United States Patent 11,931,406 (FLAVIVIRUS VACCINE) - sequence listing, part 58

SEQ ID NO: 20715 - RNA, 9873 nt, Artificial Sequence
  derived and/or modified CDS sequence (opt5) from DENV-3__FJ205871__SS-prME
accagccugugccucaugaugauccugcccgccgcucuugccuuccaccugacaucccgggacggcgaaccucggaugauuguggggaagaacgaacgcggaaagucucuccuguuuaagacggcgagcggcaucaauauguguacccuuauugcuauggaucugggggaaaugugcgacgauacagucaccuacaaguguccgcacaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggcgagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacacgaucggagugcuggagcagggcaaacggacccuuacaccucagcccauggagcugaaguacucuuggaaaaccugggggaaggccaagauugucacagccgaaacccaaaacuccagcuucaucauugauggaccuaauacacccgagugcccgucugcuuccagagcguggaacgugugggaaguggaggacuauggcuuuggcgucuucaccacgaauaucuggcucaaacugcgcgaagccuacacacagcugugugaccaccggcuuaugagcgcugccguuaaggaugagagagccgugcacgcugacaugggguacuggaucgagucccagaaaaacggaucuuggaagcucgaaaaagccagccugauugaggugaagaccugcaccuggccuaagucccauacacuguggucuaauggcguccucgaaagcgauaugaucauucccaaaucccuggcggggccuaucagccagcacaacuaucgccccggauaccauacccaaacggcuggcccuuggcaccuugggaagcuggagcucgacuuuaauuauugcgagggaacaaccgugguuauuacagaaaacuguggcacccggggccccucucugagaacaaccacgguguccgggaaacugauccacgaguggugcugucgcagcugcacccuuccgccucuccgguacaugggagaagauggcuguugguaugggauggagaucagacccauuucugaaaaggaggagaauauggucaaaucccuggugagcgccggaucuggcaagguugacaacuucacaaugggggugcugugccucgccauccuguuugaagaggucaugcggggaaaguucggcaaaaagcauaugauugcuggcguguucuuuaccuucguucuucugcucagcgggcagaucacauggcgcgauauggcccacacccugauuaugaucggauccaaugcgagcgacagaaugggcaugggggugacguaccuggcucuuauugccacauuuaaaauccagcccuuccuggcccucggauuuuuccugcggaagcucaccucuagagaaaaccugcuucugggcgucgggcucgcuauggccacaacccugcaacugccugaggauaucgaacagauggcuaauggaauugcccuuggccugauggcgcucaaacugaccacacaguuugagacguaucagcucuggaccgcccugaucucccuuacauguagcaacaccauuuucacacugaccguggcuuggcgcacggccacacucauccuggcuggcgugucccugcuuccggucugccaaucuagcuccaugcggaagaccgacuggcugcccaugaccguugccgccaugggggugccuccccucccucuguuuauuuucucucucaaggauacacugaaaagacgcagcuggccccuuaaugagggagugauggcugucggccugguguccauccuggcgucuagccuccugagaaacgacguuccuauggccgggccccuuguggcuggaggccugcucaucgccuguuacgucauuaccgggacauccgccgaucugacgguggaaaaggcugccgacguuaccugggaggaagaggcggaacagacaggagugagccauaaccucaugaucaccgucgacgaugacggcacaaugcggauuaaagaugacgagaccgagaauauccugacggugcuucugaagaccgcucugcucauugucucuggcaucuuuccguacuccaucccugccacacugcuuguguggcacaccuggcagaaacagacacaacgcagcgggguucugugggaugugcccucuccucccgaaacccagaaggccgagcucgaagagggagucuauagaauuaaacagcagggcaucuucgggaagacacaagugggaguuggcgugcagaaggagggggucuuucauacgauguggcacgugacccggggagcugugcugacauacaacggcaaacgccucgaaccgaauugggccuccguuaagaaagaccugauuagcuauggcgggggauggagacuuucugcgcaguggcaaaagggcgaggaaguccaggugaucgcuguggagccugggaaaaaccccaagaauuuccagaccaugccuggaaccuuccagacaacgaccggcgaaauuggggccaucgcccuggauuuuaagcccggaacauccggcagccccauuaucaaccgggagggcaaagucguggggcuguacggaaauggcguugugaccaagaacgggggauaugucuccggcaucgcucaaacaaaugccgagccugacgggccgacccccgaacucgaggaagagauguucaaaaagcgcaaccugacgauuauggaucuucacccuggcagcggaaaaacaagaaaguaccugcccgcuaucgugcgggaagccauuaagcgcagacuccggacccugauccucgcgccuaccagaguuguggccgcugagauggaggaagcccugaaaggccuucccauucgcuaucagacaaccgcuacaaagucugagcauaccgggcgggaaaucgucgaccugaugugccacgccacguuuacaaugagacugcucagcccugugcgcguuccgaauuacaaccugaucauuauggaugaggcccauuucaccgaccccgcuuccaucgcggcccggggauacauuucuacaagagugggcaugggggaagcugccgccaucuuuaugaccgcuacgccucccggaaccgccgaugcguucccucagagcaaugcucccauucaggacgaggagcgcgacaucccggaacgguccuggaacucuggcaaugaguggaucacagauuuugccgggaaaaccgucugguucgugccuagcauuaaggccggcaacgacaucgcuaacugucuucgcaaaaauggaaagaaggugauucaacuguccagaaaaacauuugauaccgaauaucagaagacaaaacucaacgacugggauuucgucguuaccacggacaucucugagaugggcgccaauuuuaaggcggaucgggugauugaccccagacggugccugaaacccgugauccugacagaugggccugagcgcgucauucucgccggacccaugccugugaccgcugccagcgcugcccagagacggggccgcguugggagaaacccgcagaaggaaaaugaccaauacaucuucaccggacagccccuuaacaaugaugaggaccacgcucauuggacagaagccaagaugcugcuggacaacaucaauaccccugagggcauuauccccgcccucuucgaaccugagcgggagaaauccgccgcuauugauggggaauauagacugaagggcgagagccgcaaaacauuuguggaacuuaugcggagaggagaccugcccgucuggcucgcccacaagguggcuucugagggcaucaaauacacggaucgcaaguggugcuucgacgggcagcggaacaaucagauucuggaagagaacauggauguugagaucuggaccaaagaaggagagaagaagaaacugagaccgcgcuggcucgacgcccggacauauuccgauccucuugcccugaaggaauuuaaagacuucgcugcgggcagaaagagcaucgcccuggaucucgugaccgagauugggcgcguccccucucaccuggcucauagaacacggaaugcccuugacaaccuggugaugcuccacaccuccgaacauggaggcaaagccuaccgccacgcugucgaggagcugccugaaacgauggagacccugcuccuucugggccugaugauccuccugacagggggagccaugcuuuuucugauuagcggcaaggggaucggaaagaccuccauuggccucaucugugugaucgcgucuagcgggaugcuguggauggccgaaauuccccugcaauggaucgcuuccgccauuguucucgaguucuuuaugauggugcuucugaucccugagcccgaaaaacagagaacaccgcaggauaaucaacuggcuuauguggucauuggaauccucacccuggccgcgauuaucgccgcuaacgagaugggccuucuggaaacgacaaagcgggaccucggcaugagcaaagagccugggguugugucucccaccuccuaccuggauguggaccugcaccccgccagcgcuuggacacucuacgccgucgcuaccaccgugaucacaccuaugcuucgccauacgauugaaaauucuaccgccaacguuagccuggcggccaucgcuaaccaggccgugguccugaugggacucgacaagggcuggccgauuuccaaaauggaucugggggugccccuucuggcucucggaugcuauucucaggucaauccucugacacugaccgccgccgugcuccuucugaucacacacuacgcgauuaucggccccgggcugcaggcuaaggccaccagagaggcucaaaagcggacggccgccggaaucaugaaaaacccuacaguugacggcauuaugaccaucgaucucgaccccgugauuuaugauagcaaguucgagaaacagcugggccaggucaugcuucuggugcucugugcuguucagcugcugcucaugagaaccuccugggcccuuugcgaagcgcugacacuggccaccgggccuaucacaacgcucugggagggaucuccgggcaaguuuuggaauaccacaauugcugugagcauggccaacaucuuccgcggguccuaccuggcuggagccggccuugcguuuagcaucaugaaaucugucgggaccggaaagcggggcacaggcucccaaggggaaacccugggagagaaguggaaaaagaaacucaaucagcugagcagaaaggaguucgaccuguauaaaaaguccggcauuacggagguggaucgcaccgaggccaaagaagggcucaagcggggagagaucacacaucacgcugugucuagaggcagcgccaaacuucagugguuuguugaacggaacauggucauucccgaggggcgcgugaucgaccugggauguggcagaggcgggugguccuacuauugcgcuggacugaaaaaggugaccgaaguccggggcuacacaaaagggggaccuggccaugaggagcccguuccuaugucuaccuacggguggaauauugugaagcucaugagcggaaaagauguguucuaucugcccccggaaaagugugacacacuucugugcgauaucggcgaguccagcccuucucccaccgucgaagagucccgcacgauuagagugcucaagaugguugagcccuggcugaaaaacaaucaguucuguaucaaggugcugaacccuuacaugcccacagucaucgaacaccucgagcggcuucaacgcaaacacggcgggaugcuggugagaaauccucugagccggaacucuacccaugaaauguauuggauuuccaauggaaccggcaacaucguugccagcgugaauauggucucucgccuccugcuuaacagauuuacaaugacgcaccggagaccgaccauugagaaggacguggaucugggggcuggaacacgccaugugaacgccgaacccgagaccccuaauauggacgucaucggcgagcggauuaaaagaaucaaggaagaacacaacagcacauggcacuacgacgaugaaaaucccuauaagaccugggcguaccauggguccuaugagguuaaagccacaggaucugcuagcuccaugaucaacggcguggugaagcuccugaccaaaccuugggacgucgugcccaugguuacgcagauggccaugaccgauacaaccccguucggccagcaacgcguguuuaaggaaaaagucgacacacggaccccuagaagcaugcccgggacgcgccgggugaugggaauuacagcugaguggcuguggagaacccucggccgcaauaagaagccucggcugugcacaagagaggaguucaccaaaaagguucgcacgaacgccgccaugggggcgguguuuaccgaggaaaaucagugggauuccgcuaaagccgccgucgaggacgaagauuucuggaaacuuguggaccgggagagagagcugcacaaacucggaaaguguggcucuugcguuuacaacaugauggggaaacgcgaaaagaagcugggcgaguuuggaaaagcuaagggcagcagagccaucugguacauguggcuuggggcucgguaucuggaguucgaggcccucggauuucugaaugaggaucauugguucucccgcgaaaacucuuacagcggcguggagggggaaggacugcacaaacucggcuauauucugagagacaucuccaagauucccgggggcgcgauguacgccgaugacacagcuggaugggacacccggaucacagaggaugaccuucauaaugaagagaaaaucacccagcagauggauccugagcacagacaacuggccaacgcuauuuuuaagcucacauaucagaauaaggucgugaaaguccagcggcccaccccgacgggcacagugauggacaucauuucucgcaaggaucagagagggagcggacaaguuggcaccuacgggcugaacaccuucacaaauauggaagcccagcuuauccggcagauggagggagaaggcgugcuguccaaagcggaccucgagaacccucaucugcccgaaaagaaaauuacccaguggcuggagacaaagggggucgagcgccucaagagaauggccaucagcggcgaugacugcguggugaaacccaucgaugaccgguuugcuaacgcccugcuugcucugaaugauaugggaaagguucgcaaagacauuccucaauggcagccgucuaagggcuggcaugauuggcaacaggugcccuucuguucccaccauuuccacgaacucaucaugaaagacgggagaaagcuggucgugccuugccggccccaagacgagcuuauuggacgcgccagaaucagccagggcgcuggguggucucugcgggaaacggccugucucggaaaggcguaugcccagauguggucccugauguacuuucaccgcagagaucugcggcucgcuagcaacgccauuugcucugccguuccugugcauuggguccccaccucccgcacaaccuggagcauccacgcucaucaccaauggaugacaaccgaggacaugcugacgguguggaauagagucuggauugaagauaacccuuggauggaggacaaaacccccgugacaaccugggagaauguuccguaccuuggcaagcgggaagaucaguggugugggucccugaucggccucacaagcagagccaccugggcgcagaacaucccuacggcuauucagcaagugcgcucucugaucggaaaugaggaguuccuugacuauaugcccagcaugaaacgguuuagaaaggaggaggaauccgagggcgccauuugguga

SEQ ID NO: 20716 - RNA, 9873 nt, Artificial Sequence
  derived and/or modified CDS sequence (opt5) from DENV-3__FJ390375__SS-prME
accagccugugccucaugaugauccugcccgccgcucuugccuuccaccugacaucccgggacggcgaaccucggaugauuguggggaagaacgaacgcggaaagucucuccuguuuaagacggcgagcggcaucaauauguguacccuuauugcuauggaucugggggaaaugugcgacgauacagugaccuacaaguguccgcacaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacacgaucggagugcuggagcagggcaaacggacccuuacaccucagcccauggagcugaaguacucuuggaaaaccugggggaaggccaagauugucacagccgaaacccaaaacuccagcuucaucauugauggaccuaauacacccgagugcccgucugcuuccagagcguggaacgugugggaaguggaggacuauggcuuuggcgucuucaccacgaauaucuggcucaaacugcgcgaaguuuacacacagcugugugaccaccggcuuaugagcgccgcugugaaggaugagagagccgugcacgccgacaugggguacuggaucgagucccagaaaaacggaucuuggaagcucgaaaaagcuagccugauugaggucaagaccugcaccuggccuaagucccauacacuguggucuaauggcgugcucgaaagcgauaugaucauucccaaaucccuggccgggccuaucagccagcacaacuaucgccccggauaccauacccaaacggcgggcccuuggcaccuugggaagcuggagcucgacuuuaauuauugcgagggaacaaccguugugauuacagaaaacuguggcacccggggccccucucugagaacaaccacggucuccgggaaacugauccacgaguggugcugucgcagcugcacccuuccgccucuccgguacaugggagaagauggcuguugguaugggauggagaucagacccauuucugaaaaggaggagaauauggugaaaucccugguuagcgcuggaucuggcaagguggacaacuucacaauggggguccugugccucgccauccuguuugaagaggugaugcggggaaaguucggcaaaaagcauaugauugccggcguuuucuuuaccuucgugcuucugcucagcgggcagaucacauggcgcgauauggcucacacccugauuaugaucggauccaaugccagcgacagaaugggcaugggggucacguaccuggcgcuuauugcuacauuuaaaauccagcccuuccuggcccucggauuuuuccugcggaagcucaccucuagagaaaaccugcuucugggcguggggcucgccauggcuacaacccugcaacugccugaggauaucgaacagauggccaauggaauugcucuuggccugauggcccucaaacugaccacacaguuugagacguaucagcucuggaccgcgcugaucucccuuacauguagcaacaccauuuucacacugaccguggccuggcgcacggcuacacucauccuggccggcgucucccugcuuccgguuugccaaucuagcuccaugcggaagaccgacuggcugcccaugaccguggcugccaugggggugccuccccucccucuguuuauuuucucucucaaggauacacugaaaagacgcagcuggccccuuaaugagggagucauggccgugggccugguuuccauccuggcuucuagccuccugagaaacgacgugccuauggcggggccccuugucgccggaggccugcucaucgcuuguuacgugauuaccgggacauccgccgaucugacgguugaaaaggccgcugacgugaccugggaggaagaggccgaacagacaggagucagccauaaccucaugaucaccguggacgaugacggcacaaugcggauuaaagaugacgagaccgagaauauccugacgguccuucugaagaccgcgcugcucauugugucuggcaucuuuccguacuccaucccugcuacacugcuuguuuggcacaccuggcagaaacagacacaacgcagcggggugcugugggauguccccucuccucccgaaacccagaaggccgagcucgaagagggaguguauagaauuaaacagcagggcaucuucgggaagacacaaguuggagugggcguccagaaggaggggguguuucauacgauguggcacgugacccggggagccguucugacauacaacggcaaacgccucgaaccgaauugggcuuccgucaagaaagaccugauuagcuauggcgggggauggagacuuucugcccaguggcaaaagggcgaggaaguccaggugaucgcggucgagccugggaaaaaccccaagaauuuccagaccaugccuggaaccuuccagacaacgaccggcgaaauuggggcuaucgcccuggauuuuaagcccggaacauccggcagccccauuaucaaccgggagggcaaagugguugggcuguacggaaauggcguggucaccaagaacgggggauauguguccggcaucgcccaaacaaaugcugagccugacgggccgacccccgaacucgaggaagagauguucaaaaagcgcaaccugacgauuauggaucuucacccuggcagcggaaaaacaagaaaguaccugcccgccaucguucgggaagcuauuaagcgcagacuccggacccugauccucgccccuaccagaguggucgcggccgagauggaggaagcucugaaaggccuucccauucgcuaucagacaaccgccacaaagucugagcauaccgggcgggaaaucguggaccugaugugccacgcuacguuuacaaugagacugcucagcccuguucgcgugccgaauuacaaccugaucauuauggaugaggcccauuucaccgaccccgccuccaucgcugcgcggggauacauuucuacaagagucggcaugggggaagccgcugccaucuuuaugaccgccacgccucccggaaccgcugaugccuucccucagagcaaugcgcccauucaggacgaggagcgcgacaucccggaacgguccuggaacucuggcaaugaguggaucacagauuuugcugggaaaaccgugugguucgugccuagcauuaaggccggcaacgacaucgccaacugucuucgcaaaaauggaaagaaggucauucaacuguccagaaaaacauuugauaccgaauaucagaagacaaaacucaacgacugggauuucguugugaccacggacaucucugagaugggcgcuaauuuuaaggccgaucgggugauugaccccagacggugccugaaacccgucauccugacagaugggccugagcgcgugauucucgcgggacccaugccuguuaccgccgcuagcgccgcucagagacggggccgcguggggagaaacccgcagaaggaaaaugaccaauacaucuucaccggacagccccuuaacaaugaugaggaccacgcccauuggacagaagcuaagaugcugcuggacaacaucaauaccccugagggcauuauccccgcccucuucgaaccugagcgggagaaauccgcggccauugauggggaauauagacugaagggcgagagccgcaaaacauuugucgaacuuaugcggagaggagaccugcccguguggcucgcucacaagguugccucugagggcaucaaauacacggaucgcaaguggugcuucgacgggcagcggaacaaucagauucuggaagagaacauggauguggagaucuggaccaaagaaggagagaagaagaaacugagaccgcgcuggcucgacgcucggacauauuccgauccucuugcccugaaggaauuuaaagacuucgccgcuggcagaaagagcaucgcgcuggaucucgucaccgagauugggcgcgugcccucucaccuggcccauagaacacggaaugcucuugacaaccuggucaugcuccacaccuccgaacauggaggcaaagccuaccgccacgccguggaggagcugccugaaacgauggagacccugcuccuucugggccugaugauccuccugacagggggagcuaugcuuuuucugauuagcggcaaggggaucggaaagaccuccauuggccucaucuguguuaucgccucuagcgggaugcuguggauggcggaaauuccccugcaauggaucgccuccgcuauugugcucgaguucuuuaugauggugcuucugaucccugagcccgaaaaacagagaacaccgcaggauaaucaacuggccuaugucguuauuggaauccucacccuggcugccauuaucgcggccaacgagaugggccuucuggaaacgacaaagcgggaccucggcaugagcaaagagccugggguggugucucccaccuccuaccuggaugucgaccugcaccccgcuagcgccuggacacucuacgcuguggccaccaccguuaucacaccuaugcuucgccauacgauugaaaauucuaccgcuaacgugagccuggccgcgaucgccaaccaggcugucgugcugaugggacucgacaagggcuggccgauuuccaaaauggaucugggggucccccuucuggcccucggaugcuauucucaggugaauccucugacacugaccgcugccguucuccuucugaucacacacuacgccauuaucggccccgggcugcaggcgaaggcuaccagagaggcccaaaagcggacggcugccggaaucaugaaaaacccuacaguggacggcauuaugaccaucgaucucgaccccgucauuuaugauagcaaguucgagaaacagcugggccaggugaugcuucugguucucugugccgugcagcugcugcucaugagaaccuccugggcucuuugcgaagcccugacacuggcgaccgggccuaucacaacgcucugggagggaucuccgggcaaguuuuggaauaccacaauugccgucagcauggcuaacaucuuccgcggguccuaccuggccggagcuggccuugccuuuagcaucaugaaaucuguggggaccggaaagcggggcacaggcucccaaggggaaacccugggagagaaguggaaaaagaaacucaaucagcugagcagaaaggaguucgaccuguauaaaaaguccggcauuacggagguggaucgcaccgaggcgaaagaagggcucaagcggggagagaucacacaucacgccguuucuagaggcagcgcuaaacuucagugguuugucgaacggaacauggugauucccgaggggcgcgugaucgaccugggauguggcagaggcgggugguccuacuauugcgccggacugaaaaaggucaccgaaguucggggcuacacaaaagggggaccuggccaugaggagcccgugccuaugucuaccuacggguggaauauugugaagcucaugagcggaaaagaugucuucuaucugcccccggaaaagugugacacacuucugugcgauaucggcgaguccagcccuucucccaccguggaagagucccgcacgauuagaguucucaagaugguggagcccuggcugaaaaacaaucaguucuguaucaagguccugaacccuuacaugcccacagugaucgaacaccucgagcggcuucaacgcaaacacggcgggaugcugguuagaaauccucugagccggaacucuacccaugaaauguauuggauuuccaauggaaccggcaacaucguggcuagcgucaauauggugucucgccuccugcuuaacagauuuacaaugacgcaccggagaccgaccauugagaaggacguggaucugggggccggaacacgccaugucaacgcugaacccgagaccccuaauauggacguuaucggcgagcggauuaaaagaaucaaggaagaacacaacagcacauggcacuacgacgaugaaaaucccuauaagaccugggccuaccauggguccuaugaggugaaagcgacaggaucugccagcuccaugaucaacggcguggucaagcuccugaccaaaccuugggacgugguucccauggugacgcagauggcuaugaccgauacaaccccguucggccagcaacgcgucuuuaaggaaaaaguggacacacggaccccuagaagcaugcccgggacgcgccggguuaugggaauuacagccgaguggcuguggagaacccucggccgcaauaagaagccucggcugugcacaagagaggaguucaccaaaaaggugcgcacgaacgcugccaugggggccgucuuuaccgaggaaaaucagugggauuccgcgaaagcugccguggaggacgaagauuucuggaaacuuguugaccgggagagagagcugcacaaacucggaaaguguggcucuugcguguacaacaugauggggaaacgcgaaaagaagcugggcgaguuuggaaaagccaagggcagcagagcuaucugguacauguggcuuggggcccgguaucuggaguucgaggcucucggauuucugaaugaggaucauugguucucccgcgaaaacucuuacagcggcgucgagggggaaggacugcacaaacucggcuauauucugagagacaucuccaagauucccgggggcgccauguacgcggaugacacagccggaugggacacccggaucacagaggaugaccuucauaaugaagagaaaaucacccagcagauggauccugagcacagacaacuggcuaacgccauuuuuaagcucacauaucagaauaagguggucaaagugcagcggcccaccccgacgggcacaguuauggacaucauuucucgcaaggaucagagagggagcggacaagugggcaccuacgggcugaacaccuucacaaauauggaagcucagcuuauccggcagauggagggagaaggcguccuguccaaagccgaccucgagaacccucaucugcccgaaaagaaaauuacccaguggcuggagacaaaggggguggagcgccucaagagaauggcgaucagcggcgaugacugcgugguuaaacccaucgaugaccgguuugccaacgcucugcuugcccugaaugauaugggaaaggugcgcaaagacauuccucaauggcagccgucuaagggcuggcaugauuggcagcagguccccuucuguucccaccauuuccacgaacucaucaugaaagacgggagaaagcuggugguuccuugccggccccaagacgagcuuauuggacgcgcuagaaucagccagggcgccggguggucucugcgggaaacggcuugucucggaaaggccuaugcgcagauguggucccugauguacuuucaccgcagagaucugcggcucgccagcaacgcuauuugcucugccgugccuguccauugggugcccaccucccgcacaaccuggagcauccacgcccaucaccaauggaugacaaccgaggacaugcugacggucuggaauagaguguggauugaagauaacccuuggauggaggacaaaacccccguuacaaccugggagaaugugccguaccuuggcaagcgggaagaucaguggugugggucccugaucggccucacaagcagagcuaccugggcccagaacaucccuacggcgauucagcaaguccgcucucugaucggaaaugaggaguuccuugacuauaugcccagcaugaaacgguuuagaaaggaggaggaauccgagggcgcuauuugguga

SEQ ID NO: 20717 - RNA, 9873 nt, Artificial Sequence
  derived and/or modified CDS sequence (opt5) from DENV-3__FJ390376__SS-prME
accagccugugccucaugaugauccugcccgccgcucuugccuuccaccugacgucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcacaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucacccugcuuaugcuggugacaccuucuaugaccaugagauguguuggagugggcaaccgggacuuugucgaagggcucagcggagcuaccuggguggaugugguccuggagcacggcgggugcguuacaacgauggccaagaauaaacccacccuggacaucgagcuccagaagacagaagcuacccaacuggccacacuucgcaaacuguguauugagggaaagaucaccaacauuacgacagauuccagaugcccuacccagggcgaagcggugcucccggaggaacaggaccagaauuauguguguaaacacaccuacgucgaucggggcugggggaacggaugcggccuguucgggaagggaagccuugugacaugcgccaaguuucaaugucuggagcccaucgagggcaaaguugugcaguaugaaaaucucaaguacaccgucauuaucacagugcauacgggggaccagcaccagguuggaaacgagacccaaggcgugacagcugaaaucaccccucaggccucuacaaccgaggcuauucugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucaaaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagauguucccuguaaaaucccuuucagcacagaggacggccaagggaaggcccauaacggaagacugauuaccgcgaaucccguggucacgaaaaaggaggaacccgugaacaucgaggcugaaccuccguucggcgaguccaauauugugaucgggauuggcgauaacgcccugaaaaucaauugguauaagaagggaucuagcaucggcaaaauguuugaagccacagcuagaggggccagacgcauggcuauucuuggagacaccgccugggauuucggcuccguugggggaguccucaacagccugggcaagauggugcaccagaucuuugggucugcguacaccgcccuguucuccggcgugagcugggucaugaaaauuggaaucggcgugcuccugacauggauugggcuuaauucuaagaacaccagcauguccuuuucuugcaucgcuauuggaaucaucacacuguaucucggcgccguugugcaggcugacauggggugugucauuaauuggaaaggaaaggagcugaagugcggcagcgggaucuucgugacgaacgagguucauaccuggacagaacaguacaaauuucaagccgauucccccaagcggcuggcgaccgccauugcuggcgccugggagaauggaguguguggcaucagaagcacaacccgcauggaaaaccuucucuggaaacagauugcuaaugagcugaacuauauccugugggaaaauaacaucaagcucacggucgugguuggggacauuaucggagugcuggagcagggcaaacggacccuuacaccucagcccauggagcugaaguacucuuggaaaaccugggggaaggccaagauugucacagccgaaacccaaaacuccagcuucaucauugauggaccuaauacacccgagugcccgucugcuuccagagcguggaacgugugggaaguggaggacuauggcuuuggcgucuucaccacgaauaucuggcucaaacugcgcgaaguuuacacacagcugugugaccaccggcuuaugagcgccgcugugaaggaugagagagccgugcacgccgacaugggguacuggaucgagucccagaaaaacggaucuuggaagcucgaaaaagcuagccugauugaggucaagaccugcaccuggccuaagucccauacacuguggucuaauggcgugcucgaaagcgauaugaucauucccaaaucccuggccgggccuaucagccagcacaacuaucgccccggauaccauacccaaacggcgggcccuuggcaccuugggaagcuggagcucgacuuuaauuauugcgagggaacaaccguugugauuacagaaaacuguggcacccggggccccucucugagaacaaccacggucuccgggaaacugauccacgaguggugcugucgcagcugcacccuuccgccucuccgguacaugggagaagauggcuguugguaugggauggagaucagacccauuucugaacgggaggagaauauggugaagucccugguuagcgcuggaucuggcaaaguggacaacuucacaauggggguccugugccucgccauccuguuugaagaggugaugcgcggaaaguucggcaagaaacauaugauugccggcguuuucuuuaccuucgugcuucugcucagcgggcagaucauuuggagagauauggcucacacacugaucaugauuggauccaaugccagcgaccggaugggcaugggggucaccuaccuggcgcuuaucgcuacguuuaagauccagcccuuccuggcccucggauuuuuccugagaaaacucacaucucgcgaaaaccugcuucugggcguggggcucgccauggcuaccacacugcaacugccugaggauauugaacagauggccaauggaaucgcucuuggccugauggcccucaagcugauuacccaguuugagaccuaucagcucuggacagcgcugaucucccuuacguguagcaacaccauuuucacacugaccguggccuggcggacagcuacccucauccuggccggcgucucccugcuuccgguuugccaaucuagcuccaugagaaaaacggacuggcugcccaugacaguggcugccaugggggugccuccccucccucuguuuaucuucucucucaaggauacccugaagcgcagaagcuggccccuuaaugagggagucauggccgugggccugguuuccauucuggcuucuagccuccugcggaacgacgugccuauggcggggccccuugucgccggaggccugcucaucgcuuguuacgugauuaccgggacauccgccgaucugaccguugaaaaagccgcugacgugacaugggaggaagaggccgaacagacgggagucagccauaaccucaugaucaccguggacgaugacggcacaaugcgcauuaaggaugacgagaccgagaauauccugacaguccuucugaaaaccgcgcugcucaucgugucuggcauuuuuccguacuccaucccugcuacgcugcuuguuuggcacaccuggcagaagcagacacaaagaagcggggugcugugggauguccccucuccucccgaaacccagaaagccgagcucgaagagggaguguaucggauuaagcagcagggcaucuucgggaaaacacaaguuggagugggcguccagaaggaggggguguuucauaccauguggcacgugacacgcggagccguucugacguacaacggcaagagacucgaaccgaauugggcuuccgucaaaaaggaccugauuagcuauggcgggggauggcggcuuucugcccaguggcaaaaaggcgaggaaguccaggugaucgcggucgagccugggaagaaccccaaaaauuuccagaccaugccuggaacauuccagaccaccacaggcgaaauuggggcuaucgcccuggauuuuaagcccggaacguccggcagccccaucauuaaccgcgagggcaaggugguugggcuguacggaaauggcguggucaccaaaaacgggggauauguguccggcaucgcccaaacaaaugcugagccugacgggccgacccccgaacucgaggaagagauguucaagaaaagaaaccugacaauuauggaucuucacccuggcagcggaaagacccggaaauaccugcccgccaucguucgcgaagcuauuaagagacggcucagaacgcugauccucgccccuacacgcguggucgcggccgagauggaggaagcucugaagggccuucccauccgguaucagaccaccgccacaaaaucugagcauaccgggagagaaauuguggaccugaugugccacgcuacauuuaccaugcgccugcucagcccuguucgggugccgaauuacaaccugaucauuauggaugaggcccauuucacggaccccgccuccaucgcugcgagaggauacauuucuacacgcgucggcaugggggaagccgcugccaucuuuaugaccgccacaccucccggaaccgcugaugccuucccucagagcaaugcgcccauccaggacgaggagcgggacauuccggaaagauccuggaacucuggcaaugaguggaucacggauuuugcugggaagaccgugugguucgugccuagcauuaaagccggcaacgacaucgccaacugucuucgcaagaauggcaaaaaggucauucaacugucccggaagacauuugauaccgaauaucagaaaacaaagcucaacgacugggauuucguugugaccacagacaucucugagaugggagcuaauuuuaaagccgauagagugauugacccccggcgcugccugaagcccgucauccugaccgaugggccugagagagugauccucgcgggacccaugccuguuacggccgcuagcgccgcucagcggcgcggcagaguggggcggaacccgcagaaagaaaaugaccaauacauuuucacaggacagccccuuaacaaugaugaggaccacgcccauuggaccgaagcuaagaugcugcuggacaacaucaauaccccugagggcauuauccccgcccucuucgaaccugagagagagaaguccgcggccauugauggggaauaucgccugaaaggcgagagccggaagacauuugucgaacuuaugagacgcggagaccugcccguguggcucgcucacaaaguugccucugagggcaucaaguacaccgaucggaaauggugcuucgacgggcagagaaacaaucagauccuggaagagaacauggauguggagauuuggacaaaggaaggagagaaaaagaagcugcgcccgcgguggcucgacgcuagaacguauuccgauccucuugcccugaaagaauuuaaggacuucgccgcuggccgcaaaagcaucgcgcuggaucucgucaccgagauugggagagugcccucucaccuggcccaucggacacgcaaugcucuugacaaccuggucaugcuccacaccuccgaacauggaggcaaggccuacagacacgccguggaggagcugccugaaacaauggagacccugcuccuucugggccugaugauccuccugacagggggagcuaugcuuuuucugauuagcggcaaagggaucggaaagaccuccaucggccucauuuguguuaucgccucuagcgggaugcuguggauggcggaaauuccccugcaauggaucgccuccgcuauugugcucgaguucuuuaugauggugcuucugaucccugagcccgaaaagcagcggacaccgcaggauaaucaacuggccuaugucguuauuggaauccucacccuggcugccaucauugcggccaacgagaugggccuucuggaaacaaccaaacgcgaccucggcaugagcaaggagccugggguggugucucccacguccuaccuggaugucgaccugcaccccgcuagcgccuggacacucuacgcuguggccaccacaguuaucaccccuaugcuuagacauaccauugaaaauucuacagcuaacgugagccuggccgcgaucgccaaccaggcugucgugcugaugggacucgacaaaggcuggccgauuuccaagauggaucugggggucccccuucuggcccucggaugcuauucucaggugaauccucugacgcugaccgcugccguucuccuucugaucacacacuacgccaucauuggccccgggcugcaggcgaaagcuacccgggaggcccaaaagagaacagcugccggaaucaugaagaacccuaccguggacggcauuaugacgaucgaucucgaccccgucauuuaugauagcaaauucgagaagcagcugggccaggugaugcuucugguucucugugccgugcagcugcugcucaugcgcacauccugggcucuuugcgaagcccugacccuggcgaccgggccuaucacaacccucugggagggaucuccgggcaaauuuuggaauacaacgaucgccgucagcauggcuaacauuuuccggggguccuaccuggccggagcuggccuugccuuuagcaucaugaagucuguggggaccggaaaaagaggcacaggcucccaaggggaaacccugggagagaaguggaagaaaaagcucaaucagcugagccgcaaagaguucgaccuguauaagaaauccggcauuacagagguggaucggaccgaggcgaaggaagggcucaaaagaggagagaucacgcaucacgccguuucucggggcagcgcuaaacuucagugguuugucgaacgcaacauggugauucccgaggggagagugaucgaccugggauguggccggggcgggugguccuacuauugcgccggacugaagaaagucaccgaaguucgcggcuacacaaaagggggaccuggccaugaggagcccgugccuaugucuaccuacggguggaauauugugaaacucaugagcggaaaggaugucuucuaucugcccccggaaaaaugugacacacuucugugcgauaucggcgaguccagcccuucucccaccguggaagaguccagaacaauccggguucucaagaugguggagcccuggcugaagaacaaucaguucuguauuaaaguccugaacccuuacaugcccaccgugaucgaacaccucgagcgccuucaaagaaagcacggcgggaugcugguucggaauccucugagccgcaacucuacgcaugaaauguauuggauuuccaauggaacaggcaacaucguggcuagcgucaauauggugucuagacuccugcuuaaccgguuuaccaugacccacagacgcccgacaauugagaaagacguggaucugggggccggaacgcggcaugucaacgcugaacccgagaccccuaauauggacguuaucggcgagagaaucaagcgcauuaaagaagaacacaacagcacauggcacuacgacgaugaaaaucccuauaagaccugggccuaccauggguccuaugaggugaaggcgacaggaucugccagcuccaugaucaacggcguggucaaacuccugaccaagccuugggacgugguucccauggugacacagauggcuaugaccgauacgaccccguucggccagcaacgggucuuuaaagaaaagguggacacaagaaccccucgcagcaugcccgggacacggagaguuaugggaauuaccgccgaguggcuguggcgcacgcucggccggaauaaaaagccuagacugugcacacgcgaggaguucaccaagaaagugcggacaaacgcugccaugggggccgucuuuaccgaggaaaaucagugggauuccgcgaaggcugccguggaggacgaagauuucuggaaacuuguugacagagagcgcgagcugcacaagcucggaaaauguggcucuugcguguacaacaugauggggaagagagagaagaagcugggcgaguuuggaaaggccaaaggcagccgggcuaucugguacauguggcuuggggcccgcuaucuggaguucgaggcucucggauuucugaaugaggaucauugguucuccagagaaaacucuuacagcggcgucgagggggaaggacugcacaagcucggcuauauucugcgggacaucuccaaaauccccgggggcgccauguacgcggaugacacggccggaugggacaccagaauuacagaggaugaccuucauaaugaagagaagaucacccagcagauggauccugagcaccggcaacuggcuaacgccauuuuuaaacucacauaucagaauaagguggucaaggugcagcgccccaccccgacaggcaccguuauggacaucauuucuagaaaagaucagcgggggagcggacaagugggcacguacgggcugaacacauucaccaauauggaagcucagcuuauccgccagauggagggagaaggcguccuguccaaggccgaccucgagaacccucaucugcccgagaagaagaucacccaguggcuggagacaaaagggguggagagacucaagcggauggcgauuagcggcgaugacugcgugguuaagcccaucgaugaccgcuuugccaacgcucugcuugcccugaaugauaugggaaaagugagaaaggacauuccucaauggcagccgucuaaaggcuggcaugauuggcagcagguccccuucuguucccaccauuuccacgaacucaucaugaaggacgggcggaaacuggugguuccuugccgcccccaagacgagcuuauuggacgggcucggaucagccagggcgccggguggucucugcgcgaaaccgcuugucucggaaaggccuaugcgcagauguggucccugauguacuuucacagacgggaucugcgccucgccagcaacgcuauuugcucugccgugccuguccauugggugcccacauccagaacgaccuggagcauccacgcccaucaccaauggaugacaaccgaggacaugcugacagucuggaaucggguguggaucgaagauaacccuuggauggaggacaagacccccguuacgaccugggagaaugugccguaccuuggcaaaagagaagaucaguggugugggucccugauuggccucacaagccgcgcuaccugggcccagaacaucccuacagcgauucagcaaguccggucucugaucggaaaugaggaguuccuugacuauaugcccagcaugaagagauuucgcaaagaggaggaauccgagggcgcuauuugguga

SEQ ID NO: 20718 - RNA, 9873 nt, Artificial Sequence
  derived and/or modified CDS sequence (opt5) from DENV-3__FJ390377__SS-prME
acaagccugugccucaugaugauccugcccgccgcucuugccuuccaccugacaucccgggacggagaaccucggaugauuguggggaagaacgaacgcggaaagucucuccuguuuaagacggcgagcggcaucaauauguguacccuuauugcuauggaucugggggaaaugugcgacgauacagugaccuacaaauguccgcacaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucacccugcuuaugcuggugacaccuucuaugaccaugagauguguuggagugggcaaccgggacuuugucgaagggcucagcggagcuaccuggguggaugugguccuggagcacggcgggugcguuacaacgauggccaagaauaaacccacccuggacaucgagcuccagaagacagaagcuacccaacuggccacacuucgcaaacuguguauugagggaaagaucaccaacauuacgacagauuccagaugcccuacccagggcgaagcggugcucccggaggaacaggaccagaauuauguguguaaacacaccuacgucgaucggggcugggggaacggaugcggccuguucgggaagggaagccuugugacaugcgccaaguuucaaugucuggagcccaucgagggcaaaguugugcaguaugaaaaucucaaguacaccgucauuaucacagugcauacgggggaccagcaccagguuggaaacgagacccaaggcgugacagcugaaaucaccccucaggccucuacaaccgaggcuauucugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucaaaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagauguucccuguaaaaucccuuucagcacagaggacggccaagggaaggcccauaacggaagacugauuaccgcgaaucccguggucacgaaaaaggaggaacccgugaacaucgaggcugaaccuccguucggcgaguccaauauugugaucgggauuggcgauaacgcccugaaaaucaauugguauaagaagggaucuagcaucggcaaaauguuugaagccacagcuagaggggccagacgcauggcuauucuuggagacaccgccugggauuucggcuccguugggggaguccucaacagccugggcaagauggugcaccagaucuuugggucugcguacaccgcccuguucuccggcgugagcugggucaugaaaauuggaaucggcgugcuccugacauggauugggcuuaauucuaagaacaccagcauguccuuuucuugcaucgcuauuggaaucaucacacuguaucucggcgccguugugcaggcugacauggggugugucauuaauuggaaaggaaaggagcugaagugcggcagcgggaucuucgugacgaacgagguucauaccuggacagaacaguacaaauuucaagccgauucccccaagcggcuggcgaccgccauugcuggcgccugggagaauggaguguguggcaucagaagcacaacccgcauggaaaaccuucucuggaaacagauugcuaaugagcugaacuauauccugugggaaaauaacaucaagcucacggucgugguuggggacauuaucggagugcuggagcagggcaaacggacccuuacaccucagcccauggagcugaaguacucuuggaaaaccugggggaaggccaagauugucacagccgaaacccaaaacuccagcuucaucauugauggaccuaauacacccgagugcccgucugcuuccagagcguggaacgugugggaaguggaggacuauggcuuuggcgucuucaccacgaauaucuggcucaaacugcgcgaaguuuacacacagcugugugaccaccggcuuaugagcgccgcugugaaggaugagagagccgugcacgccgacaugggguacuggaucgagucccagaaaaacggaucuuggaagcucgaaaaagcuagccugauugaggucaagaccugcaccuggccuaagucccauacacuguggucuaauggcgugcucgaaagcgauaugaucauucccaaaucccuggccgggccuaucagccagcacaacuaucgccccggauaccauacccaaacggcgggcccuuggcaccuugggaagcuggagcucgacuuuaauuauugcgagggaacaaccguugugauuacagaaaacuguggcacccggggccccucucugagaacaaccacggucuccgggaaacugauccacgaguggugcugucgcagcugcacccuuccgccucuccgguacaugggagaagauggcuguugguaugggauggagaucagacccauuucugaaaaggaggagaauauggugaaaucccugguuagcgcuggaucuggcaagguggacaacuucacaauggggguccugugccucgccauccuguuugaagaggugaugcggggaaaguucggcaaaaagcauaugauugccggcguuuucuuuaccuucgugcuucugcucagcgggcagaucacauggcgcgauauggcucacacccugauuaugaucggauccaaugccagcgacagaaugggcaugggggucacguaccuggcgcuuauugcuacauuuaaaauccagcccuuccuggcccucggauuuuuccugcggaagcucaccucuagagaaaaccugcuucugggcguggggcucgccauggcuacaacccugcaacugccugaggauaucgaacagauggccaauggaauugcucuuggccugauggcccucaaacugaucacccaguuugagacauaucagcucuggacggcgcugauuucccuuaccuguagcaacacaaucuucacccugacaguggccuggcgcaccgcuacgcucauucuggccggcgucucccugcuuccgguuugccaaucuagcuccaugcggaagacagacuggcugcccaugaccguggcugccaugggggugccuccccucccucuguuuaucuucucucucaaggauacccugaaaagacgcagcuggccccuuaaugagggagucauggccgugggccugguuuccauccuggcuucuagccuccugagaaacgacgugccuauggcggggccccuugucgccggaggccugcucauugcuuguuacgugaucacagggaccuccgccgaucugacaguugaaaaggccgcugacgugacgugggaggaagaggccgaacagaccggagucagccauaaccucaugauuacaguggacgaugacggcaccaugcggaucaaagaugacgagacagagaauauucugaccguccuucugaagacggcgcugcucaucgugucuggcaucuuuccguacuccauuccugcuacccugcuuguuuggcacacauggcagaaacagacccaacgcagcggggugcugugggauguccccucuccucccgaaacacagaaggccgagcucgaagagggaguguauagaaucaaacagcagggcauuuucgggaagacccaaguuggagugggcguccagaaggaggggguguuucauacaauguggcacgugacgcggggagccguucugaccuacaacggcaaacgccucgaaccgaauugggcuuccgucaagaaagaccugaucagcuauggcgggggauggagacuuucugcccaguggcaaaagggcgaggaaguccaggugauugcggucgagccugggaaaaaccccaagaauuuccagacaaugccuggaaccuuccagaccacaacgggcgaaaucggggcuauugcccuggauuuuaagcccggaaccuccggcagccccaucaucaaccgggagggcaaagugguugggcuguacggaaauggcguggucacaaagaacgggggauauguguccggcauugcccaaaccaaugcugagccugacgggccgacacccgaacucgaggaagagauguucaaaaagcgcaaccugaccaucauggaucuucacccuggcagcggaaaaacgagaaaguaccugcccgccauuguucgggaagcuaucaagcgcagacuccggacacugauucucgccccuaccagaguggucgcggccgagauggaggaagcucugaaaggccuucccauccgcuaucagaccacagccaccaagucugagcauacagggcgggaaaucguggaccugaugugccacgcuaccuuuacgaugagacugcucagcccuguucgcgugccgaauuacaaccugauuaucauggaugaggcccauuucacagaccccgccuccauugcugcgcggggauacaucucuaccagagucggcaugggggaagccgcugccauuuuuaugacagccaccccucccggaacggcugaugccuucccucagagcaaugcgcccauccaggacgaggagcgcgacaucccggaacgguccuggaacucuggcaaugaguggauuaccgauuuugcugggaaaacagugugguucgugccuagcaucaaggccggcaacgacauugccaacugucuucgcaaaaauggaaagaaggucauccaacuguccagaaaaaccuuugauacagaauaucagaagaccaaacucaacgacugggauuucguugugacaaccgacauuucugagaugggcgcuaauuuuaaggccgaucgggugaucgaccccagacggugccugaaacccgucauucugacggaugggccugagcgcgugauccucgcgggacccaugccuguuacagccgcuagcgccgcucagagacggggccgcguggggagaaacccgcagaaggaaaaugaccaauacaucuucaccggacagccccuuaacaaugaugaggaccacgcccauuggaccgaagcuaagaugcugcuggacaacauuaauacaccugagggcaucauucccgcccucuucgaaccugagcgggagaaauccgcggccaucgauggggaauauagacugaagggcgagagccgcaaaaccuuugucgaacuuaugcggagaggagaccugcccguguggcucgcucacaagguugccucugagggcauuaaauacacagaucgcaaguggugcuucgacgggcagcggaacaaucagauccuggaagagaacauggauguggagaucuggacgaaagaaggagagaagaagaaacugagaccgcgcuggcucgacgcucggaccuauuccgauccucuugcccugaaggaauuuaaagacuucgccgcuggcagaaagagcauugcgcuggaucucgucacagagaucgggcgcgugcccucucaccuggcccauagaacccggaaugcucuugacaaccuggucaugcuccacacauccgaacauggaggcaaagccuaccgccacgccguggaggagcugccugaaaccauggagacgcugcuccuucugggccugaugauucuccugaccgggggagcuaugcuuuuucugaucagcggcaaggggauuggaaagacauccaucggccucaucuguguuauugccucuagcgggaugcuguggauggcggaaaucccccugcaauggauugccuccgcuaucgugcucgaguucuuuaugauggugcuucugauuccugagcccgaaaaacagagaaccccgcaggauaaucaacuggccuaugucguuaucggcauucucacacuggcugccaucaucgcggccaacgagaugggccuucuggaaaccacgaagcgggaccucggcaugagcaaagagccugggguggugucucccacauccuaccuggaugucgaccugcaccccgcuagcgccuggacccucuacgcuguggccacaaccguuauuaccccuaugcuucgccauacaaucgaaaauucuacggcuaacgugagccuggccgcgauugccaaccaggcugucgugcugaugggacucgacaagggcuggccgaucuccaaaauggaucugggggucccccuucuggcccucggaugcuauucucaggugaauccucugacccugacagcugccguucuccuucugauuacccacuacgccaucaucggccccgggcugcaggcgaaggcuacaagagaggcccaaaagcggaccgcugccggaauuaugaaaaacccuacgguggacggcaucaugacaauugaucucgaccccgucaucuaugauagcaaguucgagaaacagcugggccaggugaugcuucugguucucugugccgugcagcugcugcucaugagaaccuccugggcucuuugcgaagcccugacccuggcgacagggccuauuaccacacucugggagggaucuccgggcaaguuuuggaauacgaccaucgccgucagcauggcuaacaucuuccgcggguccuaccuggccggagcuggccuugccuuuagcauuaugaaaucuguggggacaggaaagcggggcaccggcucccaaggggaaacacugggagagaaguggaaaaagaaacucaaucagcugagcagaaaggaguucgaccuguauaaaaaguccggcaucaccgagguggaucgcacggaggcgaaagaagggcucaagcggggagagauuacccaucacgccguuucuagaggcagcgcuaaacuucagugguuugucgaacggaacauggugauccccgaggggcgcgugauugaccugggauguggcagaggcgggugguccuacuauugcgccggacugaaaaaggucacagaaguucggggcuacaccaaagggggaccuggccaugaggagcccgugccuaugucuacauacggguggaauaucgugaagcucaugagcggaaaagaugucuucuaucugcccccggaaaagugugacacccuucugugcgauauuggcgaguccagcccuucucccacaguggaagagucccgcaccaucagaguucucaagaugguggagcccuggcugaaaaacaaucaguucuguaucaagguccugaacccuuacaugcccacggugauugaacaccucgagcggcuucaacgcaaacacggcgggaugcugguuagaaauccucugagccggaacucuacacaugaaauguauuggaucuccaauggaaccggcaacauuguggcuagcgucaauauggugucucgccuccugcuuaacagauuuaccaugacacaccggagaccgacgaucgagaaggacguggaucugggggccggaacccgccaugucaacgcugaacccgagacaccuaauauggacguuauuggcgagcggaucaaaagaaucaaggaagaacacaacagcaccuggcacuacgacgaugaaaaucccuauaagacaugggccuaccauggguccuaugaggugaaagcgaccggaucugccagcuccaugauuaacggcguggucaagcuccugacaaaaccuugggacgugguucccauggugacccagauggcuaugacggauaccacaccguucggccagcaacgcgucuuuaaggaaaaaguggacacccggacaccuagaagcaugcccgggacccgccggguuaugggaaucacggccgaguggcuguggagaacacucggccgcaauaagaagccucggcugugcaccagagaggaguucaccaagaaggugcgcaccaacgcugccaugggggccgucuuuacggaggaaaaucagugggauuccgcgaaagcugccguggaggacgaagauuucuggaaacuuguugaccgggagagagagcugcacaaacucggaaaguguggcucuugcguguacaacaugauggggaaacgcgaaaagaagcugggcgaguuuggaaaagccaagggcagcagagcuauuugguacauguggcuuggggcccgguaucuggaguucgaggcucucggauuucugaaugaggaucauugguucucccgcgaaaacucuuacagcggcgucgagggggaaggacugcacaaacucggcuauauccugagagacauuuccaagauccccgggggcgccauguacgcggaugacaccgccggaugggacacacggaucaccgaggaugaccuucauaaugaagagaaaauuacacagcagauggauccugagcacagacaacuggcuaacgccaucuuuaagcucaccuaucagaauaagguggucaaagugcagcggcccacaccgaccggcacgguuauggacauuaucucucgcaaggaucagagagggagcggacaagugggcacauacgggcugaacaccuucaccaauauggaagcucagcuuauucggcagauggagggagaaggcguccuguccaaagccgaccucgagaacccucaucugcccgaaaagaaaaucacacaguggcuggagaccaaggggguggagcgccucaagagaauggcgaucagcggcgaugacugcgugguuaaacccauugaugaccgguuugccaacgcucugcuugcccugaaugauaugggaaaggugcgcaaagacaucccucaauggcagccgucuaagggcuggcaugauuggcagcagguccccuucuguucccaccauuuccacgaacucauuaugaaagacgggagaaagcuggugguuccuugccggccccaagacgagcuuaucggacgcgcuagaauuagccagggcgccggguggucucugcgggaaacagcuugucucggaaaggccuaugcgcagauguggucccugauguacuuucaccgcagagaucugcggcucgccagcaacgcuaucugcucugccgugccuguccauugggugcccacgucccgcaccacauggagcauucacgcccaucaccaauggaugaccacagaggacaugcugaccgucuggaauagaguguggaucgaagauaacccuuggauggaggacaaaacgcccguuaccacaugggagaaugugccguaccuuggcaagcgggaagaucaguggugugggucccugaucggccucaccagcagagcuacaugggcccagaacauuccuaccgcgauccagcaaguccgcucucugauuggaaaugaggaguuccuugacuauaugcccagcaugaaacgguuuagaaaggaggaggaauccgagggcgcuaucugguga

SEQ ID NO: 20719 - RNA, 9873 nt, Artificial Sequence
  derived and/or modified CDS sequence (opt5) from DENV-3__FJ547069__SS-prME
accagccugugccugaugaugauccugcccgccgcucuugccuuccaccugacgucccgggacggcgaaccucggaugauuguggggaagaacgaacgcggaaagucucuccuguuuaagacggcgagcggcaucaauauguguacccuuauugcuauggaucugggggaaaugugcgacgauacagugaccuacaaguguccgcacaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacaaaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaaucucgggggcaccuccauuuucgccggacaucucaagugucgccugaaaauggacaaacuugagcugaaaggcaugagcuacgcuaugugcacaaacacguuugugcucaagaaagaggucucugaaacccagcacgggacaauccugaucaagguggaguacaagggagaagauguucccuguaaaauuccuuucuccaccgaggacggccaagggaaggcccauaacggaagacugaucacagcgaaucccguggucaccaaaaaggaggaacccgugaacauugaggcugaaccuccguucggcgagagcaauaucgugauugggaucggcgauaacgcccuuaaaaucaauugguauaagaagggauccucuauuggcaaaauguuugaagccacggcuagaggggcuagacgcauggcuauccucggagacacagccugggauuucggcagcguugggggaguccugaacucccugggcaagauggugcaccagauuuuugggagcgcguacaccgcccucuucucuggcguguccugggucaugaaaaucggaauuggcgugcugcuuaccuggaucgggcugaauagcaagaacacaucuaugagcuuuuccugcauugcuaucggaaucauuacccucuaucugggcgccguugugcaggcugacauggggugugucaucaauuggaaaggaaaggagcugaagugcggcucugggauuuucgugacaaacgagguucauacguggaccgaacaguacaaauuucaagccgauagccccaagcggcuugcgacagccaucgcuggcgccugggagaauggaguguguggcauuagauccaccacacgcauggaaaaccuccuguggaaacagaucgcuaaugagcugaacuauauccucugggaaaauaacauuaagcugaccgucgugguuggggacaucauuggagugcuugagcagggcaaacggacgcugaccccucagcccauggagcucaaguacagcuggaaaacaugggggaaggccaagaucgucaccgccgaaacacaaaacucuuccuucauuaucgauggaccuaauacccccgagugcccgagcgcuucuagagcguggaacgugugggaaguggaggacuauggcuuuggcgucuucacaaccaauaucuggcugaaacugcgcgaaguuuacacgcagcuuugugaccaccggcucauguccgccgcugugaaggaugagagagccgugcacgccgacaugggguacuggauugagagccagaaaaacggauccuggaagcuggaaaaggcuucucugaucgaggucaagacaugcaccuggccuaagagccauacccucugguccaauggcgugcuggaaucugauaugauuauccccaaaagccuugccgggccuauuucccagcacaacuaucgccccggauaccauacacaaaccgcgggcccuuggcaccuggggaagcucgagcuggacuuuaauuauugcgagggaacgacaguugugaucaccgaaaacuguggcacacggggccccagccugagaaccacaaccgucucugggaaacuuauccacgaguggugcugucgcuccugcacgcucccgccucugcgguacaugggagaagauggcuguugguaugggauggagauuagacccaucagcgaaaaggaggagaauauggugaaaucucugguuuccgcuggaagcggcaagguggacaacuucaccauggggguccucugccuggccauucuuuuugaagaggugaugcggggaaaguucggcaaaaagcauaugaucgccggcguuuucuuuacauucgugcugcuccugucugggcagauuaccuggcgcgauauggcucacacacugaucaugauuggaagcaaugccuccgacagaaugggcaugggggucaccuaccuugcgcugaucgcuacguuuaaaauccagcccuuccucgcccugggauuuuuccuccggaagcugacaagcagagaaaaccuucugcucggcguggggcuggccauggcuaccacacugcaacuuccugaggauauugaacagauggccaauggaaucgcucugggccucauggcccugaaacucauuacccaguuugagaccuaucagcuguggacagcgcuuaucucucugacguguuccaacaccauuuucacacucaccguggccuggcgcacagcuacccugauccuggccggcgucagccuucugccgguuugccaauccucuagcaugcggaagacggacuggcuccccaugacaguggcugccaugggggugccuccccugccucucuuuaucuucucccugaaggauacccuuaaaagacgcucuuggccccugaaugagggagucauggccgugggccugguuagcauucucgcuuccucucugcuuagaaacgacgugccuauggcggggccccuggucgccggaggccuccugaucgcuuguuacgugauuaccgggacaagcgccgaucucaccguugaaaaggccgcugacgugacaugggaggaagaggccgaacagacgggagucucccauaaccugaugaucaccguggacgaugacggcacaaugcggauuaaagaugacgagaccgagaauauccuuacaguccugcugaagaccgcgcuccugaucgugagcggcauuuuuccguacucuaucccugcuacgcuucugguuuggcacaccuggcagaaacagacacaacgcuccggggugcucugggauguccccagcccucccgaaacccagaaggccgagcuggaagagggaguguauagaauuaaacagcagggcaucuucgggaagacacaaguuggagugggcguccagaaggaggggguguuucauaccauguggcacgugacacggggagccguucucacguacaacggcaaacgccuggaaccgaauugggcuucugucaagaaagaccuuauuuccuauggcgggggauggagacugagcgcccaguggcaaaagggcgaggaaguccaggugaucgcggucgagccugggaaaaaccccaagaauuuccagaccaugccuggaacauuccagaccaccacaggcgaaauuggggcuaucgcccuggauuuuaagcccggaacgucuggcucccccaucauuaaccgggagggcaaagugguugggcucuacggaaauggcguggucaccaagaacgggggauaugugagcggcaucgcccaaacaaaugcugagccugacgggccgacccccgaacuggaggaagagauguucaaaaagcgcaaccuuacaauuauggaucugcacccuggcuccggaaaaaccagaaaguaccuccccgccaucguucgggaagcuauuaagcgcagacugcggacgcucauccuggccccuacaagaguggucgcggccgagauggaggaagcucuuaaaggccugcccauccgcuaucagaccaccgccacaaagagcgagcauaccgggcgggaaauuguggaccugaugugccacgcuacauuuaccaugagacuccugucuccuguucgcgugccgaauuacaaccuuaucauuauggaugaggcccauuucacggaccccgccagcaucgcugcgcggggauacauuuccacaagagucggcaugggggaagccgcugccaucuuuaugaccgccacaccucccggaaccgcugaugccuucccucagucuaaugcgcccauccaggacgaggagcgcgacauuccggaacggagcuggaacuccggcaaugaguggaucacggauuuugcugggaaaaccgugugguucgugccuucuauuaaggccggcaacgacaucgccaacugucugcgcaaaaauggaaagaaggucauucaacucagcagaaaaacauuugauaccgaauaucagaagacaaaacugaacgacugggauuucguugugaccacagacaucuccgagaugggcgcuaauuuuaaggccgaucgggugauugaccccagacggugccugaaacccgucauccucaccgaugggccugagcgcgugauccuugcgggacccaugccuguuacggccgcuucugccgcucagagacggggccgcguggggagaaacccgcagaaggaaaaugaccaauacauuuucacaggacagccccugaacaaugaugaggaccacgcccauuggaccgaagcuaagaugcugcucgacaacaucaauaccccugagggcauuauccccgcccuguucgaaccugagcgggagaaaagcgcggccauugauggggaauauagacuuaagggcgagucccgcaaaacauuugucgaacugaugcggagaggagaccuccccguguggcuggcucacaagguugccagcgagggcaucaaauacaccgaucgcaaguggugcuucgacgggcagcggaacaaucagauccuggaagagaacauggauguggagauuuggacaaaagaaggagagaagaagaaacucagaccgcgcuggcuugacgcucggacguauucugauccucuggcccugaaggaauuuaaagacuucgccgcuggcagaaaguccaucgcgcucgaucuggucaccgagauugggcgcgugcccagccaccuugcccauagaacacggaaugcucuggacaaccucgucaugcugcacaccucugaacauggaggcaaagccuaccgccacgccguggaggagcugccugaaacaauggagacccuccuucugcugggccucaugauccugcuuacagggggagcuaugcuguuucucauuuccggcaaggggaucggaaagaccagcaucggccugauuuguguuaucgccuccucugggaugcuguggauggcggaaauuccccuccaauggaucgccagcgcuauugugcuugaguucuuuaugauggugcugcugaucccugagcccgaaaaacagagaacaccgcaggauaaucaacucgccuaugucguuauuggaauccugacccuugcugccaucauugcggccaacgagaugggccugcucgaaacaaccaagcgggaccugggcauguccaaagagccugggguggugagccccacgucuuaccuggaugucgaccuccaccccgcuuccgccuggacacuuuacgcuguggccaccacaguuaucaccccuaugcugcgccauaccauugaaaauagcacagcuaacgugucucuggccgcgaucgccaaccaggcugucgugcucaugggacuggacaagggcuggccgauuagcaaaauggaucuuggggucccccugcucgcccugggaugcuauucccaggugaauccucugacgcucaccgcugccguucuucugcugaucacacacuacgccaucauuggccccgggcuccaggcgaaggcuaccagagaggcccaaaagcggacagcugccggaaucaugaaaaacccuaccguggacggcauuaugacgaucgaucuggaccccgucauuuaugauucuaaguucgagaaacagcuuggccaggugaugcugcucguucugugugccgugcagcugcuccuuaugagaacaagcugggcucugugcgaagcccugacccucgcgaccgggccuaucacaacccugugggagggauccccgggcaaguuuuggaauacaacgaucgccgucucuauggcuaacauuuuccgcgggagcuaccuugccggagcuggccuggccuuuuccaucaugaaaagcguggggaccggaaagcggggcacaggcucucaaggggaaacccucggagagaaguggaaaaagaaacugaaucagcuguccagaaaggaguucgaccucuauaaaaagagcggcauuacagagguggaucgcaccgaggcgaaagaagggcuuaagcggggagagaucacgcaucacgccguuuccagaggcucugcuaagcugcagugguuugucgaacggaacauggugauucccgaggggcgcgugaucgaccugggauguggcagaggcggguggagcuacuauugcgccggacucaaaaaggucaccgaaguucggggcuacacaaaagggggaccuggccaugaggagcccgugccuauguccaccuacggguggaauauugugaagcugaugucuggaaaagaugucuucuaucuucccccggaaaagugugacacacugcucugcgauaucggcgagagcuccccuagccccaccguggaagagucucgcacaaucagaguucugaagaugguggagcccuggcugaaaaacaaucaguucuguauuaagguccucaacccuuacaugcccaccgugaucgaacaccuugagcggcugcaacgcaaacacggcgggaugcugguuagaaauccucucucccggaacagcacgcaugaaauguauuggauuucuaauggaacaggcaacaucguggcuuccgucaauauggugagccgccugcuucugaacagauuuaccaugacccaccggagaccgacaauugagaaggacguggaucucggggccggaacgcgccaugucaacgcugaacccgagaccccuaauauggacguuaucggcgagcggaucaaaagaauuaaggaagaacacaacucuacauggcacuacgacgaugaaaaucccuauaagaccugggccuaccaugggagcuaugaggugaaagcgacaggauccgccucuagcaugaucaacggcguggucaagcugcugaccaaaccuugggacgugguucccauggugacacagauggcuaugaccgauacgaccccguucggccagcaacgcgucuuuaaggaaaaaguggacacacggaccccuagauccaugcccgggacacgccggguuaugggaauuaccgccgaguggcucuggagaacgcugggccgcaauaagaagccucggcuuugcacaagagaggaguucaccaaaaaggugcgcacaaacgcugccaugggggccgucuuuaccgaggaaaaucagugggauagcgcgaaagcugccguggaggacgaagauuucuggaagcugguugaccgggagagagagcuccacaaacugggaaaguguggcuccugcguguacaacaugauggggaaacgcgaaaagaaacuuggcgaguuuggaaaagccaagggcucuagagcuaucugguacauguggcugggggcccgguaucucgaguucgaggcucugggauuucugaaugaggaucauugguucagccgcgaaaacuccuacucuggcgucgagggggaaggacuccacaaacugggcuauauucuuagagacaucagcaagauccccgggggcgccauguacgcggaugacacggccggaugggacacccggauuacagaggaugaccugcauaaugaagagaaaaucacccagcagauggauccugagcacagacaacucgcuaacgccauuuuuaagcugacauaucagaauaagguggucaaagugcagcggcccaccccgacaggcaccguuauggacaucauuucccgcaaggaucagagagggucuggacaagugggcacguacgggcuuaacacauucaccaauauggaagcucagcugauccggcagauggagggagaaggcguccucagcaaagccgaccuggagaacccucaucugcccgaaaagaaaaucacccaguggcucgagacaaaggggguggagcgccugaagagaauggcgauuuccggcgaugacugcgugguuaaacccaucgaugaccgguuugccaacgcccuucuggcccucaaugauaugggaaaggugcgcaaagacauuccucaauggcagccgagcaagggcuggcaugauuggcagcagguccccuucuguucucaccauuuccacgaacugaucaugaaagacgggagaaaacuugugguuccuugccggccccaagacgagcugauuggacgcgcuagaaucucccagggcgccggguggagccuccgggaaaccgcuugucugggaaaggccuaugcgcagauguggucucugauguacuuucaccgcagagaucuccggcuggccuccaacgcuauuugcagcgccgugccuguccauugggugcccacaucucgcacgaccugguccauccacgcccaucaccaauggaugacaaccgaggacaugcuuacagucuggaauagaguguggaucgaagauaacccuuggauggaggacaaaacccccguuacgaccugggagaaugugccguaccugggcaagcgggaagaucaguggugugggagccucauuggccugacauccagagcuaccugggcccagaacaucccuacagcgauucagcaaguccgcagccuuaucggaaaugaggaguuccuggacuauaugcccucuaugaaacgguuuagaaaggaggaggaaagcgagggcgcuauuugguga

SEQ ID NO: 20720 - RNA, 9873 nt, Artificial Sequence
  derived and/or modified CDS sequence (opt5) from DENV-3__FJ562107__SS-prME
accagccugugccucaugaugauccugcccgccgcucuugccuuccaccugacgucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauuguuaucggaaucauuacccuguaucucggcgcugugguccaggccgacauggggugugugaucaauuggaaaggaaaggagcugaagugcggcagcgggauuuucguuacaaacgaggugcauacguggaccgaacaguacaaauuucaagcugauucccccaagcggcuggccacagcgaucgccggcgcuugggagaauggagucuguggcauuagaagcaccacacgcauggaaaaccuucucuggaaacagaucgccaaugagcugaacuauauccugugggaaaauaacauuaagcucaccgugguugugggggacaucauuggaguccuggagcagggcaaacggacgcuuaccccucagcccauggagcugaaguacucuuggaaaacaugggggaaggcuaagaucgugaccgccgaaacacaaaacuccagcuucauuaucgauggaccuaauacccccgagugcccgucugccuccagagcuuggaacgugugggaagucgaggacuauggcuuuggcguuuucacaaccaauaucuggcucaaacugcgcgaaguguacacgcagcugugugaccaccggcuuaugagcgcggccgugaaggaugagagagcuguccacgccgacaugggguacuggauugagucccagaaaaacggaucuuggaagcucgaaaaagccagccugaucgaggugaagacaugcaccuggccuaagucccauacccuguggucuaauggcguucucgaaagcgauaugauuauccccaaaucccuggcugggccuauuagccagcacaacuaucgccccggauaccauacacaaaccgccggcccuuggcaccuugggaagcuggagcucgacuuuaauuauugcgagggaacgacaguggucaucaccgaaaacuguggcacacggggccccucucugagaaccacaaccguguccgggaaacugauccacgaguggugcugucgcagcugcacgcuuccgccucuccgguacaugggagaagauggcuguugguaugggauggagauuagacccaucucugaaaaggaggagaauaugguuaaaucccuggugagcgcgggaucuggcaaggucgacaacuucaccaugggggugcugugccucgcuauucuguuugaagagguuaugcggggaaaguucggcaaaaagcauaugaucgccggcguguucuuuacauucguccuucugcucagcgggcagauuaccuggcgcgauauggcccacacacugaucaugauuggauccaaugcuagcgacagaaugggcaugggggugaccuaccuggcccuuaucgcgacguuuaaaauccagcccuuccuggcucucggauuuuuccugcggaagcucacaucuagagaaaaccugcuucugggcguggggcucgccauggccaccacacugcaacugccugaggauauugaacagauggcuaauggaaucgcccuuggccugauggcucucaaacugauuacccaguuugagaccuaucagcucuggacagcccugaucucccuuacguguagcaacaccauuuucacacugaccgucgcguggcgcacagccacccucauccuggcuggcguuucccugcuuccggugugccaaucuagcuccaugcggaagacggacuggcugcccaugacaguggccgcuaugggggucccuccccucccucuguuuaucuucucucucaaggauacccugaaaagacgcagcuggccccuuaaugagggagugauggccguuggccugguguccauucuggccucuagccuccugagaaacgacgucccuauggcugggccccuuguggcgggaggccugcucaucgccuguuacguuauuaccgggacauccgcugaucugaccguggaaaaggccgccgacgucacaugggaggaagaggcugaacagacgggagugagccauaaccucaugaucaccgucgacgaugacggcacaaugcggauuaaagaugacgagaccgagaauauccugacagugcuucugaagaccgcccugcucaucguuucuggcauuuuuccguacuccaucccugcgacgcugcuuguguggcacaccuggcagaaacagacacaacgcagcgggguccugugggaugugcccucuccucccgaaacccagaaggcugagcucgaagagggaguuuauagaauuaaacagcagggcaucuucgggaagacacaagugggagucggcgugcagaaggaggggguguuucauaccauguggcacguuacacggggagccguccugacguacaacggcaaacgccucgaaccgaauugggccuccgugaagaaagaccugauuagcuauggcgggggauggagacuuucugcucaguggcaaaagggcgaggaagugcaggucaucgccguggagccugggaaaaaccccaagaauuuccagaccaugccuggaacauuccagaccaccacaggcgaaauuggggcgaucgcucuggauuuuaagcccggaacguccggcagccccaucauuaaccgggagggcaaaguuguggggcuguacggaaauggcgucgugaccaagaacgggggauauguuuccggcaucgcccaaacaaaugccgagccugacgggccgacccccgaacucgaggaagagauguucaaaaagcgcaaccugacaauuauggaucuucacccuggcagcggaaaaaccagaaaguaccugcccgcuaucgugcgggaagccauuaagcgcagacuccggacgcugauccucgcuccuacaagagucguggccgcggagauggaggaagcccugaaaggccuucccauccgcuaucagaccaccgcuacaaagucugagcauaccgggcgggaaauuguugaccugaugugccacgccacauuuaccaugagacugcucagcccugugcgcgucccgaauuacaaccugaucauuauggaugaggcucauuucacggaccccgccuccaucgccgcucggggauacauuucuacaagagugggcaugggggaagcggccgcuaucuuuaugaccgccacaccucccggaaccgccgaugcuuucccucagagcaaugcccccauccaggacgaggagcgcgacauuccggaacgguccuggaacucuggcaaugaguggaucacggauuuugcggggaaaaccgugugguucgucccuagcauuaaggcuggcaacgacaucgccaacugucuucgcaaaaauggaaagaagguuauucaacuguccagaaaaacauuugauaccgaauaucagaagacaaaacucaacgacugggauuucguggugaccacagacaucucugagaugggcgccaauuuuaaggcugaucgggucauugaccccagacggugccugaaacccgugauccugaccgaugggccugagcgcguuauccucgccggacccaugccugugacggcggccagcgcugcccagagacggggccgcgucgggagaaacccgcagaaggaaaaugaccaauacauuuucacaggacagccccuuaacaaugaugaggaccacgcucauuggaccgaagccaagaugcugcuggacaacaucaauaccccugagggcauuauccccgcucucuucgaaccugagcgggagaaauccgccgcgauugauggggaauauagacugaagggcgagagccgcaaaacauuuguggaacuuaugcggagaggagaccugcccguuuggcucgccuacaagguggcuucugagggcaucaaauauaccgaucgcaaguggugcuucgacgggcagcggaacaaucagauccuggaagagaacauggaugucgagauuuggacaaaagaaggagagaagaagaaacugagaccgcgcuggcucgacgcccggacguacuccgauccucuugcucugaaggaauuuaaagacuucgccgccggcagaaagagcaucgcucuggaucucgugaccgagauugggcgcguccccucucaccuggcgcacagaacacggaaugcccuugacaaccuggugaugcuccauaccuccgaacacggaggcaaggcuuaucgccaugccguugaggagcugccugaaacaauggagacccugcuccuucugggccugaugauccuccugacagggggagccaugcuuuuucugauuagcggcaaggggaucggaaagaccuccaucggccucauuugugugaucgcuucuagcgggaugcuguggauggccgaaauuccccugcaauggaucgcguccgccauugugcucgaguucuuuaugaugguccuucugaucccugagcccgaaaaacagagaacaccgcaggauaaucaacuggcuuacguugugauuggaauccucacccuggccgcuaucauugccgcgaacgagaugggccuucuggaaacaaccaagcgggaccucggcaugagcaaagagccugggguggucucucccacguccuaccuggauguggaccugcaccccgccagcgcuuggacacucuaugccguugcuaccacagugaucaccccuaugcuucgccacaccauugaaaauucuacagccaacgucagccuggcugccaucgcgaaccaggccgugguccugaugggacucgacaagggcuggccgauuuccaaaauggaucugggggugccccuucuggcucucggaugcuacucucagguuaauccucugacgcugaccgccgcugugcuccuucugaucacacauuaugccaucauuggccccgggcugcaggccaaggcgaccagagaggcucaaaagcggacagccgcuggaaucaugaaaaacccuaccgucgacggcauuaugacgaucgaucucgaccccgugauuuacgauagcaaguucgagaaacagcugggccagguuaugcuucuggugcucugugccguccagcugcugcucaugagaacauccugggcccuuugcgaagcucugacccuggccaccgggccuaucacaacccucugggagggaucuccgggcaaguuuuggaauacaacgaucgcggugagcauggccaacauuuuccgcggguccuaucuggcuggagccggccuugcuuuuagcaucaugaaaucuguggggaccggaaagcggggcacaggcucccaaggggaaacccugggagagaaguggaaaaagaaacucaaucagcugagcagaaaggaguucgaccuguacaaaaaguccggcauuacagagguugaucgcaccgaggccaaagaagggcucaagcggggagagaucacgcaccaugcggucucuagaggcagcgccaaacuucagugguuuguggaacggaacauggugauucccgaggggcgcgucaucgaccugggauguggcagaggcgggugguccuauuacugcgcuggacugaaaaagguuaccgaagugcggggcuacacaaaagggggaccuggccacgaggagcccgugccuaugucuaccuauggguggaauauugucaagcucaugagcggaaaagauguguucuaccugcccccggaaaagugugacacacuucugugcgauaucggcgaguccagcccuucucccaccguugaagagucccgcacaaucagagugcucaagauggucgagcccuggcugaaaaacaaucaguucuguauuaaggugcugaacccuuauaugcccaccguuaucgaacaucucgagcggcuucaacgcaaacacggcgggaugcuggugagaaauccucugagccggaacucuacgcacgaaauguacuggauuuccaauggaacaggcaacaucgucgccagcgugaauauggugucucgccuccugcuuaacagauuuaccaugacccaucggagaccgacaauugagaaggacgucgaucugggggcuggaacgcgccacguuaacgccgaacccgagaccccuaauauggacgugaucggcgagcggaucaaaagaauuaaggaagaacacaacagcacauggcacuaugacgaugaaaaucccuacaagaccugggcuuaucacggguccuacgaggugaaagccacaggaucugcgagcuccaugaucaacggcgucgugaagcuccugaccaaaccuugggacguugugcccauggucacacagauggccaugaccgauacgaccccguucggccagcaacgcguguuuaaggaaaaaguugacacacggaccccuagaagcaugcccgggacacgccgggugaugggaauuaccgcugaguggcuguggagaacgcucggccgcaauaagaagccucggcugugcacaagagaggaguucaccaaaaagguccgcacaaacgccgcuaugggggccguguuuaccgaggaaaaucagugggauuccgccaaagcggcuguugaggacgaagauuucuggauccuuguggaccgggagagagagcugcauaagcucggaaaauguggcucuugcgucuacaacaugauggggaagcgcgagaaaaagcugggcgaguuuggaaaggccaaaggcagcagagccauuugguauauguggcuuggggcucgguaccuggaguucgaggcccucggauuucugaaugaggaucacugguucucccgcgaaaacucuuauagcggcguggagggggaaggacugcauaagcucggcuacauccugagagacaucuccaaaauucccgggggcgcuauguaugccgaugacacggcgggaugggacacccggaucacagaggaugaccuucacaaugaagagaagauuacccagcagauggauccugagcauagacaacuggccaacgcuaucuuuaaacucacauaccagaauaaggucgugaagguucagcggcccaccccgacaggcaccgugauggacauuaucucucgcaaagaucagagagggagcggacaagucggcacguaugggcugaacacauucaccaauauggaagcccagcuuauccggcagauggagggagaaggcgugcuguccaaggcugaccucgagaacccucaucugcccgagaaaaagauuacccaguggcuggagacaaaagggguggagcgccucaagagaauggccaucagcggcgaugacugcguugugaagcccauugaugaccgguuugcgaacgcccugcuugcucugaaugauaugggaaaaguccgcaaggacaucccucaauggcagccgucuaaaggcuggcacgauuggcaacaggugcccuucuguucccaucacuuccaugaacucauuaugaaggacgggagaaaacugguugugccuugccggccccaagacgagcuuaucggacgcgccagaauuagccagggcgcuggguggucucugcgggaaaccgccugucucggaaaggcuuacgcccagauguggucccugauguacuuucaccgcagagaucugcggcucgcgagcaacgccaucugcucugcugucccugugcacuggguccccacaucccgcacgaccuggagcauccaugcccaccaucaauggaugacaaccgaggacaugcugacaguguggaauagaguuuggauugaagauaacccuuggauggaggacaagacccccgugacgaccugggagaaugucccguaucuuggcaaacgggaagaucaguggugugggucccugaucggccucacaagcagagccaccugggcucagaacauuccuacagccauccagcaagugcgcucucugauuggaaaugaggaguuccuugacuacaugcccagcaugaagcgguuuagaaaagaggaggaauccgagggcgcgaucugguga

SEQ ID NO: 20721 - RNA, 9873 nt, Artificial Sequence
  derived and/or modified CDS sequence (opt5) from DENV-3__FJ547071__SS-prME
acaagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcacaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaaaauccagcccuuccuggcccucggauuuuuccugcggaagcucacaucuagagaaaaccugcuucugggcguggggcucgccauggcuaccacacugcaacugccugaggauauugaacagauggccaauggaaucgcucuuggccugauggcccucaaacugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaagacggacuggcugcccaugacaguggcugccaugggggugccuccccucccucuguuuaucuucucucucaaggauacccugaaaagacgcagcuggccccuuaaugagggagucauggccgugggccugguuuccauucuggcuucuagccuccugagaaacgacgugccuauggcggggccccuugucgccggaggccugcucaucgcuuguuacgugauuaccgggacauccgccgaucugaccguugaaaagacagccgacgugacgugggaggaagaggcugaacagaccggagucagccauaaccucaugaucacaguggacgaugacggcaccaugcggauuaaagaugacgagacagagaauauccugaccguccuucugaagacggcccugcucaucgugucuggcauuuuuccguacuccaucccugcgacccugcuuguuuggcacacauggcagaaacagacccaacgcagcggggugcugugggauguccccucuccucccgaaacacagaaggcugagcucgaagagggaguguauagaauuaaacagcagggcaucuucgggaagacccaaguuggagugggcguccagaaggaggggguguuucauacaauguggcacgugacgcggggagccguucugaccuacaacggcaaacgccucgaaccgaauugggccuccgucaagaaagaccugauuagcuauggcgggggauggagacuuucugcucaguggcaaaagggcgaggaaguccaggugaucgccgucgagccugggaaaaaccccaagaauuuccagacaaugccuggaaccuuccagaccacaacgggcgaaauuggggcgaucgcucuggauuuuaagcccggaaccuccggcagccccaucauuaaccgggagggcaaagugguugggcuguacggaaauggcguggucacaaagaacgggggauauguguccggcaucgcccaaaccaaugccgagccugacgggccgacacccgaacucgaggaagagauguucaaaaagcgcaaccugaccauuauggaucuucacccuggcagcggaaaaacgagaaaguaccugcccgcuaucguucgggaagccauuaagcgcagacuccggacacugauccucgcuccuaccagaguggucgccgcggagauggaggaagcccugaaaggccuucccauccgcuaucagaccacagcuaccaagucugagcauacagggcgggaaauuguggaccugaugugccacgccaccuuuacgaugagacugcucagcccuguucgcgugccgaauuacaaccugaucauuauggaugaggcucauuucacagaccccgccuccaucgccgcucggggauacauuucuaccagagucggcaugggggaagcggccgcuaucuuuaugacagccaccccucccggaacggccgaugcuuucccucagagcaaugcccccauccaggacgaggagcgcgacauuccggaacgguccuggaacucuggcaaugaguggaucaccgauuuugcggggaaaacagugugguucgugccuagcauuaaggcuggcaacgacaucgccaacugucuucgcaaaaauggaaagaaggucauucaacuguccagaaaaaccuuugauacagaauaucagaagaccaaacucaacgacugggauuucguugugacaaccgacaucucugagaugggcgccaauuuuaaggcugaucgggugauugaccccagacggugccugaaacccgucauccugacggaugggccugagcgcgugauccucgccggacccaugccuguuacagcggccagcgcugcccagagacggggccgcguggggagaaacccgcagaaggaaaaugaccaauacauuuucaccggacagccccuuaacaaugaugaggaccacgcucauuggaccgaagccaagaugcugcuggacaacaucaauacaccugagggcauuauccccgcucucuucgaaccugagcgggagaaauccgccgcgauugauggggaauauagacugaagggcgagagccgcaaaaccuuugucgaacuuaugcggagaggagaccugcccguguggcucgcccacaagguugcuucugagggcaucaaauacacagaucgcaaguggugcuucgacgggcagcggaacaaucagauccuggaagagaacauggauguggagauuuggacgaaagaaggagagaagaagaaacugagaccgcgcuggcucgacgcccggaccuauuccgauccucuugcucugaaggaauuuaaagacuucgccgccggcagaaagagcaucgcucuggaucucgucacagagauugggcgcgugcccucucaccuggcgcauagaacccggaaugcccuugacaaccuggucaugcuccacacauccgaacauggaggcaaggcuuaccgccacgccguggaggagcugccugaaaccauggagacgcugcuccuucugggccugaugauccuccugaccgggggagccaugcuuuuucugauuagcggcaaggggaucggaaagacauccaucggccucauuuguguuaucgcuucuagcgggaugcuguggauggccgaaauuccccugcaauggaucgcguccgccauugugcucgaguucuuuaugauggugcuucugaucccugagcccgaaaaacagagaaccccgcaggauaaucaacuggcuuaugucguuauuggaauccucacacuggccgcuaucauugccgcgaacgagaugggccuucuggaaaccacgaagcgggaccucggcaugagcaaagagccugggguggugucucccacauccuaccuggaugucgaccugcaccccgccagcgcuuggacccucuacgccguggcuacaaccguuaucaccccuaugcuucgccauacaauugaaaauucuacggccaacgugagccuggcugccaucgcgaaccaggccgucgugcugaugggacucgacaagggcuggccgauuuccaaaauggaucugggggucccccuucuggcucucggaugcuauucucaggugaauccucugacccugacagccgcuguucuccuucugaucacccacuacgccaucauuggccccgggcugcaggccaaggcgacaagagaggcucaaaagcggaccgccgcuggaaucaugaaaaacccuacgguggacggcauuaugacaaucgaucucgaccccgucauuuaugauagcaaguucgagaaacagcugggccaggugaugcuucugauccucugugccguucagcugcugcucaugagaaccuccugggcccuuugcgaagcucugacccuggccacagggccuaucaccacacucugggagggaucuccgggcaaguuuuggaauacgaccauugcggugagcauggccaacaucuuccgcggguccuaccuggcuggagccggccuugcuuuuagcauuaugaaaucugucgggacaggaaagcggggcaccggcucccaaggggaaacacugggagagaaguggaaaaagaaacucaaucagcugagcagaaaggaguucgaccuguauaaaaaguccggcaucaccgagguggaucgcacggaggccaaagaagggcucaagcggggagagauuacccaucacgcggugucuagaggcagcgccaaacuucagugguuuguugaacggaacauggucauccccgaggggcgcgugauugaccugggauguggcagaggcgggugguccuacuauugcgcuggacugaaaaaggugacagaaguccggggcuacaccaaagggggaccuggccaugaggagcccguuccuaugucuacauacggguggaauaucgugaagcucaugagcggaaaagauguguucuaucugcccccggaaaagugugacacccuucugugcgauaucggcgaguccagcccuucucccacagucgaagagucccgcaccauuagagugcucaagaugguugagcccuggcugaaaaacaaucaguucuguaucaaggugcugaacccuuacaugcccacggucauugaacaccucgagcggcuucaacgcaaacacggcgggaugcuggugagaaauccucugagccggaacucuacacaugaaauguauuggaucuccaauggaaccggcaacauuguugccagcgugaauauggucucucgccuccugcuuaacagauuuaccaugacacaccggagaccgacgaucgagaaggacguggaucugggggcuggaacccgccaugugaacgccgaacccgagacaccuaauauggacgucaucggcgagcggauuaaaagaaucaaggaagaacacaacagcaccuggcacuacgacgaugaaaaucccuauaagacaugggcuuaccauggguccuaugagguuaaagccaccggaucugcgagcuccaugauuaacggcguggugaagcuccugacaaaaccuugggacgucgugcccaugguuacccagauggccaugacggauaccacaccguucggccagcaacgcguguuuaaggaaaaagucgacacccggacaccuagaagcaugcccgggacccgccgggugaugggaaucacggcugaguggcuguggagaacacucggccgcaauaagaagccucggcugugcaccagagaggaguucaccaagaagguucgcaccaacgccgcuaugggggccguguuuacggaggaaaaucagugggauuccgccaaagcggcugucgaggacgaagauuucuggaaacuuguggaccgggagagagagcugcacaaacucggaaaguguggcucuugcguuuacaacaugauggggaaacgcgaaaagaagcugggcgaguuuggaaaagccaagggcagcagagccauuugguacauguggcuuggggcucgguaucuggaguucgaggcccucggauuucugaaugaggaucauugguucucccgcgaaaacucuuacagcggcguggagggggaaggacugcacaaacucggcuauauccugagagacaucuccaagauucccgggggcgcuauguacgccgaugacaccgcgggaugggacacacggaucaccgaggaugaccuucauaaugaagagaaaauuacacagcagauggauccugagcacagacaacuggccaacgcuaucuuuaagcucaccuaucagaauaaggucgugaaaguccagcggcccacaccgaccggcacggugauggacauuaucucucgcaaggaucagagagggagcggacaaguuggcacauacgggcugaacaccuucaccaauauggaagcccagcuuauccggcagauggagggagaaggcgugcuguccaaagcugaccucgagaacccucaucugcccgaaaagaaaauuacacaguggcuggagaccaagggggucgagcgccucaagagaauggccaucagcggcgaugacugcguggugaaacccauugaugaccgguuugcgaacgcccugcuugcucugaaugauaugggaaagguucgcaaagacaucccucaauggcagccgucuaagggcuggcaugauuggcaacaggugcccuucuguucccaccauuuccacgaacucauuaugaaagacgggagaaagcuggucgugccuugccggccccaagacgagcuuaucggacgcgccagaauuagccagggcgcuggguggucucugcgggaaacagccugucucggaaaggcuuaugcccagauguggucccugauguacuuucaccgcagagaucugcggcucgcgagcaacgccaucugcucugcuguuccugugcauuggguccccacgucccgcaccacauggagcauccacgcccaucaccaauggaugaccacagaggacaugcugaccguguggaauagagucuggauugaagauaacccuuggauggaggacaaaacgcccgugaccacaugggagaauguuccguaccuuggcaagcgggaagaucaguggugugggucccugaucggccucaccagcagagccacaugggcucagaacauuccuaccgccauccagcaagugcgcucucugauuggaaaugaggaguuccuugacuauaugcccagcaugaaacgguuuagaaaggaggaggaauccgagggcgcgaucugguga

SEQ ID NO: 20722 - RNA, 9873 nt, Artificial Sequence
  derived and/or modified CDS sequence (opt5) from DENV-3__FJ410176__SS-prME
accagccugugccucaugaugauccugcccgccgcucuugccuuccaccugacaucccgggacggcgagccucggaugauuguggggaagaacgaacgcggcaagucucuccuguuuaagacggcguccggcaucaauauguguacccuuauugcuauggaucugggggagaugugcgacgauacagugaccuacaaguguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggcuagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacacgaucggagugcuggagcagggcaaacggacccuuacaccucagcccauggagcugaaguacucuuggaaaaccugggggaaggccaagauugucacagccgaaacccaaaacuccagcuucaucauugauggaccuaauacacccgagugcccgucugcuuccagagcguggaacgugugggaaguggaggacuauggcuuuggcgucuucaccacgaauaucuggcucaaacugcgcgaaguuuacacacagcugugugaccaccggcuuaugagcgccgcugugaaggaugagagagccgugcacgccgacaugggguacuggaucgagucccagaaaaacggaucuuggaagcucgaaaaagcuagccugauugaggucaagaccugcaccuggccuaagucccauacacuguggucuaauggcgugcucgaaagcgauaugaucauucccaaaucccuggccgggccuaucagccagcacaacuaucgccccggauaccauacccaaacggcgggcccuuggcaccuugggaagcuggagcucgacuuuaauuauugcgagggaacaaccguugugauuacagaaaacuguggcacccggggaucuucccugagaacaaccacggucagcgggaaacugauccacgaguggugcugucgcucuugcacccuucccccgcuccgguacaugggagaagauggcuguugguaugggauggagaucagaccuauuuccgaaaaggaggagaauauggugaaaagccugguuucugcuggaagcggcaagguggacaacuucacaauggggguccugugccucgccauccuguuugaagaggugaugcggggaaaguucggcaaaaagcauaugauugccggcguucuuuucaccuuugugcugcuccuguccgggcagaucacauggcgcgauauggcucacacccugauuaugaucggaagcaaugccucugacagaaugggcaugggggucacguaccuugcgcugauugcuacauucaaaauccagcccuuucucgcccugggauucuuucuccggaagcugaccuccagagaaaaccuucugcucggcguggggcuggccauggcuacaacccugcaacuucccgaggauaucgaacagauggccaauggaauugcucugggccucauggcccugaaacucaccacacaguucgagacguaucagcuguggaccgcgcuuaucagccugacauguuccaacaccauuuuuacacucaccguggccuggcgcacggcuacacugauccuggccggcgucucucuucugccuguuugccaaagcuccucuaugcggaagaccgacuggcucccgaugaccguggcugccaugggggugcccccucugccccucuucauuuuuagccugaaggauacacuuaaaagacgcuccuggccucugaaugagggagucauggccgugggccugguuucuauccucgcuagcucccugcuuagaaacgacgugcccauggcggggccucuggucgccggaggccuccugaucgcuuguuacgugauuaccgggacaagcgccgaucucacgguugaaaaggccgcugacgugaccugggaggaagaggccgaacagacaggagucucucauaaccugaugaucaccguggacgaugacggcacaaugcggauuaaagaugacgagaccgagaauauccuuacgguccugcugaagaccgcgcuccugauuguguccggcaucuuccccuacagcaucccggcuacacuucugguuuggcacaccuggcagaaacagacacaacgcucuggggugcucugggaugucccuucucccccugaaacccagaaggccgagcuggaagagggaguguauagaauuaaacagcagggcaucuuugggaagacacaaguuggagugggcguccagaaggaggggguguuccauacgauguggcacgugacccggggagccguucucacauacaacggcaaacgccuggaacccaauugggcuagcgucaagaaagaccuuauuagcuauggcgggggauggagacuguccgcccaguggcaaaagggcgaggaaguccaggugaucgcggucgagccggggaaaaacccuaagaauuuucagaccaugcccggaaccuuccagacaacgaccggcgaaauuggggcuaucgcccuggauuucaagccuggaacaagcggcucccccauuaucaaccgggagggcaaagugguugggcucuacggaaauggcguggucaccaagaacgggggauaugugagcggcaucgcccaaacaaaugcugagcccgacgggccuaccccggaacuggaggaagagauguuuaaaaagcgcaaccuuacgauuauggaucugcaccccggcucuggaaaaacaagaaaguaccucccugccaucguucgggaagcuauuaagcgcagacugcggacccucauccuggcccccaccagaguggucgcggccgagauggaggaagcucuuaaaggccugccuauucgcuaucagacaaccgccacaaagagcgagcauaccgggcgggaaaucguggaccugaugugccacgcuacguucacaaugagacuccugucccccguucgcgugccuaauuacaaccuuaucauuauggaugaggcccauuuuaccgacccggccucuaucgcugcgcggggauacauuagcacaagagucggcaugggggaagccgcugccaucuucaugaccgccacgcccccuggaaccgcugaugccuuuccccaguccaaugcgccuauucaggacgaggagcgcgacauccccgaacggucuuggaacagcggcaaugaguggaucacagauuucgcugggaaaaccgugugguuugugccguccauuaaggccggcaacgacaucgccaacugucugcgcaaaaauggaaagaaggucauucaacucucuagaaaaacauucgauaccgaauaucagaagacaaaacugaacgacugggauuuuguugugaccacggacaucagcgagaugggcgcuaauuucaaggccgaucgggugauugacccuagacggugccugaaacccgucauccucacagaugggcccgagcgcgugauucuugcgggaccuaugcccguuaccgccgcuuccgccgcucagagacggggccgcguggggagaaacccucagaaggaaaaugaccaauacaucuuuaccggacagccgcugaacaaugaugaggaccacgcccauuggacagaagcuaagaugcugcucgacaacaucaauacccccgagggcauuaucccugcccuguucgaacccgagcgggagaaaagcgcggccauugauggggaauauagacuuaagggcgagucucgcaaaacauucgucgaacugaugcggagaggagaccucccuguguggcuggcucacaagguugccuccgagggcaucaaauacacggaucgcaaguggugcuuugacgggcagcggaacaaucagauucuggaagagaacauggauguggagaucuggaccaaagaaggagagaagaagaaacucagaccccgcuggcuugacgcucggacauauagcgauccgcuggcccugaaggaguucaaagacuuugccgcuggcagaaagucuaucgcgcucgaucuggucaccgagauugggcgcgugccuucccaccuugcccauagaacacggaaugcucuggacaaccucgucaugcugcacaccagcgaacauggaggcaaagccuaccgccacgccguggaggagcugcccgaaacgauggagacccuccuucugcugggccucaugauccugcuuacagggggagcuaugcuguuccucauuuccggcaaggggaucggaaagaccucuauuggccugaucuguguuaucgccagcuccgggaugcuguggauggcggaaauuccucuccaauggaucgccagcgcuauugugcuugaguuuuucaugauggugcugcugauccccgagccugaaaaacagagaacaccccaggauaaucaacucgccuaugucguuauuggaauccugacccuugcugccauuaucgcggccaacgagaugggccugcucgaaacgacaaagcgggaccugggcaugucuaaagagccgggggugguguccccuaccagcuaccuggaugucgaccuccaccccgcuucugccuggacacuuuacgcuguggccaccaccguuaucacacccaugcugcgccauacgauugaaaauagcaccgcuaacgugucccuggccgcgaucgccaaccaggcugucgugcucaugggacuggacaagggcuggccuauuucuaaaauggaucuuggggucccgcugcucgcccugggaugcuauagccaggugaauccccugacacucaccgcugccguucuucugcugaucacacacuacgccauuaucggcccugggcuccaggcgaaggcuaccagagaggcccaaaagcggacggcugccggaaucaugaaaaaccccacaguggacggcauuaugaccaucgaucuggacccugucauuuaugauuccaaguuugagaaacagcuuggccaggugaugcugcucguucugugugccgugcagcugcuccuuaugagaaccucuugggcucugugcgaagcccugacacucgcgaccgggcccaucacaacgcugugggagggaagcccuggcaaguucuggaauaccacaauugccgucuccauggcuaacaucuuucgcgggagcuaccuugccggagcuggccuggccuucucuaucaugaaauccguggggaccggaaagcggggcacaggcagccaaggggaaacccucggagagaaguggaaaaagaaacugaaucagcuguccagaaaggaauuugaccucuauaaaaagucuggcauuacggagguggaucgcaccgaggcgaaagaagggcuuaagcggggagagaucacacaucacgccguuagcagaggcuccgcuaagcugcagugguucgucgaacggaacauggugauuccggaggggcgcgugaucgaccugggauguggcagaggcggguggucuuacuauugcgccggacucaaaaaggucaccgaaguucggggcuacacaaaagggggacccggccaugaggagccugugcccaugagcaccuacggguggaauauugugaagcugauguccggaaaagaugucuuuuaucuuccucccgaaaagugugacacacugcucugcgauaucggcgagagcucuccguccccuaccguggaagagagccgcacgauuagaguucugaagaugguggagcccuggcugaaaaacaaucaguucuguaucaagguccucaaccccuacaugccuacagugaucgaacaccuugagcggcugcaacgcaaacacggcgggaugcugguuagaaauccccucucucggaacuccacccaugaaauguauuggauuagcaauggaaccggcaacaucguggcuucugucaauauggugagccgccugcuucugaacagauucacaaugacgcaccggagaccuaccauugagaaggacguggaucucggggccggaacacgccaugucaacgcugaaccggagacccccaauauggacguuaucggcgagcggauuaaaagaaucaaggaagaacacaacuccacauggcacuacgacgaugaaaauccuuauaagaccugggccuaccaugggucuuaugaggugaaagcgacaggaagcgccuccagcaugaucaacggcguggucaagcugcugaccaaacccugggacgugguuccuauggugacgcagauggcuaugaccgauacaacccccuuuggccagcaacgcgucuucaaggaaaaaguggacacacggaccccgagauccaugccugggacgcgccggguuaugggaauuacagccgaguggcucuggagaacccugggccgcaauaagaagccccggcuuugcacaagagaggaauuuaccaaaaaggugcgcacgaacgcugccaugggggccgucuucaccgaggaaaaucagugggauucugcgaaagcugccguggaggacgaagauuuuuggaagcugguugaccgggagagagagcuccacaaacugggaaaguguggcagcugcguguacaacaugauggggaaacgcgaaaagaaacuuggcgaguucggaaaagccaagggcuccagagcuaucugguacauguggcugggggcccgguaucucgaauuugaggcucugggauuccugaaugaggaucauugguuuucucgcgaaaacagcuacuccggcgucgagggggaaggacuccacaaacugggcuauauucuuagagacaucucuaagauuccugggggcgccauguacgcggaugacacagccggaugggacacccggaucacagaggaugaccugcauaaugaagagaaaaucacccagcagauggaucccgagcacagacaacucgcuaacgccauuuucaagcugacauaucagaauaagguggucaaagugcagcggccuacccccacgggcacaguuauggacaucauuagccgcaaggaucagagaggguccggacaagugggcaccuacgggcuuaacaccuuuacaaauauggaagcucagcugauccggcagauggagggagaaggcguccucagcaaagccgaccuggagaacccgcaucugccugaaaagaaaauuacccaguggcucgagacaaaggggguggagcgccugaagagaauggcgaucucuggcgaugacugcgugguuaaacccaucgaugaccgguucgccaacgcccuucuggcccucaaugauaugggaaaggugcgcaaagacauuccccaauggcagccuuccaagggcuggcaugauuggcagcaggucccguuuuguagccaccauuuccacgaacugaucaugaaagacgggagaaaacuugugguucccugccggccucaagacgagcugauuggacgcgcuagaaucucucagggcgccggguggucccuccgggaaacggcuugucugggaaaggccuaugcgcagauguggagccugauguacuuccaccgcagagaucuccggcuggccucuaacgcuauuugcuccgccgugcccguccauugggugccuaccagccgcacaaccugguccauccacgcccaucaccaauggaugacaaccgaggacaugcuuacggucuggaauagaguguggauugaagauaaccccuggauggaggacaaaaccccuguuacaaccugggagaaugugcccuaccugggcaagcgggaagaucaguggugugggagccucaucggccugacaucuagagcuaccugggcccagaacaucccgacggcgauucagcaaguccgcagccuuaucggaaaugaggaauuucuggacuauaugccuuccaugaaacgguucagaaaggaggaggaaucugagggcgcuauuugguga

SEQ ID NO: 20723 - RNA, 9873 nt, Artificial Sequence
  derived and/or modified CDS sequence (opt5) from DENV-3__FJ410177__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcucggggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacacgaucggagugcuggagcagggcaaacggacccuuacaccucagcccauggagcugaaguacucuuggaaaaccugggggaaggccaagauugucacagccgaaacccaaaacuccagcuucaucauugauggaccuaauacacccgagugcccgucugcuuccagagcguggaacgugugggaaguggaggacuauggcuuuggcgucuucaccacgaauaucuggcucaaacugcgcgaaguuuacacacagcugugugaccaccggcuuaugagcgccgcugugaaggaugagagagccgugcacgccgacaugggguacuggaucgagucccagaaaaacggaucuuggaagcucgaaaaagcuagccugauugaggucaagaccugcaccuggccuaagucccauacacuguggucuaauggcgugcucgaaagcgauaugaucauucccaaaucccuggccgggccuaucagccagcacaacuaucgccccggauaccauacccaaacggcgggcccuuggcaccuugggaagcuggagcucgacuuuaauuauugcgagggaacaaccguugugauuacagaaaacuguggcaccggcgggcccucucugcggacaaccacggucuccggaaaacugauccacgaguggugcuguagaagcugcacccuuccgccucuccgcuacaugggcgaagauggguguugguauggaauggagauccggcccauuucugaaaaggaggagaauauggugaaaucccugguuagcgcuggcucugggaagguggacaacuucacaaugggaguccugugccucgccauccuguuugaagaggugaugagaggcaaguucggcaaaaagcauaugauugccgggguuuucuuuaccuucgugcuucugcucagcggacagaucacauggcgggauauggcucacacccugauuaugaucggcuccaaugccagcgaccgcauggggaugggagucacguaccuggcgcuuauugcuacauuuaaaauccagcccuuccuggcccucggcuuuuuccugagaaagcucaccucucgggaaaaccugcuucugggggugggacucgccauggcuacaacccugcaacugccugaggauaucgaacagauggccaauggcauugcucuuggccugauggcccucaaacugaccacacaguuugagacguaucagcucuggaccgcgcugaucucccuuacauguagcaacaccauuuucacacugaccguggccuggagaacggcuacacucauccuggccggggucucccugcuuccgguuugccaaucuagcuccaugcgcaagaccgacuggcugcccaugaccguggcugccaugggagugccuccccucccucuguuuauuuucucucucaaggauacacugaaacggagaagcuggccccuuaaugagggcgucauggccguggggcugguuuccauccuggcuucuagccuccugcgcaacgacgugccuauggcgggaccccuugucgccggcgggcugcucaucgcuuguuacgugauuaccggaacauccgccgaucugacgguugaaaaggccgcugacgugaccugggaggaagaggccgaacagacaggcgucagccauaaccucaugaucaccguggacgaugacggcacaaugagaauuaaagaugacgagaccgagaauauccugacgguccuucugaagaccgcgcugcucauugugucugggaucuuuccguacuccaucccugcuacacugcuuguuuggcacaccuggcagaaacagacacaacggagcggagugcugugggauguccccucuccucccgaaacccagaaggccgagcucgaagagggcguguaucgcauuaaacagcaggggaucuucggaaagacacaaguuggcguggggguccagaaggagggaguguuucauacgauguggcacgugaccagaggcgccguucugacauacaacggcaaacggcucgaaccgaauugggcuuccgucaagaaagaccugauuagcuaugggggaggcuggcgccuuucugcccaguggcaaaagggggaggaagugcaggugaucgcggucgagccuggaaaaaaccccaagaauuuccagaccaugccuggcaccuuccagacaacgaccggggaaauuggagcuaucgcccuggauuuuaagcccggcacauccggcagccccauuaucaacagagaggggaaagugguuggacuguacggcaaugggguggucaccaagaacggaggcuauguguccgggaucgcccaaacaaaugcugagccugacggcccgacccccgaacucgaggaagagauguucaaaaagcggaaccugacgauuauggaucuucacccuggaagcggcaaaacacgcaaguaccugcccgccaucguuagagaagcuauuaagcggcgccucagaacccugauccucgccccuacccggguggucgcggccgagauggaggaagcucugaaagggcuucccauuagauaucagacaaccgccacaaagucugagcauaccggacgcgaaaucguggaccugaugugccacgcuacguuuacaaugcggcugcucagcccuguuagagugccgaauuacaaccugaucauuauggaugaggcccauuucaccgaccccgccuccaucgcugcgcgcggcuacauuucuacacgggucgggaugggagaagccgcugccaucuuuaugaccgccacgccucccggcaccgcugaugccuucccucagagcaaugcgcccauucaggacgaggagagagacaucccggaacgcuccuggaacucugggaaugaguggaucacagauuuugcuggcaaaaccgugugguucgugccuagcauuaaggccggaaacgacaucgccaacugucuucggaaaaauggcaagaaggucauucaacuguccagaaaaacauuugauaccgaauaucagaagacaaaacucaacgacugggauuucguugugaccacggacaucucugagaugggggcuaauuuuaaggccgaucgcgugauugacccccggagaugccugaaacccgucauccugacagauggaccugagcgggugauucucgcgggccccaugccuguuaccgccgcuagcgccgcucagcgcagagggcgggugggacgcaacccgcagaaggaaaaugaccaauacaucuucaccggccagccccuuaacaaugaugaggaccacgcccauuggacagaagcuaagaugcugcuggacaacaucaauaccccugaggggauuauccccgcccucuucgaaccugagagagagaaauccgcggccauugauggcgaauaucggcugaagggagagagcagaaaaacauuugucgaacuuaugcgccggggcgaccugcccguguggcucgcucacaagguugccucugaggggaucaaauacacggauagaaaguggugcuucgacggacagcgcaacaaucagauucuggaagagaacauggauguggagaucuggaccaaagaaggcgagaagaagaaacugcggccgagauggcucgacgcucgcacauauuccgauccucuugcccugaaggaauuuaaagacuucgccgcugggcggaagagcaucgcgcuggaucucgucaccgagauuggaagagugcccucucaccuggcccaucgcacaagaaaugcucuugacaaccuggucaugcuccacaccuccgaacauggcggcaaagccuaccggcacgccguggaggagcugccugaaacgauggagacccugcuccuucuggggcugaugauccuccugacaggaggcgcuaugcuuuuucugauuagcgggaagggaaucggcaagaccuccauugggcucaucuguguuaucgccucuagcggaaugcuguggauggcggaaauuccccugcaauggaucgccuccgcuauugugcucgaguucuuuaugauggugcuucugaucccugagcccgaaaaacagcgcacaccgcaggauaaucaacuggccuaugucguuauuggcauccucacccuggcugccauuaucgcggccaacgagaugggccuucuggaaacgacaaagagagaccucgggaugagcaaagagccuggaguggugucucccaccuccuaccuggaugucgaccugcaccccgcuagcgccuggacacucuacgcuguggccaccaccguuaucacaccuaugcuucggcauacgauugaaaauucuaccgcuaacgugagccuggccgcgaucgccaaccaggcugucgugcugaugggccucgacaagggguggccgauuuccaaaauggaucugggagucccccuucuggcccucggcugcuauucucaggugaauccucugacacugaccgcugccguucuccuucugaucacacacuacgccauuaucgggcccggacugcaggcgaaggcuacccgcgaggcccaaaagagaacggcugccggcaucaugaaaaacccuacaguggacggcauuaugaccaucgaucucgaccccgucauuuaugauagcaaguucgagaaacagcuggggcaggugaugcuucugguucucugugccgugcagcugcugcucaugcggaccuccugggcucuuugcgaagcccugacacuggcgaccggaccuaucacaacgcucugggagggcucuccggggaaguuuuggaauaccacaauugccgucagcauggcuaacaucuucagaggauccuaccuggccggcgcugggcuugccuuuagcaucaugaaaucugugggaaccggcaagcgcggcacagggucccaaggagaaacccugggcgagaaguggaaaaagaaacucaaucagcugagccggaaggaauucgaccuguauaaaaaguccgggauuacggagguggauagaaccgaggcgaaagaaggacucaagcgcggcgagaucacacaucacgccguuucucgggggagcgcuaagcuucagugguuugucgaaagaaacauggugauucccgagggacgggugaucgaccugggcuguggccgcgggggaugguccuacuauugcgccggccugaaaaaggucaccgaaguuagaggguacacaaaaggaggcccugggcaugaggagcccgugccuaugucuaccuacggauggaauauugugaagcucaugagcggcaaagaugucuucuaucugcccccggaaaagugugacacacuucugugcgauaucggcgaguccagcccuucucccaccguggaagagucccggacgauucgcguucucaagaugguggagcccuggcugaaaaacaaucaguucuguaucaagguccugaacccuuacaugcccacagugaucgaacaccucgagagacuucaacggaaacacgggggaaugcugguucgcaauccucugagcagaaacucuacccaugaaauguauuggauuuccaauggcaccgggaacaucguggcuagcgucaauauggugucucggcuccugcuuaaccgcuuuacaaugacgcacagacggccgaccauugagaaggacguggaucugggagccggcacaagacaugucaacgcugaacccgagaccccuaauauggacguuaucggggagcgcauuaaacggaucaaggaagagcacaacagcacauggcacuacgacgaugaaaaucccuauaagaccugggccuaccauggauccuaugaggugaaagcgacaggcucugccagcuccaugaucaacggcguggucaagcuccugaccaaaccuugggacgugguucccauggugacgcagauggcuaugaccgauacaaccccguucgggcagcaaagagucuuuaaggaaaaaguggacacacgcaccccucggagcaugcccggaacgagacgcguuaugggcauuacagccgaguggcuguggcggacccucgggagaaauaagaagccucgccugugcacacgggaggaauucaccaaaaaggugagaacgaacgcugccaugggagccgucuuuaccgaggaaaaucagugggauuccgcgaaagcugccguggaggacgaagauuucuggaagcuuguugaccgcgagcgggagcugcacaaacucggcaagugugggucuugcguguacaacaugaugggcaaaagagaaaagaagcugggagaguuuggcaaagccaaggggagccgcgcuaucugguacauguggcuuggagccagauaucuggaauucgaggcucucggcuuucugaaugaggaucauugguucucccgggaaaacucuuacagcggggucgagggagaaggccugcacaaacucggguauauucugcgcgacaucuccaagauucccggcggagccauguacgcggaugacacagccggcugggacaccagaaucacagaggaugaccuucauaaugaagagaaaaucacccagcagauggauccugagcaccggcaacuggcuaacgccauuuuuaagcucacauaucagaauaagguggucaaagugcagagacccaccccgacggggacaguuauggacaucauuucucggaaggaucagcgcggaagcggccaaguggggaccuacggacugaacaccuucacaaauauggaagcucagcuuaucagacagauggagggcgaagggguccuguccaaagccgaccucgagaacccucaccugcccgaaaagaaaauuacccaguggcuggagacaaagggcguggagcggcucaagcgcauggcgaucagcggagaugacugcgugguuaaacccaucgaugacagauuugccaacgcucugcuugcccugaaugauaugggcaaggugcggaaagacauuccucaauggcagccgucuaagggguggcaugauuggcagcagguccccuucuguucccaccauuuccacgaacucaucaugaaagacggacgcaagcuggugguuccuugcagaccccaagacgagcuuauuggccgggcucgcaucagccagggggccggauggucucugagagaaacggcuugucucggcaaggccuaugcgcagauguggucccugauguacuuucaccggcgcgaucugagacucgccagcaacgcuauuugcucugccgugccuguccauugggugcccaccucccggacaaccuggagcauccacgcccaucaccaauggaugacaaccgaggacaugcugacggucuggaaucgcguguggauugaagauaacccuuggauggaggacaaaacccccguuacaaccugggagaaugugccguaccuugggaagagagaagaucagugguguggcucccugaucggacucacaagccgggcuaccugggcccagaacaucccuacggcgauucagcaagucagaucucugaucggcaaugaggaauuccuugacuauaugcccagcaugaaacgcuuucggaaggaggaggaauccgagggggcuauuugguga

SEQ ID NO: 20724 - RNA, 9873 nt, Artificial Sequence
  derived and/or modified CDS sequence (opt5) from DENV-3__FJ547072__SS-prME
accagccugugccucaugaugauccugcccgccgcucuugccuuccaccugacauccagagacggcgagccucggaugauuguggggaagaacgaacgcggaagaucucuccuguuuaaaacggcgagcggcaucaauauguguacccuuauugcuauggaucugggggagaugugcgacgauacagucaccuacaaguguccgcauaucacagaaguugagcccgaagacauugauugcugguguaaccucaccuccacaugggugaccuauggaacgugcaaucaggccggcgagcaccggcgcgacaaaagaucuguggcccuggcuccucaugucgggaugggacuggauacccggacacaaaccuggaugagcgccgagggcgcuuggcgccagguggaaaagguugagacaugggcccucagacaccccggcuucaccauccuggcgcuuuuucuggcccauuacaucgggacgucccucacacagaaaguggucauuuucauccugcuuaugcuggugaccccuucuaugacaaugcgguguguuggagugggcaaccgcgacuuugucgaagggcucagcggagcuaccuggguggaugugguccuggagcacggcgggugcguuaccacaauggccaagaauaagcccacgcuggacauugagcuccagaaaaccgaagcuacacaacuggccacccuuagaaagcuguguaucgagggaaaaauuacaaacaucaccacggauucccggugcccuacacagggcgaagcggugcucccggaggaacaggaccagaauuauguguguaagcacaccuacgucgaucgcggcugggggaacggaugcggccuguucgggaaaggaagccuugugaccugcgccaaguuucaaugucuggagcccauugagggcaagguugugcaguaugaaaaucucaaauacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccuagaacgggacuggacuucaaugagaugauucuucugaccaugaagaacaaagccuggaugguccaucggcagugguuuuucgaucucccccugccguggacaagcggcgccaccacagaaaccccuacguggaaucgcaaggagcuucuggugacauuuaaaaacgcucacgcgaagaaacaagaagucgugguucucgggucucaggagggagccaugcacaccgcucugacaggcgccaccgaaauccagaauuccgggggcaccagcauuuucgccggacaucugaaguguagacucaagauggacaaacuggagcuuaagggcaugucuuacgcuaugugcacaaacacguuugugcugaaaaaggaggucuccgaaacccagcacgggacaauccucaucaaaguggaguacaagggagaagauguucccuguaagauuccuuucagcaccgaggacggccaagggaaagcccauaacggacggcugaucacagcgaaucccguggucaccaagaaagaggaacccgugaacauugaggcugaaccuccguucggcgaguccaauaucgugauugggaucggcgauaacgcccugaagaucaauugguauaaaaagggaucuagcauuggcaagauguuugaagccacggcuagaggggcccgccggauggcuauccuuggagacacagccugggauuucggcuccguugggggaguccucaacagccugggcaaaauggugcaccagauuuuugggucugcguacaccgcccuguucuccggcgugagcugggucaugaagaucggaauuggcgugcuccugaccuggaucgggcuuaauucuaaaaacacaagcauguccuuuucuugcauuguuaucggaaucauuacccuguaucucggcgcugugguccaggccgacauggggugugugaucaauuggaagggaaaagagcugaagugcggcagcgggauuuucguuacaaacgaggugcauacguggaccgaacaguacaaguuucaagcugauucccccaaaagacuggccacagcgaucgccggcgcuugggagaauggagucuguggcauucgcagcaccacacggauggaaaaccuucucuggaagcagaucgccaaugagcugaacuauauccugugggaaaauaacauuaaacucaccgugguugugggggacaucauuggaguccuggagcagggcaagagaacgcuuaccccucagcccauggagcugaaauacucuuggaagacaugggggaaagcuaagaucgugaccgccgaaacacaaaacuccagcuucauuaucgauggaccuaauacccccgagugcccgucugccucccgcgcuuggaacgugugggaagucgaggacuauggcuuuggcguuuucacaaccaauaucuggcucaagcugcgggaaguguacacgcagcugugugaccacagacuuaugagcgcggccgugaaagaugagcgcgcuguccacgccgacaugggguacuggauugagucccagaagaacggaucuuggaaacucgaaaaggccagccugaucgaggugaaaacaugcaccuggccuaagucccauacccuguggucuaauggcguucucgaaagcgauaugauuauccccaagucccuggcugggccuauuagccagcacaacuaucggcccggauaccauacacaaaccgccggcccuuggcaccuugggaaacuggagcucgacuuuaauuauugcgagggaacgacaguggucaucaccgaaaacuguggcacaagaggccccucucugcgcaccacaaccguguccgggaagcugauccacgaguggugcugucggagcugcacgcuuccgccucucagauacaugggagaagauggcuguugguaugggauggagauucggcccaucucugaaaaagaggagaauaugguuaagucccuggugagcgcgggaucuggcaaagucgacaacuucaccaugggggugcugugccucgcuauucuguuugaagagguuaugcgcggaaaguucggcaagaaacauaugaucgccggcguguucuuuacauucguccuucugcucagcgggcagauuaccuggagagauauggcccacacacugaucaugauuggauccaaugcuagcgaccggaugggcaugggggugaccuaccuggcccuuaucgcgacguuuaagauccagcccuuccuggcucucggauuuuuccugagaaaacucacaucucgcgaaaaccugcuucugggcguggggcucgccauggccaccacacugcaacugccugaggauauugaacagauggcuaauggaaucgcccuuggccugauggcucucaagcugauuacccaguuugagaccuaucagcucuggacagcccugaucucccuuacguguagcaacaccauuuucacacugaccgucgcguggcggacagccacccucauccuggcuggcguuucccugcuuccggugugccaaucuagcuccaugagaaaaacggacuggcugcccaugacaguggccgcuaugggggucccuccccucccucuguuuaucuucucucucaaggauacccugaagcgcagaagcuggccccuuaaugagggagugauggccguuggccugguguccauucuggccucuagccuccugcggaacgacgucccuauggcugggccccuuguggcgggaggccugcucaucgccuguuacguuauuaccgggacauccgcugaucugaccguggaaaaagccgccgacgucacaugggaggaagaggcugaacagacgggagugagccauaaccucaugaucaccgucgacgaugacggcacaaugcgcauuaaggaugacgagaccgagaauauccugacagugcuucugaaaaccgcccugcucaucguuucuggcauuuuuccguacuccaucccugcgacgcugcuuguguggcacaccuggcagaagcagacacaaagaagcgggguccugugggaugugcccucuccucccgaaacccagaaagcugagcucgaagagggaguuuaucggauuaagcagcagggcaucuucgggaaaacacaagugggagucggcgugcagaaggaggggguguuucauaccauguggcacguuacacgcggagccguccugacguacaacggcaagagacucgaaccgaauugggccuccgugaaaaaggaccugauuagcuauggcgggggauggcggcuuucugcucaguggcaaaaaggcgaggaagugcaggucaucgccguggagccugggaagaaccccaaaaauuuccagaccaugccuggaacauuccagaccaccacaggcgaaauuggggcgaucgcucuggauuuuaagcccggaacguccggcagccccaucauuaaccgcgagggcaagguuguggggcuguacggaaauggcgucgugaccaaaaacgggggauauguuuccggcaucgcccaaacaaaugccgagccugacgggccgacccccgaacucgaggaagagauguucaagaaaagaaaccugacaauuauggaucuucacccuggcagcggaaagacccggaaauaccugcccgcuaucgugcgcgaagccauuaagagacggcucagaacgcugauccucgcuccuacacgcgucguggccgcggagauggaggaagcccugaagggccuucccauccgguaucagaccaccgcuacaaaaucugagcauaccgggagagaaauuguugaccugaugugccacgccacauuuaccaugcgccugcucagcccugugcgggucccgaauuacaaccugaucauuauggaugaggcucauuucacggaccccgccuccaucgccgcuagaggauacauuucuacacgcgugggcaugggggaagcggccgcuaucuuuaugaccgccacaccucccggaaccgccgaugcuuucccucagagcaaugcccccauccaggacgaggagcgggacauuccggaaagauccuggaacucuggcaaugaguggaucacggauuuugcggggaagaccgugugguucgucccuagcauuaaagcuggcaacgacaucgccaacugucuucgcaagaauggaaaaaagguuauucaacugucccggaagacauuugauaccgaauaucagaaaacaaagcucaacgacugggauuucguggugaccacagacaucucugagaugggcgccaauuuuaaagcugauagagucauugacccccggcgcugccugaagcccgugauccugaccgaugggccugagagaguuauccucgccggacccaugccugugacggcggccagcgcugcccagcggcgcggcagagucgggcggaacccgcagaaagaaaaugaccaauacauuuucacaggacagccccuuaacaaugaugaggaccacgcucauuggaccgaagccaagaugcugcuggacaacaucaauaccccugagggcauuauccccgcucucuucgaaccugagagagagaaguccgccgcgauugauggggaauaucgccugaaaggcgagagccggaagacauuuguggaacuuaugagacgcggagaccugcccguuuggcucgcccacaaaguggcuucugagggcaucaaguacaccgaucggaaauggugcuucgacgggcagagaaacaaucagauccuggaagagaacauggaugucgagauuuggacaaaggaaggagagaaaaagaagcugcgcccgcgguggcucgacgccagaacguauuccgauccucuugcucugaaagaauuuaaggacuucgccgccggccgcaaaagcaucgcucuggaucucgugaccgagauugggagaguccccucucaccuggcgcaucggacacgcaaugcccuugacaaccuggugaugcuccacaccuccgaacauggaggcaaggcuuacagacacgccguugaggagcugccugaaacaauggagacccugcuccuucugggccugaugauccuccugacggggggagccaugcuuuuucugauuagcggcaaagggaucggaaagaccuccaucggccucauuugugugaucgcuucuagcgggaugcuguggauggccgaaauuccccugcaauggaucgcguccgccauugugcucgaguucuuuaugaugguccuucugaucccugagcccgaaaagcagcggacaccgcaggauaaucaacuggcuuauguugugauuggaauccucacccuggccgcuaucauugccgcgaacgagaugggccuucuggaaacaaccaaacgcgaccucggcaugagcaaggagccugggguggucucucccacguccuaccuggauguggaccugcaccccgccagcgcuuggacacucuacgccguugcuaccacagugaucaccccuaugcuuagacauaccauugaaaauucuacagccaacgucagccuggcugccaucgcgaaccaggccgugguccugaugggacucgacaaaggcuggccgauuuccaagauggaucugggggugccccuucuggcucucggaugcuauucucagguuaauccucugacgcugaccgccgcugugcuccuucugaucacacacuacgccaucauuggccccgggcugcaggccaaagcgacccgggaggcucaaaagagaacagccgcuggaaucaugaagaacccuaccgucgacggcauuaugacgaucgaucucgaccccgugauuuaugauagcaaauucgagaagcagcugggccagguuaugcuucuggugcucugugccguccagcugcugcucaugcgcacauccugggcccuuugcgaagcucugacccuggccaccgggccuaucacaacccucugggagggaucuccgggcaaauuuuggaauacaacgaucgcggugagcauggccaacauuuuccggggguccuaccuggcuggagccggccuugcuuuuagcaucaugaagucuguggggaccggaaaaagaggcacaggcucccaaggggaaacccugggagagaaguggaagaaaaagcucaaucagcugagccgcaaagaauucgaccuguauaagaaauccggcauuacagagguugaucggaccgaggccaaggaagggcucaaaagaggagagaucacgcaucacgcggucucucggggcagcgccaagcuucagugguuuguggaacgcaacauggugauucccgaggggagagucaucgaccugggauguggccggggcgggugguccuacuauugcgcuggacugaagaaaguuaccgaagugcgcggcuacacaaaggggggaccuggccaugaggagcccgugccuaugucuaccuacggguggaauauugucaaacucaugagcggaaaggauguguucuaucugcccccggaaaaaugugacacacuucugugcgauaucggcgaguccagcccuucucccaccguugaagaguccagaacaauccgggugcucaagauggucgagcccuggcugaagaacaaucaguucuguauuaaagugcugaacccuuacaugcccaccguuaucgaacaccucgagcgccuucaaagaaagcacggcgggaugcuggugcggaauccucugagccgcaacucuacgcaugaaauguauuggauuuccaauggaacaggcaacaucgucgccagcgugaauauggugucuagacuccugcuuaaccgguuuaccaugacccacagacgcccgacaauugagaaagacgucgaucugggggcuggaacgcggcauguuaacgccgaacccgagaccccuaauauggacgugaucggcgagagaaucaagcgcauuaaagaagagcacaacagcacauggcacuacgacgaugaaaaucccuauaagaccugggcuuaccauggguccuaugaggugaaggccacaggaucugcgagcuccaugaucaacggcgucgugaaacuccugaccaagccuugggacguugugcccauggucacacagauggccaugaccgauacgaccccguucggccagcaacggguguuuaaagaaaagguugacacaagaaccccucgcagcaugcccgggacacggagagugaugggaauuaccgcugaguggcuguggcgcacgcucggccggaauaaaaagccuagacugugcacacgcgaggaauucaccaagaaaguccggacaaacgccgcuaugggggccguguuuaccgaggaaaaucagugggauuccgccaaggcggcuguugaggacgaagauuucuggauccuuguggacagagagcgcgagcugcacaaacucggaaaguguggcucuugcgucuacaacaugauggggaaaagagaaaagaaacugggcgaguuuggaaaggccaagggcagccgggccauuugguacauguggcuuggggcucgcuaucuggaauucgaggcccucggauuucugaaugaggaucauugguucuccagagaaaacucuuacagcggcguggagggggaaggacugcacaaacucggcuauauccugcgggacaucuccaagauucccgggggcgcuauguacgccgaugacacggcgggaugggacaccagaaucacagaggaugaccuucauaaugaagagaaaauuacccagcagauggauccugagcaccggcaacuggccaacgcuaucuuuaagcucacauaucagaauaaagucgugaagguucagcgccccaccccgacaggcaccgugauggacauuaucucuagaaaggaucagcgggggagcggacaagucggcacguacgggcugaacacauucaccaauauggaagcccagcuuauccgccagauggagggagaaggcgugcuguccaaagcugaccucgagaacccucaccugcccgaaaagaaaauuacccaguggcuggagacaaaggggguggagagacucaaacggauggccaucagcggcgaugacugcguugugaagcccauugaugaccgcuuugcgaacgcccugcuugcucugaaugauaugggaaaggucagaaaagacaucccucaauggcagccgucuaagggcuggcaugauuggcagcaggugcccuucuguucccaccauuuccacgaacucauuaugaaagacgggcggaagcugguugugccuugccgcccccaagacgagcuuaucggaagagcccggauuagccagggcgcuggguggucucugcgcgaaaccgccugucucggaaaagcuuaugcccagauguggucccugauguacuuucacagacgggaucugcgccucgcgagcaacgccaucugcucugcugucccugugcauuggguccccacauccagaacgaccuggagcauccacgcccaucaccaauggaugacaaccgaggacaugcugacaguguggaaucggguuuggauugaagauaacccuuggauggaggacaagacccccgugacgaccugggagaaugucccguaccuuggcaagagagaagaucaguggugugggucccugaucggccucacaagccgcgccaccugggcucagaacauuccuacagccauccagcaagugcggucucugauuggaaaugaggaauuccuugacuauaugcccagcaugaaaagauuucgcaaggaggaggaauccgagggcgcgaucugguga

SEQ ID NO: 20725 - RNA, 9873 nt, Artificial Sequence
  derived and/or modified CDS sequence (opt5) from DENV-3__FJ547073__SS-prME
accagccugugccucaugaugauccugcccgccgcucuugccuuccaccugacgucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauuguuaucggaaucauuacccuguaucucggcgcugugguccaggccgacauggggugugugaucaauuggaaaggaaaggagcugaagugcggcagcgggauuuucguuacaaacgaggugcauacguggaccgaacaguacaaauuucaagcugauucccccaagcggcuggccacagcgaucgccggcgcuugggagaauggagucuguggcauuagaagcaccacacgcauggaaaaccuucucuggaaacagaucgccaaugagcugaacuauauccugugggaaaauaacauuaagcucaccgugguugugggggacaucauuggaguccuggagcagggcaaacggacgcuuaccccucagcccauggagcugaaguacucuuggaaaacaugggggaaggcuaagaucgugaccgccgaaacacaaaacuccagcuucauuaucgauggaccuaauacccccgagugcccgucugccuccagagcuuggaacgugugggaagucgaggacuauggcuuuggcguuuucacaaccaauaucuggcucaaacugcgcgaaguguacacgcagcugugugaccaccggcuuaugagcgcggccgugaaggaugagagagcuguccacgccgacaugggguacuggauugagucccagaaaaacggaucuuggaagcucgaaaaagccagccugaucgaggugaagacaugcaccuggccuaagucccauacccuguggucuaauggcguucucgaaagcgauaugauuauccccaaaucccuggcugggccuauuagccagcacaacuaucgccccggauaccauacacaaaccgccggcccuuggcaccuugggaagcuggagcucgacuuuaauuauugcgagggaacgacaguggucaucaccgaaaacuguggcacacggggccccucucugagaaccacaaccguguccgggaaacugauccacgaguggugcugucgcagcugcacgcuuccgccucuccgguacaugggagaagauggcuguugguaugggauggagauuagacccaucucugaaaaggaggagaauaugguuaaaucccuggugagcgcgggaucuggcaaggucgacaacuucaccaugggggugcugugccucgcuauucuguuugaagagguuaugcggggaaaguucggcaaaaagcauaugaucgccggcguguucuuuacauucguccuucugcucagcgggcagauuaccuggcgcgauauggcccacacacugaucaugauuggauccaaugcuagcgacagaaugggcaugggggugaccuaccuggcccuuaucgcgacguuuaaaauccagcccuuccuggcucucggauuuuuccugcggaagcucacaucuagagaaaaccugcuucugggcguggggcucgccauggccaccacacugcaacugccugaggauauugaacagauggcuaauggaaucgcccuuggccugauggcucucaaacugauuacccaguuugagaccuaucagcucuggacagcccugaucucccuuacguguagcaacaccauuuucacacugaccgucgcguggcgcacagccacccucauccuggcuggcguuucccugcuuccggugugccaaucuagcuccaugcggaagacggacuggcugcccaugacaguggccgcuaugggggucccuccccucccucuguuuaucuucucucucaaggauacccugaaaagacgcagcuggccccuuaaugagggagugauggccguuggccugguguccauucuggccucuagccuccugagaaacgacgucccuauggcugggccccuuguggcgggaggccugcucaucgccuguuacguuauuaccgggacauccgcugaucugaccguggaaaaggccgccgacgucacaugggaggaagaggcugaacagacgggagugagccauaaccucaugaucaccgucgacgaugacggcacaaugcggauuaaagaugacgagaccgagaauauccugacagugcuucugaagaccgcccugcucaucguuucuggcauuuuuccguacuccaucccugcgacgcugcuuguguggcacaccuggcagaaacagacacaacgcagcgggguccugugggaugugcccucuccucccgaaacccagaaggcugagcucgaagagggaguuuauagaauuaaacagcagggcaucuucgggaagacacaagugggagucggcgugcagaaggaggggguguuucauaccauguggcacguuacacggggagccguccugacguacaacggcaaacgccucgaaccgaauugggccuccgugaagaaagaccugauuagcuauggcgggggauggagacuuucugcucaguggcaaaagggcgaggaagugcaggucaucgccguggagccugggaaaaaccccaagaauuuccagaccaugccuggaacauuccagaccaccacaggcgaaauuggggcgaucgcucuggauuuuaagcccggaacguccggcagccccaucauuaaccgggagggcaaaguuguggggcuguacggaaauggcgucgugaccaagaacgggggauauguuuccggcaucgcccaaacaaaugccgagccugacgggccgacccccgaacucgaggaagagauguucaaaaagcgcaaccugacaauuauggaucuucacccuggcagcggaaaaaccagaaaguaccugcccgcuaucgugcgggaagccauuaagcgcagacuccggacgcugauccucgcuccuacaagagucguggccgcggagauggaggaagcccugaaaggccuucccauccgcuaucagaccaccgcuacaaagucugagcauaccgggcgggaaauuguugaccugaugugccacgccacauuuaccaugagacugcucagcccugugcgcgucccgaauuacaaccugaucauuauggaugaggcucauuucacggaccccgccuccaucgccgcucggggauacauuucuacaagagugggcaugggggaagcggccgcuaucuuuaugaccgccacaccucccggaaccgccgaugcuuucccucagagcaaugcccccauccaggacgaggagcgcgacauuccggaacgguccuggaacucuggcaaugaguggaucacggauuuugcggggaaaaccgugugguucgucccuagcauuaaggcuggcaacgacaucgccaacugucuucgcaaaaauggaaagaagguuauucaacuguccagaaaaacauuugauaccgaauaucagaagacaaaacucaacgacugggauuucguggugaccacagacaucucugagaugggcgccaauuuuaaggcugaucgggucauugaccccagacggugccugaaacccgugauccugaccgaugggccugagcgcguuauccucgccggacccaugccugugacggcggccagcgcugcccagagacggggccgcgucgggagaaacccgcagaaggaaaaugaccaauacauuuucacaggacagccccuuaacaaugaugaggaccacgcucauuggaccgaagccaagaugcugcuggacaacaucaauaccccugagggcauuauccccgcucucuucgaaccugagcgggagaaauccgccgcgauugauggggaauauagacugaagggcgagagccgcaaaacauuuguggaacuuaugcggagaggagaccugcccguuuggcucgcccacaagguggcuucugagggcaucaaauacaccgaucgcaaguggugcuucgacgggcagcggaacaaucagauccuggaagagaacauggaugucgagauuuggacaaaagaaggagagaagaagaaacugagaccgcgcuggcucgacgcccggacguauuccgauccucuugcucugaaggaauuuaaagacuucgccgccggcagaaagagcaucgcucuggaucucgugaccgagauugggcgcguccccucucaccuggcgcauagaacacggaaugcccuugacaaccuggugaugcuccacaccuccgaacauggaggcaaggcuuaccgcuaugccguugaggagcugccugaaacaauggagacccugcuccuucugggccugaugauccuccugacagggggagccaugcuuuuucugauuagcggcaaggggaucggaaagaccuccaucggccucauuugugugaucgcuucuagcgggaugcuguggauggccgaaauuccccugcaauggaucgcguccgccauugugcucgaguucuuuaugaugguccuucugaucccugagcccgaaaaacagagaacaccgcaggauaaucaacuggcuuacguugugauuggaauccucacccuggccgcuaucauugccgcgaacgagaugggccuucuggaaacaaccaagcgggaccucggcaugagcaaagagccugggguggucucucccacguccuaccuggauguggaccugcaccccgccagcgcuuggacacucuaugccguugcuaccacagugaucaccccuaugcuucgccacaccauugaaaauucuacagccaacgucagccuggcugccaucgcgaaccaggccgugguccugaugggacucgacaagggcuggccgauuuccaaaauggaucugggggugccccuucuggcucucggaugcuacucucagguuaauccucugacgcugaccgccgcugugcuccuucugaucacacauuaugccaucauuggccccgggcugcaggccaaggcgaccagagaggcucaaaagcggacagccgcuggaaucaugaaaaacccuaccgucgacggcauuaugacgaucgaucucgaccccgugauuuacgauagcaaguucgagaaacagcugggccagguuaugcuucuggugcucugugccguccagcugcugcucaugagaacauccugggcccuuugcgaagcucugacccuggccaccgggccuaucacaacccucugggagggaucuccgggcaaguuuuggaauacaacgaucgcggugagcauggccaacauuuuccgcggguccuaucuggcuggagccggccuugcuuuuagcaucaugaaaucuguggggaccggaaagcggggcacaggcucccaaggggaaacccugggagagaaguggaaaaagaaacucaaucagcugagcagaaaggaguucgaccuguacaaaaaguccggcauuacagagguugaucgcaccgaggccaaagaagggcucaagcggggagagaucacgcaccaugcggucucuagaggcagcgccaaacuucagugguuuguggaacggaacauggugauucccgaggggcgcgucaucgaccugggauguggcagaggcgggugguccuauuacugcgcuggacugaaaaagguuaccgaagugcggggcuacacaaaagggggaccuggccacgaggagcccgugccuaugucuaccuauggguggaauauugucaagcucaugagcggaaaagauguguucuaccugcccccggaaaagugugacacacuucugugcgauaucggcgaguccagcccuucucccaccguugaagagucccgcacaaucagagugcucaagauggucgagcccuggcugaaaaacaaucaguucuguauuaaggugcugaacccuuauaugcccaccguuaucgaacaucucgagcggcuucaacgcaaacacggcgggaugcuggugagaaauccucugagccggaacucuacgcacgaaauguacuggauuuccaauggaacaggcaacaucgucgccagcgugaauauggugucucgccuccugcuuaacagauuuaccaugacccaucggagaccgacaauugagaaggacgucgaucugggggcuggaacgcgccacguuaacgccgaacccgagaccccuaauauggacgugaucggcgagcggaucaaaagaauuaaggaagaacacaacagcacauggcacuaugacgaugaaaaucccuacaagaccugggcuuaucacggguccuacgaggugaaagccacaggaucugcgagcuccaugaucaacggcgucgugaagcuccugaccaaaccuugggacguugugcccauggucacacagauggccaugaccgauacgaccccguucggccagcaacgcguguuuaaggaaaaaguugacacacggaccccuagaagcaugcccgggacacgccgggugaugggaauuaccgcugaguggcuguggagaacgcucggccgcaauaagaagccucggcugugcacaagagaggaguucaccaaaaagguccgcacaaacgccgcuaugggggccguguuuaccgaggaaaaucagugggauuccgccaaagcggcuguugaggacgaagauuucuggauccuuguggaccgggagagagagcugcauaagcucggaaaauguggcucuugcgucuacaacaugauggggaagcgcgagaaaaagcugggcgaguuuggaaaggccaaaggcagcagagccauuugguauauguggcuuggggcucgguaccuggaguucgaggcccucggauuucugaaugaggaucacugguucucccgcgaaaacucuuauagcggcguggagggggaaggacugcauaagcucggcuacauccugagagacaucuccaaaauucccgggggcgcuauguaugccgaugacacggcgggaugggacacccggaucacagaggaugaccuucacaaugaagagaagauuacccagcagauggauccugagcauagacaacuggccaacgcuaucuuuaaacucacauaccagaauaaggucgugaagguucagcggcccaccccgacaggcaccgugauggacauuaucucucgcaaagaucagagagggagcggacaagucggcacguaugggcugaacacauucaccaauauggaagcccagcuuauccggcagauggagggagaaggcgugcuguccaaggcugaccucgagaacccucaucugcccgagaaaaagauuacccaguggcuggagacaaaagggguggagcgccucaagagaauggccaucagcggcgaugacugcguugugaagcccauugaugaccgguuugcgaacgcccugcuugcucugaaugauaugggaaaaguccgcaaggacaucccucaauggcagccgucuaaaggcuggcacgauuggcaacaggugcccuucuguucccaucacuuccaugaacucauuaugaaggacgggagaaaacugguugugccuugccggccccaagacgagcuuaucggacgcgccagaauuagccagggcgcuggguggucucugcgggaaaccgccugucucggaaaggcuuacgcccagauguggucccugauguacuuucaccgcagagaucugcggcucgcgagcaacgccaucugcucugcugucccugugcacuggguccccacaucccgcacgaccuggagcauccaugcccaccaucaauggaugacaaccgaggacaugcugacaguguggaauagaguuuggauugaagauaacccuuggauggaggacaagacccccgugacgaccugggagaaugucccguaucuuggcaaacgggaagaucaguggugugggucccugaucggccucacaagcagagccaccugggcucagaacauuccuacagccauccagcaagugcgcucucugauuggaaaugaggaguuccuugacuacaugcccagcaugaagcgguuuagaaaagaggaggaauccgagggcgcgaucugguga

SEQ ID NO: 20726 - RNA, 9873 nt, Artificial Sequence
  derived and/or modified CDS sequence (opt5) from DENV-3__FJ547074__SS-prME
accagccugugccucaugaugauccugcccgccgcucuugccuuccaccugacgucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauuguuaucggaaucauuacccuguaucucggcgcugugguccaggccgacauggggugugugaucaauuggaaaggaaaggagcugaagugcggcagcgggauuuucguuacaaacgaggugcauacguggaccgaacaguacaaauuucaagcugauucccccaagcggcuggccacagcgaucgccggcgcuugggagaauggagucuguggcauuagaagcaccacacgcauggaaaaccuucucuggaaacagaucgccaaugagcugaacuauauccugugggaaaauaacauuaagcucaccgugguugugggggacaucauuggaguccuggagcagggcaaacggacgcuuaccccucagcccauggagcugaaguacucuuggaaaacaugggggaaggcuaagaucgugaccgccgaaacacaaaacuccagcuucauuaucgauggaccuaauacccccgagugcccgucugccuccagagcuuggaacgugugggaagucgaggacuauggcuuuggcguuuucacaaccaauaucuggcucaaacugcgcgaaguguacacgcagcugugugaccaccggcuuaugagcgcggccgugaaggaugagagagcuguccacgccgacaugggguacuggauugagucccagaaaaacggaucuuggaagcucgaaaaagccagccugaucgaggugaagacaugcaccuggccuaagucccauacccuguggucuaauggcguucucgaaagcgauaugauuauccccaaaucccuggcugggccuauuagccagcacaacuaucgccccggauaccauacacaaaccgccggcccuuggcaccuugggaagcuggagcucgacuuuaauuauugcgagggaacgacaguggucaucaccgaaaacuguggcacacggggccccucucugagaaccacaaccguguccgggaaacugauccacgaguggugcugucgcagcugcacgcuuccgccucuccgguacaugggagaagauggcuguugguaugggauggagauuagacccaucucugaaaaggaggagaauaugguuaaaucccuggugagcgcgggaucuggcaaggucgacaacuucaccaugggggugcugugccucgcuauucuguuugaagagguuaugcggggaaaguucggcaaaaagcauaugaucgccggcguguucuuuacauucguccuucugcucagcgggcagauuaccuggcgcgauauggcccacacacugaucaugauuggauccaaugcuagcgacagaaugggcaugggggugaccuaccuggcccuuaucgcgacguuuaaaauccagcccuuccuggcucucggauuuuuccugcggaagcucacaucuagagaaaaccugcuucugggcguggggcucgccauggccaccacacugcaacugccugaggauauugaacagauggcuaauggaaucgcccuuggccugauggcucucaaacugauuacccaguuugagaccuaucagcucuggacagcccugaucucccuuacguguagcaacaccauuuucacacugaccgucgcguggcgcacagccacccucauccuggcuggcguuucccugcuuccggugugccaaucuagcuccaugcggaagacggacuggcugcccaugacaguggccgcuaugggggucccuccccucccucuguuuaucuucucucucaaggauacccugaaaagacgcagcuggccccuuaaugagggagugauggccguuggccugguguccauucuggccucuagccuccugagaaacgacgucccuauggcugggccccuuguggcgggaggccugcucaucgccuguuacguuauuaccgggacauccgcugaucugaccguggaaaaggccgccgacgucacaugggaggaagaggcugaacagacgggagugagccauaaccucaugaucaccgucgacgaugacggcacaaugcggauuaaagaugacgagaccgagaauauccugacagugcuucugaagaccgcccugcucaucguuucuggcauuuuuccguacuccaucccugcgacgcugcuuguguggcacaccuggcagaaacagacacaacgcagcgggguccugugggaugugcccucuccucccgaaacccagaaggcugagcucgaagagggaguuuauagaauuaaacagcagggcaucuucgggaagacacaagugggagucggcgugcagaaggaggggguguuucauaccauguggcacguuacacggggagccguccugacguacaacggcaaacgccucgaaccgaauugggccuccgugaagaaagaccugauuagcuauggcgggggauggagacuuucugcucaguggcaaaagggcgaggaagugcaggucaucgccguggagccugggaaaaaccccaagaauuuccagaccaugccuggaacauuccagaccaccacaggcgaaauuggggcgaucgcucuggauuuuaagcccggaacguccggcagccccaucauuaaccgggagggcaaaguuguggggcuguacggaaauggcgucgugaccaagaacgggggauauguuuccggcaucgcccaaacaaaugccgagccugacgggccgacccccgaacucgaggaagagauguucaaaaagcgcaaccugacaauuauggaucuucacccuggcagcggaaaaaccagaaaguaccugcccgcuaucgugcgggaagccauuaagcgcagacuccggacgcugauccucgcuccuacaagagucguggccgcggagauggaggaagcccugaaaggccuucccauccgcuaucagaccaccgcuacaaagucugagcauaccgggcgggaaauuguugaccugaugugccacgccacauuuaccaugagacugcucagcccugugcgcgucccgaauuacaaccugaucauuauggaugaggcucauuucacggaccccgccuccaucgccgcucggggauacauuucuacaagagugggcaugggggaagcggccgcuaucuuuaugaccgccacaccucccggaaccgccgaugcuuucccucagagcaaugcccccauccaggacgaggagcgcgacauuccggaacgguccuggaacucuggcaaugaguggaucacggauuuugcggggaaaaccgugugguucgucccuagcauuaaggcuggcaacgacaucgccaacugucuucgcaaaaauggaaagaagguuauucaacuguccagaaaaacauuugauaccgaauaucagaagacaaaacucaacgacugggauuucguggugaccacagacaucucugagaugggcgccaauuuuaaggcugaucgggucauugaccccagacggugccugaaacccgugauccugaccgaugggccugagcgcguuauccucgccggacccaugccugugacggcggccagcgcugcccagagacggggccgcgucgggagaaacccgcagaaggaaaaugaccaauacauuuucacaggacagccccuuaacaaugaugaggaccacgcucauuggaccgaagccaagaugcugcuggacaacaucaauaccccugagggcauuauccccgcucucuucgaaccugagcgggagaaauccgccgcgauugauggggaauauagacugaagggcgagagccgcaaaacauuuguggaacuuaugcggagaggagaccugcccguuuggcucgcccacaagguggcuucugagggcaucaaauacaccgaucgcaaguggugcuucgacgggcagcggaacaaucagauccuggaagagaacauggaugucgagauuuggacaaaagaaggagagaagaagaaacugagaccgcgcuggcucgacgcccggacguauuccgauccucuugcucugaaggaauuuaaagacuucgccgccggcagaaagagcaucgcucuggaucucgugaccgagauugggcgcguccccucucaccuggcgcauagaacacggaaugcccuugacaaccuggugaugcuccacaccuccgaacauggaggcaaggcuuaccgccacgccguugaggagcugccugaaacaauggagacccugcuccuucugggccugaugauccuccugacagggggagccaugcuuuuucugauuagcggcaaggggaucggaaagaccuccaucggccucauuugugugaucgcuucuagcgggaugcuguggauggccgaaauuccccugcaauggaucgcguccgccauugugcucgaguucuuuaugaugguccuucugaucccugagcccgaaaaacagagaacaccgcaggauaaucaacuggcuuauguugugauuggaauccucacccuggccgcuaucauugccgcgaacgagaugggccuucuggaaacaaccaagcgggaccucggcaugagcaaagagccugggguggucucucccacguccuaccuggauguggaccugcaccccgccagcgcuuggacacucuacgccguugcuaccacagugaucaccccuaugcuucgccauaccauugaaaauucuacagccaacgucagccuggcugccaucgcgaaccaggccgugguccugaugggacucgacaagggcuggccgauuuccaaaauggaucugggggugccccuucuggcucucggaugcuauucucagguuaauccucugacgcugaccgccgcugugcuccuucugaucacacacuacgccaucauuggccccgggcugcaggccaaggcgaccagagaggcucaaaagcggacagccgcuggaaucaugaaaaacccuaccgucgacggcauuaugacgaucgaucucgaccccgugauuuaugauagcaaguucgagaaacagcugggccagguuaugcuucuggugcucugugccguccagcugcugcucaugagaacauccugggcccuuugcgaagcucugacccuggccaccgggccuaucacaacccucugggagggaucuccgggcaaguuuuggaauacaacgaucgcggugagcauggccaacauuuuccgcggguccuaccuggcuggagccggccuugcuuuuagcaucaugaaaucuguggggaccggaaagcggggcacaggcucccaaggggaaacccugggagagaaguggaaaaagaaacucaaucagcugagcagaaaggaguucgaccuguauaaaaaguccggcauuacagagguugaucgcaccgaggccaaagaagggcucaagcggggagagaucacgcaucacgcggucucuagaggcagcgccaaacuucagugguuuguggaacggaacauggugauucccgaggggcgcgucaucgaccugggauguggcagaggcgggugguccuacuauugcgcuggacugaaaaagguuaccgaagugcggggcuacacaaaagggggaccuggccaugaggagcccgugccuaugucuaccuacggguggaauauugucaagcucaugagcggaaaagauguguucuaucugcccccggaaaagugugacacacuucugugcgauaucggcgaguccagcccuucucccaccguugaagagucccgcacaaucagagugcucaagauggucgagcccuggcugaaaaacaaucaguucuguauuaaggugcugaacccuuacaugcccaccguuaucgaacaccucgagcggcuucaacgcaaacacggcgggaugcuggugagaaauccucugagccggaacucuacgcaugaaauguauuggauuuccaauggaacaggcaacaucgucgccagcgugaauauggugucucgccuccugcuuaacagauuuaccaugaccuaccggagaccgacaauugagaaggacgucguucugggggcuggaacgcgccacgugaacgccgaacccgagaccccuaauauggaugugaucggcgagcggaucaaaagaauuaaggaagaacacaacagcacauggcacuaugacgacgaaaaucccuacaagaccugggcuuaucacggguccuacgaggucaaagccacaggaucugcgagcuccaugaucaacggcgugguuaagcuccugaccaaaccuugggaugugguccccauggugacacagauggccaugaccgacacgaccccguucggccagcaacgcguuuuuaaggaaaaaguggauacacggaccccuagaagcaugcccgggacacgccgggucaugggaauuaccgcugaguggcuguggagaacgcucggccgcaauaagaagccucggcugugcacaagagaggaguucaccaaaaaggugcgcacaaacgccgcuaugggggccguuuuuaccgaggaaaaucagugggacuccgccaaagcggcuguggaggaugaagacuucuggauccuugucgaucgggagagagagcugcauaagcucggaaaauguggcucuugcguguacaacaugauggggaagcgcgagaaaaagcugggcgaguuuggaaaggccaaaggcagcagagccauuugguauauguggcuuggggcucgguaccuggaguucgaggcccucggauuucugaaugaggaccacugguucucccgcgaaaacucuuauagcggcgucgagggggaaggacugcauaagcucggcuacauccugagagauaucuccaaaauucccgggggcgcuauguaugccgacgauacggcgggaugggacacccggaucacagaggacgaucuucacaaugaagagaagauuacccagcagauggacccugagcauagacaacuggccaacgcuaucuuuaaacucacauaccagaauaaggugguuaaggugcagcggcccaccccgacaggcaccgucauggauauuaucucucgcaaagaccagagagggagcggacaagugggcacguaugggcugaacacauucaccaauauggaagcccagcuuauccggcagauggagggagaaggcgugcuguccaaggcugaucucgagaacccucaucugcccgagaaaaagauuacccaguggcuggagacaaaagggguugagcgccucaagagaauggccaucagcggcgacgauugcguggucaagcccauugacgaucgguuugcgaacgcccugcuugcucugaaugacaugggaaaagugcgcaaggauaucccucaauggcagccgucuaaaggcuggcacgacuggcagcagguucccuucuguucccaucacuuccaugaacucauuaugaaggaugggagaaaacugguggucccuugccggccccaagacgagcuuaucggacgcgccagaauuagccagggcgcuggguggucucugcgggaaaccgccugucucggaaaggcuuacgcccagauguggucccugauguacuuucaccgcagagaccugcggcucgcgagcaacgccaucugcucugcugugccuguccacugggugcccacaucccgcacgaccuggagcauccaugcccaccaucaauggaugacaaccgaggauaugcugacaguuuggaauagaguguggauugaagacaacccuuggauggaggauaagacccccgucacgaccugggagaaugugccguaucuuggcaaacgggaagaccaguggugugggucccugaucggccucacaagcagagccaccugggcucagaacauuccuacagccauccagcaaguucgcucucugauuggaaaugaggaguuccuugauuacaugcccagcaugaagcgguuuagaaaagaggaggaauccgagggcgcgaucugguga

SEQ ID NO: 20727 - RNA, 9873 nt, Artificial Sequence
  derived and/or modified CDS sequence (opt5) from DENV-3__FJ547075__SS-prME
accagccugugccucaugaugauccugcccgccgcucuugccuuccaccugacgucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcacaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauuguuaucggaaucauuacccuguaucucggcgcugugguccaggccgacauggggugugugaucaauuggaaaggaaaggagcugaagugcggcagcgggauuuucguuacaaacgaggugcauacguggaccgaacaguacaaauuucaagcugauucccccaagcggcuggccacagcgaucgccggcgcuugggagaauggagucuguggcauuagaagcaccacacgcauggaaaaccuucucuggaaacagaucgccaaugagcugaacuauauccugugggaaaauaacauuaagcucaccgugguugugggggacaucauuggaguccuggagcagggcaaacggacgcuuaccccucagcccauggagcugaaguacucuuggaaaacaugggggaaggcuaagaucgugaccgccgaaacacaaaacuccagcuucauuaucgauggaccuaauacccccgagugcccgucugccuccagagcuuggaacgugugggaagucgaggacuauggcuuuggcguuuucacaaccaauaucuggcucaaacugcgcgaaguguacacgcagcugugugaccaccggcuuaugagcgcggccgugaaggaugagagagcuguccacgccgacaugggguacuggauugagucccagaaaaacggaucuuggaagcucgaaaaagccagccugaucgaggugaagacaugcaccuggccuaagucccauacccuguggucuaauggcguucucgaaagcgauaugauuauccccaaaucccuggcugggccuauuagccagcacaacuaucgccccggauaccauacacaaaccgccggcccuuggcaccuugggaagcuggagcucgacuuuaauuauugcgagggaacgacaguggucaucaccgaaaacuguggcacacggggccccucucugagaaccacaaccguguccgggaaacugauccacgaguggugcugucgcagcugcacgcuuccgccucuccgguacaugggagaagauggcuguugguaugggauggagauuagacccaucucugaaaaggaggagaauaugguuaaaucccuggugagcgcgggaucuggcaaggucgacaacuucaccaugggggugcugugccucgcuauucuguuugaagagguuaugcggggaaaguucggcaaaaagcauaugaucgccggcguguucuuuacauucguccuucugcucagcgggcagauuaccuggcgcgauauggcccacacacugaucaugauuggauccaaugcuagcgacagaaugggcaugggggugaccuaccuggcccuuaucgcgacguuuaaaauccagcccuuccuggcucucggauuuuuccugcggaagcucacaucuagagaaaaccugcuucugggcguggggcucgccauggccaccacacugcaacugccugaggauauugaacagauggcuaauggaaucgcccuuggccugauggcucucaaacugauuacccaguuugagaccuaucagcucuggacagcccugaucucccuuacguguagcaacaccauuuucacacugaccgucgcguggcgcacagccacccucauccuggcuggcguuucccugcuuccggugugccaaucuagcuccaugcggaagacggacuggcugcccaugacaguggccgcuaugggggucccuccccucccucuguuuaucuucucucucaaggauacccugaaaagacgcagcuggccccuuaaugagggagugauggccguuggccugguguccauucuggccucuagccuccugagaaacgacgucccuauggcugggccccuuguggcgggaggccugcucaucgccuguuacguuauuaccgggacauccgcugaucugaccguggaaaaggccgccgacgucacaugggaggaagaggcugaacagacgggagugagccauaaccucaugaucaccgucgacgaugacggcacaaugcggauuaaagaugacgagaccgagaauauccugacagugcuucugaagaccgcccugcucaucguuucuggcauuuuuccguacuccaucccugcgacgcugcuuguguggcacaccuggcagaaacagacacaacgcagcgggguccugugggaugugcccucuccucccgaaacccagaaggcugagcucgaagagggaguuuauagaauuaaacagcagggcaucuucgggaagacacaagugggagucggcgugcagaaggaggggguguuucauaccauguggcacguuacacggggagccguccugacguacaacggcaaacgccucgaaccgaauugggccuccgugaagaaagaccugauuagcuauggcgggggauggagacuuucugcucaguggcaaaagggcgaggaagugcaggucaucgccguggagccugggaaaaaccccaagaauuuccagaccaugccuggaacauuccagaccaccacaggcgaaauuggggcgaucgcucuggauuuuaagcccggaacguccggcagccccaucauuaaccgggagggcaaaguuguggggcuguacggaaauggcgucgugaccaagaacgggggauauguuuccggcaucgcccaaacaaaugccgagagcgacgggccuaccccggaacucgaggaagagauguucaaaaagcgcaaccugacaauuauggaucuucaccccggcucuggaaaaaccagaaaguaccugccugcuaucgugcgggaagccauuaagcgcagacuccggacgcugauccucgcucccacaagagucguggccgcggagauggaggaagcccugaaaggccuuccuauccgcuaucagaccaccgcuacaaagagcgagcauaccgggcgggaaauuguugaccugaugugccacgccacauuuaccaugagacugcucucccccgugcgcgucccuaauuacaaccugaucauuauggaugaggcucauuucacggacccggccucuaucgccgcucggggauacauuagcacaagagugggcaugggggaagcggccgcuaucuuuaugaccgccacacccccuggaaccgccgaugcuuucccccaguccaaugccccuauccaggacgaggagcgcgacauucccgaacggucuuggaacagcggcaaugaguggaucacggauuuugcggggaaaaccgugugguucgucccguccauuaaggcuggcaacgacaucgccaacugucuucgcaaaaauggaaagaagguuauucaacugucuagaaaaacauuugauaccgaauaucagaagacaaaacucaacgacugggauuucguggugaccacagacaucagcgagaugggcgccaauuuuaaggcugaucgggucauugacccuagacggugccugaaacccgugauccugaccgaugggcccgagcgcguuauccucgccggaccuaugcccgugacggcggccuccgcugcccagagacggggccgcgucgggagaaacccucagaaggaaaaugaccaauacauuuucacaggacagccgcuuaacaaugaugaggaccacgcucauuggaccgaagccaagaugcugcuggacaacaucaauacccccgagggcauuaucccugcucucuucgaacccgagcgggagaaaagcgccgcgauugauggggaauauagacugaagggcgagucucgcaaaacauuuguggaacuuaugcggagaggagaccugccuguuuggcucgcccacaagguggcuuccgagggcaucaaauacaccgaucgcaaguggugcuucgacgggcagcggaacaaucagauccuggaagagaacauggaugucgagauuuggacaaaagaaggagagaagaagaaacugagaccccgcuggcucgacgcccggacguauagcgauccgcuugcucugaaggaauuuaaagacuucgccgccggcagaaagucuaucgcucuggaucucgugaccgagauugggcgcgucccuucccaccuggcgcauagaacacggaaugcccuugacaaccuggugaugcuccacaccagcgaacauggaggcaaggcuuaccgccacgccguugaggagcugcccgaaacaauggagacccugcuccuucugggccugaugauccuccugacagggggagccaugcuuuuucugauuuccggcaaggggaucggaaagaccucuaucggccucauuugugugaucgcuagcuccgggaugcuguggauggccgaaauuccucugcaauggaucgcgagcgccauugugcucgaguucuuuaugaugguccuucugauccccgagccugaaaaacagagaacaccccaggauaaucaacuggcuuauguugugauuggaauccucacccuggccgcuaucauugccgcgaacgagaugggccuucuggaaacaaccaagcgggaccucggcaugucuaaagagccggggguggucuccccuacgagcuaccuggauguggaccugcaccccgccucugcuuggacacucuacgccguugcuaccacagugaucacccccaugcuucgccauaccauugaaaauagcacagccaacgucucccuggcugccaucgcgaaccaggccgugguccugaugggacucgacaagggcuggccuauuucuaaaauggaucugggggugccgcuucuggcucucggaugcuauagccagguuaauccccugacgcugaccgccgcugugcuccuucugaucacacacuacgccaucauuggcccugggcugcaggccaaggcgaccagagaggcucaaaagcggacagccgcuggaaucaugaaaaaccccaccgucgacggcauuaugacgaucgaucucgacccugugauuuaugauuccaaguucgagaaacagcugggccagguuaugcuucuggugcucugugccguccagcugcugcucaugagaacaucuugggcccuuugcgaagcucugacccuggccaccgggcccaucacaacccucugggagggaagcccuggcaaguuuuggaauacaacgaucgcgguguccauggccaacauuuuccgcgggagcuaccuggcuggagccggccuugcuuuuucuaucaugaaauccguggggaccggaaagcggggcacaggcagccaaggggaaacccugggagagaaguggaaaaagaaacucaaucagcuguccagaaaggaguucgaccuguauaaaaagucuggcauuacagagguugaucgcaccgaggccaaagaagggcucaagcggggagagaucacgcaucacgcggucagcagaggcuccgccaaacuucagugguuuguggaacggaacauggugauuccggaggggcgcgucaucgaccugggauguggcagaggcggguggucuuacuauugcgcuggacugaaaaagguuaccgaagugcggggcuacacaaaagggggacccggccaugaggagccugugcccaugagcaccuacggguggaauauugucaagcucauguccggaaaagauguguucuaucugccucccgaaaagugugacacacuucugugcgauaucggcgagagcucuccguccccuaccguugaagagagccgcacaaucagagugcucaagauggucgagcccuggcugaaaaacaaucaguucuguauuaaggugcugaaccccuacaugccuaccguuaucgaacaccucgagcggcuucaacgcaaacacggcgggaugcuggugagaaauccccugucucggaacuccacgcaugaaauguauuggauuagcaauggaacaggcaacaucgucgccucugugaauauggugagccgccuccugcuuaacagauuuaccaugacccaccggagaccuacaauugagaaggacgucgaucugggggcuggaacgcgccauguuaacgccgaaccggagacccccaauauggacgugaucggcgagcggaucaaaagaauuaaggaagaacacaacuccacauggcacuacgacgaugaaaauccuuauaagaccugggcuuaccaugggucuuaugaggugaaagccacaggaagcgcguccagcaugaucaacggcgucgugaagcuccugaccaaacccugggacguugugccuauggucacacagauggccaugaccgauacgacccccuucggccagcaacgcguguuuaaggaaaaaguugacacacggaccccgagauccaugccugggacacgccgggugaugggaauuaccgcugaguggcuguggagaacgcucggccgcaauaagaagccccggcugugcacaagagaggaguucaccaaaaagguccgcacaaacgccgcuaugggggccguguuuaccgaggaaaaucagugggauucugccaaagcggcuguugaggacgaagauuucuggauccuuguggaccgggagagagagcugcacaagcucggaaaauguggcagcugcgucuacaacaugauggggaagcgcgagaaaaagcugggcgaguuuggaaaggccaaaggcuccagagccauuugguacauguggcuuggggcucgguaucuggaguucgaggcccucggauuucugaaugaggaucauugguucucucgcgaaaacagcuacuccggcguggagggggaaggacugcacaagcucggcuauauccugagagacaucucuaaaauuccugggggcgcuauguacgccgaugacacggcgggaugggacacccggaucacagaggaugaccuucauaaugaagagaagauuacccagcagauggaucccgagcacagacaacuggccaacgcuaucuuuaaacucacauaucagaauaaggucgugaagguucagcggccuacccccacaggcaccgugauggacauuaucagccgcaaagaucagagaggguccggacaagucggcacguacgggcugaacacauucaccaauauggaagcccagcuuauccggcagauggagggagaaggcgugcugagcaaggcugaccucgagaacccgcaucugccugagaaaaagauuacccaguggcuggagacaaaagggguggagcgccucaagagaauggccaucucuggcgaugacugcguugugaagcccauugaugaccgguuugcgaacgcccugcuugcucugaaugauaugggaaaaguccgcaaggacaucccccaauggcagccuuccaaaggcuggcaugauuggcaacaggugccguucuguagccaccauuuccacgaacucauuaugaaggacgggagaaaacugguugugcccugccggccucaagacgagcuuaucggacgcgccagaauuucucagggcgcuggguggucccugcgggaaaccgccugucucggaaaggcuuaugcccagauguggagccugauguacuuucaccgcagagaucugcggcucgcgucuaacgccaucugcuccgcuguccccgugcauugggucccuacaagccgcacgaccugguccauccacgcccaucaccaauggaugacaaccgaggacaugcugacaguguggaauagaguuuggauugaagauaaccccuggauggaggacaagaccccugugacgaccugggagaauguccccuaccuuggcaaacgggaagaucaguggugugggagccugaucggccucacaucuagagccaccugggcucagaacauuccgacagccauccagcaagugcgcagccugauuggaaaugaggaguuccuugacuauaugccuuccaugaagcgguuuagaaaagaggaggaaucugagggcgcgaucugguga

SEQ ID NO: 20728 - RNA, 9873 nt, Artificial Sequence
  derived and/or modified CDS sequence (opt5) from DENV-3__FJ547076__SS-prME
accagccugugccucaugaugauccugcccgccgcucuugccuuccaccugacgucccgggacggagaaccucggaugauuguggggaagaacgaacgcggaaagucucuccuguuuaagacggcgagcggcaucaauauguguacccuuauugcuauggaucugggggaaaugugcgacgauacagucaccuacaaguguccgcacaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccgugucugaaaaggaggagaauaugguuaaaucccuggugagcgcuggaucuggcaaggucgacaacuucaccaugggggugcugugccucgccauccuguuugaagagguuaugcggggaaaguucggcaaaaagcauaugauugccggcguguucuuuacauucguccuucugcucagcgggcagaucaccuggcgcgauauggcucacacacugauuaugaucggauccaaugccagcgacagaaugggcaugggggugaccuaccuggcgcuuauugcuacguuuaaaauccagcccuuccuggcccucggauuuuuccugcggaagcucacaucuagagaaaaccugcuucugggcguggggcucgccauggcuaccacacugcaacugccugaggauaucgaacagauggccaauggaauugcucuuggccugauggcccucaaacugaucacccaguuugagaccuaucagcucuggacagcgcugauuucccuuacguguagcaacaccaucuucacacugaccgucgccuggcgcacagcuacccucauucuggccggcguuucccugcuuccggugugccaaucuagcuccaugcggaagacggacuggcugcccaugacaguggcugccaugggggucccuccccucccucuguuuaucuucucucucaaggauacccugaaaagacgcagcuggccccuuaaugagggagugauggccguuggccugguguccauccuggcuucuagccuccugagaaacgacgucccuauggcggggccccuuguggccggaggccugcucauugcuuguuacguuaucaccgggacauccgccgaucugaccguggaaaaggccgcugacgucacaugggaggaagaggccgaacagacgggagugagccauaaccucaugauuaccgucgacgaugacggcacaaugcggaucaaagaugacgagaccgagaauauucugacagugcuucugaagaccgcgcugcucaucguuucuggcaucuuuccguacuccauuccugcuacgcugcuuguguggcacaccuggcagaaacagacacaacgcagcgggguccugugggaugugcccucuccucccgaaacccagaaggccgagcucgaagagggaguuuauagaaucaaacagcagggcauuuucgggaagacacaagugggagucggcgugcagaaggaggggguguuucauaccauguggcacguuacacggggagccguccugacguacaacggcaaacgccucgaaccgaauugggcuuccgugaagaaagaccugaucagcuauggcgggggauggagacuuucugcccaguggcaaaagggcgaggaagugcaggucauugcgguggagccugggaaaaaccccaagaauuuccagaccaugccuggaacauuccagaccaccacaggcgaaaucggggcuauugcccuggauuuuaagcccggaacguccggcagccccaucaucaaccgggagggcaaaguuguggggcuguacggaaauggcgucgugaccaagaacgggggauauguuuccggcauugcccaaacaaaugcugagccugacgggccgacccccgaacucgaggaagagauguucaaaaagcgcaaccugacaaucauggaucuucacccuggcagcggaaaaaccagaaaguaccugcccgccauugugcgggaagcuaucaagcgcagacuccggacgcugauucucgccccuacaagagucguggcggccgagauggaggaagcucugaaaggccuucccauccgcuaucagaccaccgccacaaagucugagcauaccgggcgggaaaucguugaccugaugugccacgcuacauuuaccaugagacugcucagcccugugcgcgucccgaauuacaaccugauuaucauggaugaggcccauuucacggaccccgccuccauugcugcgcggggauacaucucuacaagagugggcaugggggaagccgcugccauuuuuaugaccgccacaccucccggaaccgcugaugccuucccucagagcaaugcgcccauccaggacgaggagcgcgacaucccggaacgguccuggaacucuggcaaugaguggauuacggauuuugcugggaaaaccgugugguucgucccuagcaucaaggccggcaacgacauugccaacugucuucgcaaaaauggaaagaagguuauccaacuguccagaaaaacauuugauaccgaauaucagaagacaaaacucaacgacugggauuucguggugaccacagacauuucugagaugggcgcuaauuuuaaggccgaucgggucaucgaccccagacggugccugaaacccgugauucugaccgaugggccugagcgcguuauccucgcgggacccaugccugugacggccgcuagcgccgcucagagacggggccgcgucgggagaaacccgcagaaggaaaaugaccaauacaucuucacaggacagccccuuaacaaugaugaggaccacgcccauuggaccgaagcuaagaugcugcuggacaacauuaauaccccugagggcaucauucccgcccucuucgaaccugagcgggagaaauccgcggccaucgauggggaauauagacugaagggcgagagccgcaaaacauuuguggaacuuaugcggagaggagaccugcccguuuggcucgcucacaagguggccucugagggcauuaaauacaccgaucgcaaguggugcuucgacgggcagcggaacaaucagauccuggaagagaacauggaugucgagaucuggacaaaagaaggagagaagaagaaacugagaccgcgcuggcucgacgcucggacguauuccgauccucuugcccugaaggaauuuaaagacuucgccgcuggcagaaagagcauugcgcuggaucucgugaccgagaucgggcgcguccccucucaccuggcccauagaacacggaaugcucuugacaaccuggugaugcuccacaccuccgaacauggaggcaaagccuaccgccacgccguugaggagcugccugaaacaauggagacccugcuccuucugggccugaugauucuccugacagggggagcuaugcuuuuucugaucagcggcaaggggauuggaaagaccuccaucggccucaucugugugauugccucuagcgggaugcuguggauggcggaaaucccccugcaauggauugccuccgcuaucgugcucgaguucuuuaugaugguccuucugauuccugagcccgaaaaacagagaacaccgcaggauaaucaacuggccuauguugugaucggcauucucacccuggcugccaucaucgcggccaacgagaugggccuucuggaaacaaccaagcgggaccucggcaugagcaaagagccugggguggucucucccacguccuaccuggauguggaccugcaccccgcuagcgccuggacacucuacgcuguugccaccacagugauuaccccuaugcuucgccauaccaucgaaaauucuacagcuaacgucagccuggccgcgauugccaaccaggcugugguccugaugggacucgacaagggcuggccgaucuccaaaauggaucugggggugccccuucuggcccucggaugcuauucucagguuaauccucugacgcugaccgcugccgugcuccuucugauuacacacuacgccaucaucggccccgggcugcaggcgaaggcuaccagagaggcccaaaagcggacagcugccggaauuaugaaaaacccuaccgucgacggcaucaugacgauugaucucgaccccgugaucuaugauagcaaguucgagaaacagcugggccagguuaugcuucuggugcucugugccguccagcugcugcucaugagaacauccugggcucuuugcgaagcccugacccuggcgaccgggccuauuacaacccucugggagggaucuccgggcaaguuuuggaauacaacgaucgccgugagcauggcuaacaucuuccgcggguccuaccuggccggagcuggccuugccuuuagcauuaugaaaucuguggggaccggaaagcggggcacaggcucccaaggggaaacccugggagagaaguggaaaaagaaacucaaucagcugagcagaaaggaguucgaccuguauaaaaaguccggcaucacagagguugaucgcaccgaggcgaaagaagggcucaagcggggagagauuacgcaucacgccgucucuagaggcagcgcuaaacuucagugguuuguggaacggaacauggugauccccgaggggcgcgucauugaccugggauguggcagaggcgggugguccuacuauugcgccggacugaaaaagguuaccgaagugcggggcuacacaaaagggggaccuggccaugaggagcccgugccuaugucuaccuacggguggaauaucgucaagcucaugagcggaaaagauguguucuaucugcccccggaaaagugugacacacuucugugcgauauuggcgaguccagcccuucucccaccguugaagagucccgcacaaucagagugcucaagauggucgagcccuggcugaaaaacaaucaguucuguaucaaggugcugaacccuuacaugcccaccguuauugaacaccucgagcggcuucaacgcaaacacggcgggaugcuggugagaaauccucugagccggaacucuacgcaugaaauguauuggaucuccaauggaacaggcaacauugucgcuagcgugaauauggugucucgccuccugcuuaacagauuuaccaugacccaccggagaccgacaaucgagaaggacgucgaucugggggccggaacgcgccauguuaacgcugaacccgagaccccuaauauggacgugauuggcgagcggaucaaaagaaucaaggaagaacacaacagcacauggcacuacgacgaugaaaaucccuauaagaccugggccuaccauggguccuaugaggugaaagcgacaggaucugccagcuccaugauuaacggcgucgugaagcuccugaccaaaccuugggacguugugcccauggucacacagauggcuaugaccgauacgaccccguucggccagcaacgcguguuuaaggaaaaaguugacacacggaccccuagaagcaugcccgggacacgccgggugaugggaaucaccgccgaguggcuguggagaacgcucggccgcaauaagaagccucggcugugcacaagagaggaguucaccaaaaagguccgcacaaacgcugccaugggggccguguuuaccgaggaaaaucagugggauuccgcgaaagcugccguugaggacgaagauuucuggaaacuuguggaccgggagagagagcugcacaaacucggaaaguguggcucuugcgucuacaacaugauggggaaacgcgaaaagaagcugggcgaguuuggaaaagccaagggcagcagagcuauuugguacauguggcuuggggcccgguaucuggaguucgaggcucucggauuucugaaugaggaucauugguucucccgcgaaaacucuuacagcggcguggagggggaaggacugcacaaacucggcuauauccugagagacauuuccaagauccccgggggcgccauguacgcggaugacacggccggaugggacacccggaucacagaggaugaccuucauaaugaagagaaaauuacccagcagauggauccugagcacagacaacuggcuaacgccaucuuuaagcucacauaucagaauaaggucgugaaaguucagcggcccaccccgacaggcaccgugauggacauuaucucucgcaaggaucagagagggagcggacaagucggcacguacgggcugaacacauucaccaauauggaagcucagcuuauucggcagauggagggagaaggcgugcuguccaaagccgaccucgagaacccucaucugcccgaaaagaaaaucacccaguggcuggagacaaaggggguggagcgccucaagagaauggcgaucagcggcgaugacugcguugugaaacccauugaugaccgguuugccaacgcucugcuugcccugaaugauaugggaaagguccgcaaagacaucccucaauggcagccgucuaagggcuggcaugauuggcaacaggugcccuucuguucccaccauuuccacgaacucauuaugaaagacgggagaaagcugguugugccuugccggccccaagacgagcuuaucggacgcgcuagaauuagccagggcgccggguggucucugcgggaaaccgcuugucucggaaaggccuaugcgcagauguggucccugauguacuuucaccgcagagaucugcggcucgccagcaacgcuaucugcucugccgucccugugcauuggguccccacaucccgcacgaccuggagcauucacgcccaucaccaauggaugacaaccgaggacaugcugacaguguggaauagaguuuggaucgaagauaacccuuggauggaggacaaaacccccgugacgaccugggagaaugucccguaccuuggcaagcgggaagaucaguggugugggucccugaucggccucacaagcagagcuaccugggcccagaacauuccuacagcgauccagcaagugcgcucucugauuggaaaugaggaguuccuugacuauaugcccagcaugaaacgguuuagaaaggaggaggaauccgagggcgcuaucugguga

SEQ ID NO: 20729 - RNA, 9873 nt, Artificial Sequence
  derived and/or modified CDS sequence (opt5) from DENV-3__FJ547077__SS-prME
acaagccugugccucaugaugauccugcccgcggcucuugccuuccaccugacgucccgggacggcgaaccucggaugauuguggggaagaacgaacgcggaaagucucuccuguuuaagacggcgagcggcaucaauauguguacccuuauugcuauggaucugggggaaaugugcgacgauacagugaccuacaaauguccgcacaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggccaagaucgugaccgcugaaacacaaaacuccagcuucauuaucgauggaccuaauacccccgagugcccgucugcguccagagccuggaacgucugggaaguggaggacuauggcuuuggcguguucacaaccaauaucuggcucaaacugcgcgaagucuacacgcagcugugugaccaccggcuuaugagcgcugccguuaaggaugagagagccgugcacgcugacaugggguacuggauugagucccagaaaaacggaucuuggaagcucgaaaaagccagccugaucgaggugaagacaugcaccuggccuaagucccauacccuguggucuaauggcguccucgaaagcgauaugauuauccccaaaucccuggcggggccuauuagccagcacaacuaucgccccggauaccauacacaaaccgcuggcccuuggcaccuugggaagcuggagcucgacuuuaauuauugcgagggaacgacagugguuaucaccgaaaacuguggcacacggggccccucucugagaaccacaaccguguccgggaaacugauccacgaguggugcugucgcagcugcacgcuuccgccucuccgguacaugggagaagauggcuguugguaugggauggagauuagacccaucucugaaaaggaggagaauauggucaaaucccuggugagcgccggaucuggcaagguugacaacuucaccaugggggugcugugccucgccauucuguuugaagaggucaugcggggaaaguucggcaaaaagcauaugaucgcuggcguguucuuuacauucguucuucugcucagcgggcagauuaccuggcgcgauauggcccacacacugaucaugauuggauccaaugcgagcgacagaaugggcaugggggugaccuaccuggcucuuaucgccacguuuaaaauccagcccuuccuggcccucggauuuuuccugcggaagcucacaucuagagaaaaccugcuucugggcgucgggcucgcuauggccaccacacugcaacugccugaggauauugaacagauggcuaauggaaucgcccuuggccugauggcgcucaaacugauuacccaguuugagaccuaucagcucuggacagcccugaucucccuuacguguagcaacaccauuuucacacugaccguggcuuggcgcacagccacccucauccuggcuggcgugucccugcuuccggucugccaaucuagcuccaugcggaagacggacuggcugcccaugacaguugccgccaugggggugccuccccucccucuguuuaucuucucucucaaggauacccugaaaagacgcagcuggccccuuaaugagggagugauggcugucggccugguguccauucuggcgucuagccuccugagaaacgacguuccuauggccgggccccuuguggcuggaggccugcucaucgccuguuacgucauuaccgggacauccgccgaucugaccguggaaaaggcugccgacguuacaugggaggaagaggcggaacagacgggagugagccauaaccucaugaucaccgucgacgaugacggcacaaugcggauuaaagaugacgagaccgagaauauccugacagugcuucugaagaccgcucugcucaucgucucuggcauuuuuccguacuccaucccugccacgcugcuuguguggcacaccuggcagaaacagacacaacgcagcgggguucugugggaugugcccucuccucccgaaacccagaaggccgagcucgaagagggagucuauagaauuaaacagcagggcaucuucgggaagacacaagugggaguuggcgugcagaaggagggggucuuucauaccauguggcacgugacacggggagcugugcugacguacaacggcaaacgccucgaaccgaauugggccuccguuaagaaagaccugauuagcuauggcgggggauggagacuuucugcgcaguggcaaaagggcgaggaaguccaggugaucgcuguggagccugggaaaaaccccaagaauuuccagaccaugccuggaacauuccagaccaccacaggcgaaauuggggccaucgcccuggauuuuaagcccggaacguccggcagccccaucauuaaccgggagggcaaagucguggggcuguacggaaauggcguugugaccaagaacgggggauaugucuccggcaucgcucaaacaaaugccgagccugacgggccgacccccgaacucgaggaagagauguucaaaaagcgcaaccugacaauuauggaucuucacccuggcagcggaaaaaccagaaaguaccugcccgcuaucgugcgggaagccauuaagcgcagacuccggacgcugauccucgcgccuacaagaguuguggccgcugagauggaggaagcccugaaaggccuucccauccgcuaucagaccaccgcuacaaagucugagcauaccgggcgggaaauugucgaccugaugugccacgccacauuuaccaugagacugcucagcccugugcgcguuccgaauuacaaccugaucauuauggaugaggcccauuucacggaccccgcuuccaucgcggcccggggauacauuucuacaagagugggcaugggggaagcugccgccaucuuuaugaccgcuacaccucccggaaccgccgaugcguucccucagagcaaugcucccauccaggacgaggagcgcgacauuccggaacgguccuggaacucuggcaaugaguggaucacggauuuugccgggaaaaccgucugguucgugccuagcauuaaggccggcaacgacaucgcuaacugucuucgcaaaaauggaaagaaggugauucaacuguccagaaaaacauuugauaccgaauaucagaagacaaaacucaacgacugggauuucgucguuaccacagacaucucugagaugggcgccaauuuuaaggcggaucgggugauugaccccagacggugccugaaacccgugauccugaccgaugggccugagcgcgucauccucgccggacccaugccugugacggcugccagcgcugcccagagacggggccgcguugggagaaacccgcagaaggaaaaugaccaauacauuuucacaggacagccccuuaacaaugaugaggaccacgcucauuggaccgaagccaagaugcugcuggacaacaucaauaccccugagggcauuauccccgcccucuucgaaccugagcgggagaaauccgccgcuauugauggggaauauagacugaagggcgagagccgcaaaacauuuguggaacuuaugcggagaggagaccugcccgucuggcucgcccacaagguggcuucugagggcaucaaauacaccgaucgcaaguggugcuucgacgggcagcggaacaaucagauccuggaagagaacauggauguugagauuuggacaaaagaaggagagaagaagaaacugagaccgcgcuggcucgacgcccggacguauuccgauccucuugcccugaaggaauuuaaagacuucgcugcgggcagaaagagcaucgcccuggaucucgugaccgagauugggcgcguccccucucaccuggcucauagaacacggaaugcccuugacaaccuggugaugcuccacaccuccgaacauggaggcaaagccuaccgccacgcugucgaggagcugccugaaacaauggagacccugcuccuucugggccugaugauccuccugacagggggagccaugcuuuuucugauuagcggcaaggggaucggaaagaccuccaucggccucauuugugugaucgcgucuagcgggaugcuguggauggccgaaauuccccugcaauggaucgcuuccgccauuguucucgaguucuuuaugauggugcuucugaucccugagcccgaaaaacagagaacaccgcaggauaaucaacuggcuuauguggucauuggaauccucacccuggccgcgacaaucgccgcuaacgagaugggccuucuggaaaccacgaagcgggaccucggcaugagcaaagagccugggguugugucucccacauccuaccuggauguggaccugcaccccgccagcgcuuggacccucuacgccgucgcuacaaccgugauuaccccuaugcuucgccauacaaucgaaaauucuacggccaacguuagccuggcggccauugcuaaccaggccgugguccugaugggacucgacaagggcuggccgaucuccaaaauggaucugggggugccccuucuggcucucggaugcuauucucaggucaauccucugacccugacagccgccgugcuccuucugauuacccacuacgcgaucaucggccccgggcugcaggcuaaggccacaagagaggcucaaaagcggaccgccgccggaauuaugaaaaacccuacgguugacggcaucaugacaauugaucucgaccccgugaucuaugauagcaaguucgagaaacagcugggccaggucaugcuucuggugcucugugcuguucagcugcugcucaugagaaccuccugggcccuuugcgaagcgcugacccuggccacagggccuauuaccacacucugggagggaucuccgggcaaguuuuggaauacgaccaucgcugugagcauggccaacaucuuccgcggguccuaccuggcuggagccggccuugcguuuagcauuaugaaaucugucgggacaggaaagcggggcaccggcucccaaggggaaacacugggagagaaguggaaaaagaaacucaaucagcugagcagaaaggaguucgaccuguauaaaaaguccggcaucaccgagguggaucgcacggaggccaaagaagggcucaagcggggagagauuacccaucacgcugugucuagaggcagcgccaaacuucagugguuuguugaacggaacauggucauccccgaggggcgcgugauugaccugggauguggcagaggcgggugguccuacuauugcgcuggacugaaaaaggugacagaaguccggggcuacaccaaagggggaccuggccaugaggagcccguuccuaugucuacauacggguggaauaucgugaagcucaugagcggaaaagauguguucuaucugcccccggaaaagugugacacccuucugugcgauauuggcgaguccagcccuucucccacagucgaagagucccgcaccaucagagugcucaagaugguugagcccuggcugaaaaacaaucaguucuguaucaaggugcugaacccuuacaugcccacggucauugaacaccucgagcggcuucaacgcaaacacggcgggaugcuggugagaaauccucugagccggaacucuacacaugaaauguauuggaucuccaauggaaccggcaacauuguugccagcgugaauauggucucucgccuccugcuuaacagauuuaccaugacacaccggagaccgacgaucgagaaggacguggaucugggggcuggaacccgccaugugaacgccgaacccgagacaccuaauauggacgucauuggcgagcggaucaaaagaaucaaggaagaacacaacagcaccuggcacuacgacgaugaaaaucccuauaagacaugggcguaccauggguccuaugagguuaaagccaccggaucugcuagcuccaugauuaacggcguggugaagcuccugacaaaaccuugggacgucgugcccaugguuacccagauggccaugacggauaccacaccguucggccagcaacgcguguuuaaggaaaaagucgacacccggacaccuagaagcaugcccgggacccgccgggugaugggaaucacggcugaguggcuguggagaacacucggccgcaauaagaagccucggcugugcaccagagaggaguucaccaagaagguucgcaccaacgccgccaugggggcgguguuuacggaggaaaaucagugggauuccgcuaaagccgccgucgaggacgaagauuucuggaaacuuguggaccgggagagagagcugcacaaacucggaaaguguggcucuugcguuuacaacaugauggggaaacgcgaaaagaagcugggcgaguuuggaaaagcuaagggcagcagagccauuugguacauguggcuuggggcucgguaucuggaguucgaggcccucggauuucugaaugaggaucauugguucucccgcgaaaacucuuacagcggcguggagggggaaggacugcacaaacucggcuauauccugagagacauuuccaagauccccgggggcgcgauguacgccgaugacaccgcuggaugggacacacggaucaccgaggaugaccuucauaaugaagagaaaauuacacagcagauggauccugagcacagacaacuggccaacgcuaucuuuaagcucaccuaucagaauaaggucgugaaaguccagcggcccacaccgaccggcacggugauggacauuaucucucgcaaggaucagagagggagcggacaaguuggcacauacgggcugaacaccuucaccaauauggaagcccagcuuauucggcagauggagggagaaggcgugcuguccaaagcggaccucgagaacccucaucugcccgaaaagaaaaucacacaguggcuggagaccaagggggucgagcgccucaagagaauggccaucagcggcgaugacugcguggugaaacccauugaugaccgguuugcuaacgcccugcuugcucugaaugauaugggaaagguucgcaaagacaucccucaauggcagccgucuaagggcuggcaugauuggcaacaggugcccuucuguucccaccauuuccacgaacucauuaugaaagacgggagaaagcuggucgugccuugccggccccaagacgagcuuaucggacgcgccagaauuagccagggcgcuggguggucucugcgggaaacagccugucucggaaaggcguaugcccagauguggaaccugauguacuuucaccgcagagaucugcggcucgcuuccaaugccaucugcagcgccguuccugugcauuggguccccacgucucgcaccacaugguccauucacgcucaucaccaauggaugaccacagaggacaugcugaccguguggaacagagucuggaucgaagauaauccuuggauggaggacaaaacgcccgugaccacaugggagaacguuccguaccuuggcaagcgggaagaucaguggugugggagccugaucggccucaccuccagagccacaugggcgcagaauauuccuaccgcuauccagcaagugcgcagccugauuggaaacgaggaguuccuugacuauaugcccucuaugaaacgguuuagaaaggaggaggaaagcgagggcgccaucugguga

SEQ ID NO: 20730 - RNA, 9873 nt, Artificial Sequence
  derived and/or modified CDS sequence (opt5) from DENV-3__FJ547078__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcacaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggauugauguggugcuggagcacggcgggugcgucaccacaauggccaagaauaaacccacgcuggacaucgagcuccagaagaccgaagcuacacagcuggccacccuucgcaaacuguguauugagggaaagaucacaaacauuaccacggauuccagaugcccuacacagggcgaagcgguucucccggaggaacaggaccagaauuauguguguaaacacaccuacguggaucggggcugggggaacggaugcggccuguucgggaagggaagccuugugaccugcgccaaguuucaaugucuggagcccaucgagggcaaagugguucaguaugaaaaucucaaguacacagugaucauuaccguccauacaggggaccagcaccaggugggaaacgagacgcaaggcguuaccgcugaaaucacaccucaggccucuaccacagaggcuauucugcccgaauauggcacccuggggcucgagugcuccccucgcacgggacuggacuucaaugagaugauccuucugaccaugaaaaacaaggccuggauggugcauagacagugguuuuucgaucucccccugccguggacaagcggcgccaccacagaaaccccuacguggaaucggaaagagcuucuggucacauuuaagaacgcucacgcgaaaaagcaagaaguggucgugcucgggucucaggagggagccaugcacaccgcucugacaggcgccaccgaaauucaaaauuccgggggcaccagcaucuucgccggacaucugaagugucgccucaaaauggacaagcuggagcuuaaaggcaugucuuacgcuaugugcacaaacacguuuguucugaagaaagagguguccgaaacccagcacgggacaauccucauuaaggucgaguacaagggagaagaugugcccuguaaaaucccuuucagcaccgaggacggccaagggaaggcccauaacggaagacugauuacagcgaaucccguugugaccaaaaaggaggaacccgucaacaucgaggcugaaccuccguucggcgaguccaauauugugaucgggaucggcgauaacgcccugaaaauuaauugguauaagaagggaucuagcaucggcaaaauguuugaagccacggcuagaggggccagacgcauggcuauucuuggagacacagccugggauuucggcuccgucgggggaguucucaacagccugggcaagaugguccaccagaucuuugggucugcguacaccgcccuguucuccggcgugagcugggugaugaaaauuggaaucggcguccuccugaccuggauugggcuuaauucuaagaacacaagcauguccuuuucuugcaucgcuaucggaauuaucacccuguaucucggcgccgugguucaggcugacauggggugugugauuaauuggaaaggaaaggagcugaagugcggcagcgggaucuucgucacaaacgaggugcauacguggaccgaacaguacaaauuucaagccgauucccccaagcggcuggcgacagccauugcuggcgccugggagaauggaguuuguggcaucagaagcaccacacgcauggaaaaccuucucuggaaacagaucgcuaaugagcugaacuauauucugugggaaaauaacaucaagcucaccguggucgugggggacauuaucggaguucuggagcagggcaaacggacgcuuaccccucagcccauggagcugaaguacucuuggaaaacaugggggaaggccaagauugugaccgccgaaacacaaaacuccagcuucaucaucgauggaccuaauacccccgagugcccgucugcuuccagagcguggaacgucugggaaguggaggacuauggcuuuggcguguucacaaccaauauuuggcucaaacugcgcgaagucuacacgcagcugugugaccaccggcuuaugagcgccgcuguuaaggaugagagagccgugcacgccgacaugggguacuggaucgagucccagaaaaacggaucuuggaagcucgaaaaagcuagccugauugaggugaagacaugcaccuggccuaagucccauacccuguggucuaauggcguccucgaaagcgauaugaucauucccaaaucccuggccgggccuaucagccagcacaacuaucgccccggauaccauacacaaaccgcgggcccuuggcaccuugggaagcuggagcucgacuuuaauuauugcgagggaacgacagugguuaucaccgaaaacuguggcacacggggccccucucugagaaccacaaccguguccgggaaacugauucacgaguggugcugucgcagcugcacgcuuccgccucuccgguacaugggagaagauggcuguugguaugggauggagaucagacccauuucugaaaaggaggagaauauggucaaaucccuggugagcgcuggaucuggcaagguugacaacuucaccaugggggugcugugccucgccauccuguuugaagaggucaugcggggaaaguucggcaaaaagcauaugauugccggcguguucuuuacauucguucuucugcucagcgggcagaucaccuggcgcgauauggcucacacacugauuaugaucggauccaaugccagcgacagaaugggcaugggggugaccuaccuggcgcuuaucgcuacguuuaaaauucagcccuuccuggcccucggauuuuuccugcggaagcucacaucuagagaaaaccugcuucugggcgucgggcucgccauggcuaccacacugcaacugccugaggauaucgaacagauggccaauggaauugcucuuggccugauggcccucaaacugaucacccaguuugagauuuaucagcucuggaccgcgcugaucucccuuacauguagcaacacgaucuucacccugacaguggccuggcgcaccgcuacacucauucuggccggcgugucccugcuuccggucugccaaucuagcuccaugcggaagaccgacuggcugcccaugacgguugcugccaugggggugccuccccucccucuguuuaucuucucucucaaggauacacugaaaagacgcagcuggccccuuaaugagggagugauggccgucggccugguguccauucuggcuucuagccuccugagaaacgacguuccuauggcggggccccuuguggccggaggccugcucaucgcuuguuacgucauuaccgggaccuccgccgaucugacaguggaaaaggccgcugacguuaccugggaggaagaggccgaacagacaggagugagccauaaccucaugaucacggucgacgaugacggcaccaugcggaucaaagaugacgagacagagaauauucugaccgugcuucugaagacagcgcugcucaucgucucuggcauuuuuccguacuccaucccugcuacccugcuuguguggcacacguggcagaaacagacccaacgcagcgggguucugugggaugugcccucuccucccgaaacacagaaggccgagcucgaagagggagucuauagaauuaaacagcagggcaucuucgggaagacccaagugggaguuggcgugcagaaggagggggucuuucauacaauguggcacgugacccggggagccgugcugacauacaacggcaaacgccucgaaccgaauugggcuuccguuaagaaagaccugauuagcuauggcgggggauggagacuuucugcccaguggcaaaagggcgaggaaguccaggugaucgcgguggagccugggaaaaaccccaagaauuuccagacgaugccuggaaccuuccagacaaccaccggcgaaaucggggcuauugcccuggauuuuaagcccggaacauccggcagccccaucauuaaccgggagggcaaagucguggggcuguacggaaauggcguugugacgaagaacgggggauaugucuccggcaucgcccaaaccaaugcugagccugacgggccgacacccgaacucgaggaagagauguucaaaaagcgcaaccugaccauuauggaucuucacccuggcagcggaaaaacaagaaaguaccugcccgccaucgugcgggaagcuaucaagcgcagacuccggacccugauucucgccccuacgagaguuguggcggccgagauggaggaagcucugaaaggccuucccauccgcuaucagacaaccgccaccaagucugagcauacagggcgggaaauugucgaccugaugugccacgcuaccuuuacaaugagacugcucagcccugugcgcguuccgaauuacaaccugaucauuauggaugaggcccauuucaccgaccccgccuccaucgcugcgcggggauacaucucuacgagagugggcaugggggaagccgcugccauuuuuaugacagccaccccucccggaacagcugaugccuucccucagagcaaugcgcccauccaggacgaggagcgcgacauuccggaacgguccuggaacucuggcaaugaguggaucaccgauuuugcugggaaaacggucugguucgugccuagcauuaaggccggcaacgacaucgccaacugucuucgcaaaaauggaaagaaggugauucaacuguccagaaaaaccuuugauacagaauaucagaagaccaaacucaacgacugggauuucgucguuacaaccgacaucucugagaugggcgcuaauuuuaaggccgaucgggugaucgaccccagacggugccugaaacccgugauucugacagaugggccugagcgcgucauccucgcgggacccaugccugugaccgccgcuagcgccgcucagagacggggccgcguugggagaaacccgcagaaggaaaaugaccaauacauuuucacgggacagccccuuaacaaugaugaggaccacgcccauuggacagaagcuaagaugcugcuggacaacaucaauaccccugagggcauuauccccgcccucuucgaaccugagcgggagaaauccgcggccaucgauggggaauauagacugaagggcgagagccgcaaaaccuuuguggaacuuaugcggagaggagaccugcccgucuggcucgcucacaagguggccucugagggcauuaaauacacagaucgcaaguggugcuucgacgggcagcggaacaaucagauccuggaagagaacauggauguugagauuuggaccaaagaaggagagaagaagaaacugagaccgcgcuggcucgacgcucggacauauuccgauccucuugcccugaaggaauuuaaagacuucgccgcuggcagaaagagcaucgcgcuggaucucgugacggagauugggcgcguccccucucaccuggcccauagaacccggaaugcucuugacaaccuggugaugcuccacacauccgaacauggaggcaaagccuaccgccacgccgucgaggagcugccugaaaccauggagacacugcuccuucugggccugaugauccuccugaccgggggagcuaugcuuuuucugaucagcggcaaggggauuggaaagacguccaucggccucauuugugugaucgccucuagcgggaugcuguggauggcggaaauuccccugcaauggaucgccuccgcuauuguucucgaguucuuuaugauggugcuucugaucccugagcccgaaaaacagagaaccccgcaggauaaucaacuggccuauguggucaucggcauucucacacuggcugccaucauugcggccaacgagaugggccuucuggaaaccacaaagcgggaccucggcaugagcaaagagccugggguugugucucccaccuccuaccuggauguggaccugcaccccgcuagcgccuggacgcucuacgcugucgccacaaccgugaucacaccuaugcuucgccauaccauugaaaauucuaccgcuaacguuagccuggccgcgaucgccaaccaggcugugguccugaugggacucgacaagggcuggccgaucuccaaaauggaucugggggugccccuucuggcccucggaugcuauucucaggucaauccucugacacugacggcugccgugcuccuucugauuacccacuacgccaucauuggccccgggcugcaggcgaaggcuacaagagaggcccaaaagcggaccgcugccggaaucaugaaaaacccuacaguugacggcauuaugaccaucgaucucgaccccgugaucuaugauagcaaguucgagaaacagcugggccaggucaugcuucuggugcucugugccguucagcugcugcucaugagaacguccugggcucuuugcgaagcccugacacuggcgaccgggccuauuaccacacucugggagggaucuccgggcaaguuuuggaauaccacaaucgccgugagcauggcuaacauuuuccgcggguccuaccuggccggagcuggccuugccuuuagcaucaugaaaucugucgggacgggaaagcggggcaccggcucccaaggggaaacacugggagagaaguggaaaaagaaacucaaucagcugagcagaaaggaguucgaccuguauaaaaaguccggcauuaccgagguggaucgcacagaggcgaaagaagggcucaagcggggagagaucacccaucacgccgugucuagaggcagcgcuaaacuucagugguuuguugaacggaacauggucauucccgaggggcgcgugaucgaccugggauguggcagaggcgggugguccuacuauugcgccggacugaaaaaggugacggaaguccggggcuacaccaaagggggaccuggccaugaggagcccguuccuaugucuacauacggguggaauaucgugaagcucaugagcggaaaagauguguucuaucugcccccggaaaagugugacacccuucugugcgauauuggcgaguccagcccuucucccacagucgaagagucccgcaccaucagagugcucaagaugguugagcccuggcugaaaaacaaucaguucuguauuaaggugcugaacccuuacaugcccacagucaucgaacaccucgagcggcuucaacgcaaacacggcgggaugcuggugagaaauccucugagccggaacucuacccaugaaauguauuggauuuccaauggaacgggcaacaucguugcuagcgugaauauggucucucgccuccugcuuaacagauuuacaaugacccaccggagaccgaccaucgagaaggacguggaucugggggccggaacacgccaugugaacgcugaacccgagacgccuaauauggacgucauuggcgagcggaucaaaagaauuaaggaagaacacaacagcaccuggcacuacgacgaugaaaaucccuauaagacaugggccuaccauggguccuaugagguuaaagcgaccggaucugccagcuccaugaucaacggcguggugaagcuccugacaaaaccuugggacgucgugcccaugguuacccagauggcuaugacagauaccacgccguucggccagcaacgcguguuuaaggaaaaagucgacacccggacaccuaagagcaugcccgggaccagacgcgugaugggaauuacagccgaguggcuguggcggacccucggcagaaauaagaaaccucgccugugcacgcgggaggaguucacaaagaaaguuagaaccaacgcugccaugggggccguguuuacagaggaaaaucagugggauuccgcgaaggcugccgucgaggacgaagauuucuggaaacuuguggaccgcgagcgggagcugcacaagcucggaaaauguggcucuugcguuuacaacaugauggggaagagagaaaagaaacugggcgaguuuggaaaggccaaaggcagccgcgcuaucugguacauguggcuuggggccagauaucuggaguucgaggcucucggauuucugaaugaggaucauugguucucccgggaaaacucuuacagcggcguggagggggaaggacugcacaagcucggcuauauccugcgcgacauuuccaaaauccccgggggcgccauguacgcggaugacaccgccggaugggacacgagaauuaccgaggaugaccuucauaaugaagagaagaucacacagcagauggauccugagcaccggcaacuggcuaacgccauuuuuaagcucaccuaucagaauaaagucgugaagguccagagacccacaccgaccggcacagugauggacaucaucucucggaaagaucagcgcgggagcggacaaguuggcaccuacgggcugaacacguucacaaauauggaagcucagcuuauuagacagauggagggagaaggcgugcuguccaaggccgaccucgagaacccucaucugcccgagaagaagaucacccaguggcuggagaccaagggggucgagcggcucaaacgcauggcgauuagcggcgaugacugcguggugaagcccaucgaugacagauuugccaacgcucugcuugcccugaaugauaugggaaaaguucggaaggacauuccucaauggcagccgucuaaaggcuggcaugauuggcaacaggugcccuucuguucccaccauuuccacgaacucaucaugaaggacgggcgcaagcuggucgugccuugcagaccccaagacgagcuuauuggacgggcucgcaucagccagggcgccggguggucucugagagaaacagcuugucucggaaaagccuaugcgcagauguggucccugauguacuuucaccggcgcgaucugagacucgccagcaacgcuaucugcucugccguuccugugcauuggguccccaccucccggacaacguggagcauucacgcccaucaccaauggaugaccacagaggacaugcugaccguguggaaucgcgucuggaucgaagauaacccuuggauggaggacaagacacccgugaccacgugggagaauguuccguaccuuggcaaaagagaagaucaguggugugggucccugauuggccucaccagccgggcuacaugggcccagaacaucccuaccgcgauucagcaagugagaucucugaucggaaaugaggaguuccuugacuauaugcccagcaugaagcgcuuucggaaagaggaggaauccgagggcgcuaucugguga

SEQ ID NO: 20731 - RNA, 9873 nt, Artificial Sequence
  derived and/or modified CDS sequence (opt5) from DENV-3__FJ547079__SS-prME
accagccugugccucaugaugauccugcccgccgcucuugccuuccaccugacgucccgggacggcgaaccucggaugauuguggggaagaacgaacgcggaaagucucuccuguuuaagacggcgagcggcaucaauauguguacccuuauugcuauggaucugggggaaaugugcgacgauacagucaccuacaaguguccgcauaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaaaauccagcccuuccuggcccucggauuuuuccugcggaagcucacaucuagagaaaaccugcuucugggcguggggcucgccauggcuaccacacugcaacugccugaggauauugaacagauggccaauggaaucgcucuuggccugauggcccucaaacugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaagacggacuggcugcccaugacaguggcugccaugggggugccuccccucccucuguuuaucuucucucucaaggauacccugaaaagacgcagcuggccccuuaaugagggagucauggccgugggccugguuuccauucuggcuucuagccuccugagaaacgacgugccuauggcggggccccuugucgccggaggccugcucaucgcuuguuacgugauuaccgggacauccgccgaucugaccguugaaaaggccgcugacgugacaugggaggaagaggccgaacagacgggagucagccauaaccucaugaucaccguggacgaugacggcacaaugcggauuaaagaugacgagaccgagaauauccugacaguccuucugaagaccgcgcugcucaucgugucuggcauuuuuccguacuccaucccugcuacgcugcuuguuuggcacaccuggcauaaacagacacagcgcagcggggugcugugggauguccccucuccucccgaaacccaaaaggccgagcucgaagagggaguguauagaauuaaacagcagggcaucuucgggaagacacagguuggagugggcguccaaaaggaggggguguuucacaccauguggcacgugacacggggagccguucugacguacaacggcaaacgccucgaaccgaauugggcuuccgucaagaaagaccugauuagcuauggcgggggauggagacuuucugcccaguggcagaagggcgaggaagugcaagugaucgcggucgagccugggaaaaaccccaagaauuuccagaccaugccuggaacauuccagaccaccacaggcgaaauuggggcuaucgcccuggauuuuaagcccggaacguccggcagccccaucauuaaccgggagggcaaagugguugggcuguacggaaauggcguggucaccaagaacgggggauauguguccggcaucgcccagacaaaugcugagccugacgggccgacccccgaacucgaggaagagauguucaaaaagcgcaaccugacaauuauggaucuucauccuggcagcggaaaaaccagaaaguaccugcccgccaucguucgggaagcuauuaagcgcagacuccggacgcugauccucgccccuacaagaguggucgcggccgagauggaggaagcucugaaaggccuucccauccgcuaucaaaccaccgccacaaagucugagcacaccgggcgggaaauuguggaccugaugugccaugcuacauuuaccaugagacugcucagcccuguucgcgugccgaauuacaaccugaucauuauggaugaggcccacuucacggaccccgccuccaucgcugcgcggggauacauuucuacaagagucggcaugggggaagccgcugccaucuuuaugaccgccacaccucccggaaccgcugaugccuucccucagagcaaugcgcccauccaggacgaggagcgcgacauuccggaacgguccuggaacucuggcaaugaguggaucacggauuuugcugggaaaaccgugugguucgugccuagcauuaaggccggcaacgacaucgccaacugucuucgcaaaaauggaaagaaggucauucagcuguccagaaaaacauuugauaccgaauaucaaaagacaaaacucaacgacugggauuucguugugaccacagacaucucugagaugggcgcuaauuuuaaggccgaucgggugauugaccccagacggugccugaaacccgucauccugaccgaugggccugagcgcgugauccucgcgggacccaugccuguuacggccgcuagcgccgcucagagacggggccgcguggggagaaacccgcagaaggaaaaugaccaguacauuuucacaggacaaccccuuaacaaugaugaggaccaugcccacuggaccgaagcuaagaugcugcuggacaacaucaauaccccugagggcauuauccccgcccucuucgaaccugagcgggagaaauccgcggccauugauggggaauauagacugaagggcgagagccgcaaaacauuugucgaacuuaugcggagaggagaccugcccguguggcucgcucacaagguugccucugagggcaucaaauacaccgaucgcaaguggugcuucgacgggcagcggaacaaucagauccuggaagagaacauggauguggagauuuggacaaaagaaggagagaagaagaaacugagaccgcgcuggcucgacgcucggacguauuccgauccucuugcccugaaggaauuuaaagacuucgccgcuggcagaaagagcaucgcgcuggaucucgucaccgagauugggcgcgugcccucucaucuggcccacagaacacggaaugcucuugacaaccuggucaugcuccauaccuccgaacacggaggcaaagccuaccgccacgccguggaggagcugccugaaacaauggagacccugcuccuucugggccugaugauccuccugacagggggagcuaugcuuuuucugauuagcggcaaggggaucggaaagaccuccaucggccucauuuguguuaucgccucuagcgggaugcuguggauggcggaaauuccccugcaguggaucgccuccgcuauugugcucgaguucuuuaugauggugcuucugaucccugagcccgaaaaacaaagaacaccgcaggauaaucagcuggccuaugucguuauuggaauccucacccuggcugccaucauugcggccaacgagaugggccuucuggaaacaaccaagcgggaccucggcaugagcaaagagccugggguggugucucccacguccuaccuggaugucgaccugcaucccgcuagcgccuggacacucuacgcuguggccaccacaguuaucaccccuaugcuucgccacaccauugaaaauucuacagcuaacgugagccuggccgcgaucgccaaccaagcugucgugcugaugggacucgacaagggcuggccgauuuccaaaauggaucugggggucccccuucuggcccucggaugcuauucucaggugaauccucugacgcugaccgcugccguucuccuucugaucacacauuacgccaucauuggccccgggcugcaggcgaaggcuaccagagaggcccagaagcggacagcugccggaaucaugaaaaacccuaccguggacggcauuaugacgaucgaucucgaccccgucauuuaugauagcaaguucgagaaacaacugggccaggugaugcuucugguucucugugccgugcagcugcugcucaugagaacauccugggcucuuugcgaagcccugacccuggcgaccgggccuaucacaacccucugggagggaucuccgggcaaguuuuggaauacaacgaucgccgucagcauggcuaacauuuuccgcggguccuaccuggccggagcuggccuugccuuuagcaucaugaaaucuguggggaccggaaagcggggcacaggcucccagggggaaacccugggagagaaguggaaaaagaaacucaaucaacugagcagaaaggaguucgaccuguauaaaaaguccggcauuacagagguggaucgcaccgaggcgaaagaagggcucaagcggggagagaucacgcaccaugccguuucuagaggcagcgcuaaacuucagugguuugucgaacggaacauggugauucccgaggggcgcgugaucgaccugggauguggcagaggcgggugguccuacuauugcgccggacugaaaaaggucaccgaaguucggggcuacacaaaagggggaccuggccacgaggagcccgugccuaugucuaccuacggguggaauauugugaagcucaugagcggaaaagaugucuucuaucugcccccggaaaagugugacacacuucugugcgauaucggcgaguccagcccuucucccaccguggaagagucccgcacaaucagaguucucaagaugguggagcccuggcugaaaaacaaucaguucuguauuaagguccugaacccuuacaugcccaccgugaucgaacaccucgagcggcuucagcgcaaacauggcgggaugcugguuagaaauccucugagccggaacucuacgcacgaaauguauuggauuuccaauggaacaggcaacaucguggcuagcgucaauauggugucucgccuccugcuuaacagauuuaccaugacccaucggagaccgacaauugagaaggacguggaucugggggccggaacgcgccacgucaacgcugaacccgagaccccuaauauggacguuaucggcgagcggaucaaaagaauuaaggaagaacacaacagcacauggcauuacgacgaugaaaaucccuauaagaccugggccuaccacggguccuaugaggugaaagcgacaggaucugccagcuccaugaucaacggcguggucaagcuccugaccaaaccuugggacgugguucccauggugacacaaauggcuaugaccgauacgaccccguucggccagcagcgcgucuuuaaggaaaaaguggacacacggaccccuagaagcaugcccgggacacgccggguuaugggaauuaccgccgaguggcuguggagaacgcucggccgcaauaagaagccucggcugugcacaagagaggaguucaccaaaaaggugcgcacaaacgcugccaugggggccgucuuuaccgaggaaaaucaaugggauuccgcgaaagcugccguggaggacgaagauuucuggaaacuuguugaccgggagagagagcugcauaaacucggaaaguguggcucuugcguguacaacaugauggggaaacgcgaaaagaagcugggcgaguuuggaaaagccaagggcagcagagcuaucugguacauguggcuuggggcccgguaucuggaguucgaggcucucggauuucugaaugaggaucacugguucucccgcgaaaacucuuacagcggcgucgagggggaaggacugcauaaacucggcuauauucugagagacaucuccaagauccccgggggcgccauguacgcggaugacacggccggaugggacacccggauuacagaggaugaccuucacaaugaagagaaaaucacccagcagauggauccugagcacagacagcuggcuaacgccauuuuuaagcucacauaucaaaauaagguggucaaagugcagcggcccaccccgacaggcaccguuauggacaucauuucucgcaaggaucagagagggagcggacaggugggcacguacgggcugaacacauucaccaauauggaagcucaacuuauccggcagauggagggagaaggcguccuguccaaagccgaccucgagaacccucaucugcccgaaaagaaaaucacccaguggcuggagacaaaggggguggagcgccucaagagaauggcgauuagcggcgaugacugcgugguuaaacccaucgaugaccgguuugccaacgcucugcuugcccugaaugauaugggaaaggugcgcaaagacauuccucaguggcaaccgucuaagggcuggcacgauuggcagcagguccccuucuguucccaucacuuccacgaacucaucaugaaagacgggagaaagcuggugguuccuugccggccccaggacgagcuuauuggacgcgcuagaaucagccaaggcgccggguggucucugcgggaaaccgcuugucucggaaaggccuaugcgcagauguggucccugauguacuuucaucgcagagaucugcggcucgccagcaacgcuauuugcucugccgugccuguccacugggugcccacaucccgcacgaccuggagcauccaugcccaccaucaguggaugacaaccgaggacaugcugacagucuggaauagaguguggaucgaagauaacccuuggauggaggacaaaacccccguuacgaccugggagaaugugccguaccuuggcaagcgggaagaucaauggugugggucccugauuggccucacaagcagagcuaccugggcccagaacaucccuacagcgauucagcagguccgcucucugaucggaaaugaggaguuccuugacuauaugcccagcaugaaacgguuuagaaaggaggaggaauccgagggcgcuauuugguga

SEQ ID NO: 20732 - RNA, 9873 nt, Artificial Sequence
  derived and/or modified CDS sequence (opt5) from DENV-3__FJ547080__SS-prME
accagccugugccucaugaugauccugcccgccgcucuugccuuccaccugacgucccgggacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucagugucuggagcccauugagggcaaaguugugcagcaugaaaaucucaaguauacagucaucaucaccgugcacacaggggaccagcaucagguuggaaacgagacgcaaggcgugaccgcugaaauuacaccucaggccucuaccacagaggcuauccugcccgaauacggcacccuggggcucgagugcuccccucgcacgggacuggacuucaaugagaugauucuucugaccaugaaaaacaaggccuggaugguccacagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcauaccgcucugacaggcgccaccgaaauccaaaauuccgggggcaccagcauuuucgccggacaccugaagugucgccucaaaauggacaagcuggagcuuaaaggcaugucuuaugcuaugugcacaaacacguuugugcugaagaaagaggucuccgaaacccagcaugggacaauccucaucaagguggaguacaagggagaagauguucccuguaaaauuccuuucagcaccgaggacggccaagggaaggcccacaacggaagacugaucacagcgaaucccguggucaccaaaaaggaggaacccgugaacauugaggcugaaccuccguucggcgaguccaauaucgugauugggaucggcgauaacgcccugaaaaucaauugguacaagaagggaucuagcauuggcaaaauguuugaagccacggcuagaggggccagacgcauggcuauccuuggagacacagccugggauuucggcuccguugggggaguccucaacagccugggcaagauggugcaucagauuuuugggucugcguauaccgcccuguucuccggcgugagcugggucaugaaaaucggaauuggcgugcuccugaccuggaucgggcuuaauucuaagaacacaagcauguccuuuucuugcauuguuaucggaaucauuacccuguaccucggcgcugugguccaggccgacauggggugugugaucaauuggaaaggaaaggagcugaagugcggcagcgggauuuucguuacaaacgaggugcacacguggaccgaacaguauaaauuucaagcugauucccccaagcggcuggccacagcgaucgccggcgcuugggagaauggagucuguggcauuagaagcaccacacgcauggaaaaccuucucuggaaacagaucgccaaugagcugaacuacauccugugggaaaauaacauuaagcucaccgugguugugggggacaucauuggaguccuggagcagggcaaacggacgcuuaccccucagcccauggagcugaaguauucuuggaaaacaugggggaaggcuaagaucgugaccgccgaaacacaaaacuccagcuucauuaucgauggaccuaauacccccgagugcccgucugccuccagagcuuggaacgugugggaagucgaggacuacggcuuuggcguuuucacaaccaauaucuggcucaaacugcgcgaaguguauacgcagcugugugaccaccggcuuaugagcgcggccgugaaggaugagagagcuguccaugccgacaugggguacuggauugagucccagaaaaacggaucuuggaagcucgaaaaagccagccugaucgaggugaagacaugcaccuggccuaagucccacacccuguggucuaauggcguucucgaaagcgauaugauuauccccaaaucccuggcugggccuauuagccagcauaacuaccgccccggauaucacacacaaaccgccggcccuuggcaccuugggaagcuggagcucgacuuuaauuacugcgagggaacgacaguggucaucaccgaaaacuguggcacacggggccccucucugagaaccacaaccguguccgggaaacugauccaugaguggugcugucgcagcugcacgcuuccgccucuccgguauaugggagaagauggcuguugguacgggauggagauuagacccaucucugaaaaggaggagaauaugguuaaaucccuggugagcgcgggaucuggcaaggucgacaacuucaccaugggggugcugugccucgcuauucuguuugaagagguuaugcggggaaaguucggcaaaaagcacaugaucgccggcguguucuuuacauucguccuucugcucagcgggcagauuaccuggcgcgauauggcccauacacugaucaugauuggauccaaugcuagcgacagaaugggcaugggggugaccuaucuggcccuuaucgcgacguuuaaaauccagcccuuccuggcucucggauuuuuccugcggaagcucacaucuagagaaaaccugcuucugggcguggggcucgccauggccaccacacugcaacugccugaggauauugaacagauggcuaauggaaucgcccuuggccugauggcucucaaacugauuacccaguuugagaccuaccagcucuggacagcccugaucucccuuacguguagcaacaccauuuucacacugaccgucgcguggcgcacagccacccucauccuggcuggcguuucccugcuuccggugugccaaucuagcuccaugcggaagacggacuggcugcccaugacaguggccgcuaugggggucccuccccucccucuguuuaucuucucucucaaggauacccugaaaagacgcagcuggccccuuaaugagggagugauggccguuggccugguguccauucuggccucuagccuccugagaaacgacgucccuauggcugggccccuuguggcgggaggccugcucaucgccuguuauguuauuaccgggacauccgcugaucugaccguggaaaaggccgccgacgucacaugggaggaagaggcugaacagacgggagugagccacaaccucaugaucaccgucgacgaugacggcacaaugcggauuaaagaugacgagaccgagaauauccugacagugcuucugaagaccgcccugcucaucguuucuggcauuuuuccguacuccaucccugcgacgcugcuuguguggcauaccuggcagaaacagacacaacgcagcgggguccugugggaugugcccucuccucccgaaacccagaaggcugagcucgaagagggaguuuacagaauuaaacagcagggcaucuucgggaagacacaagugggagucggcgugcagaaggaggggguguuucacaccauguggcacguuacacggggagccguccugacguauaacggcaaacgccucgaaccgaauugggccuccgugaagaaagaccugauuagcuacggcgggggauggagacuuucugcucaguggcaaaagggcgaggaagugcaggucaucgccguggagccugggaaaaaccccaagaauuuccagaccaugccuggaacauuccagaccaccacaggcgaaauuggggcgaucgcucuggauuuuaagcccggaacguccggcagccccaucauuaaccgggagggcaaaguuguggggcuguauggaaauggcgucgugaccaagaacgggggauacguuuccggcaucgcccaaacaaaugccgagccugacgggccgacccccgaacucgaggaagagauguucaaaaagcgcaaccugacaauuauggaucuucauccuggcagcggaaaaaccagaaaguaucugcccgcuaucgugcgggaagccauuaagcgcagacuccggacgcugauccucgcuccuacaagagucguggccgcggagauggaggaagcccugaaaggccuucccauccgcuaccagaccaccgcuacaaagucugagcacaccgggcgggaaauuguugaccugaugugccaugccacauuuaccaugagacugcucagcccugugcgcgucccgaauuauaaccugaucauuauggaugaggcucacuucacggaccccgccuccaucgccgcucggggauacauuucuacaagagugggcaugggggaagcggccgcuaucuuuaugaccgccacaccucccggaaccgccgaugcuuucccucagagcaaugcccccauccaggacgaggagcgcgacauuccggaacgguccuggaacucuggcaaugaguggaucacggauuuugcggggaaaaccgugugguucgucccuagcauuaaggcuggcaacgacaucgccaacugucuucgcaaaaauggaaagaagguuauucaacuguccagaaaaacauuugauaccgaauaccagaagacaaaacucaacgacugggauuucguggugaccacagacaucucugagaugggcgccaauuuuaaggcugaucgggucauugaccccagacggugccugaaacccgugauccugaccgaugggccugagcgcguuauccucgccggacccaugccugugacggcggccagcgcugcccagagacggggccgcgucgggagaaacccgcggaaggaaaaugaccaguauauuuucacaggacaaccccuuaacaaugaugaggaccaugcucacuggaccgaagccaagaugcugcuggacaacaucaauaccccugagggcauuauccccgcucucuucgaaccugagagagagaaauccgccgcgauugauggggaauaccgccugaagggcgagagccggaaaacauuuguggaacuuaugagacgcggagaccugcccguuuggcucgcccacaagguggcuucugagggcaucaaauauaccgaucggaaguggugcuucgacgggcagagaaacaaucagauccuggaagagaacauggaugucgagauuuggacaaaagaaggagagaagaagaaacugcgcccgcgguggcucgacgccagaacguacuccgauccucuugcucugaaggaauuuaaagacuucgccgccggccgcaagagcaucgcucuggaucucgugaccgagauugggagaguccccucucaucuggcgcaccggacacgcaaugcccuugacaaccuggugaugcuccauaccuccgaacacggaggcaaggcuuauagacacgccguugaggagcugccugaaacaauggagacccugcuccuucugggccugaugauccuccugacagggggagccaugcuuuuucugauuagcggcaaggggaucggaaagaccuccaucggccucauuugugugaucgcuucuagcgggaugcuguggauggccgaaauuccccugcaguggaucgcguccgccauugugcucgaguucuuuaugaugguccuucugaucccugagcccgaaaaacaacggacaccgcaggauaaucagcuggcuuacguugugauuggaauccucacccuggccgcuaucauugccgcgaacgagaugggccuucuggaaacaaccaagcgcgaccucggcaugagcaaagagccugggguggucucucccacguccuaucuggauguggaccugcaucccgccagcgcuuggacacucuacgccguugcuaccacagugaucaccccuaugcuuagacacaccauugaaaauucuacagccaacgucagccuggcugccaucgcgaaccaagccgugguccugaugggacucgacaagggcuggccgauuuccaaaauggaucugggggugccccuucuggcucucggaugcuacucucagguuaauccucugacgcugaccgccgcugugcuccuucugaucacacauuaugccaucauuggccccgggcugcaggccaaggcgacccgggaggcucagaagagaacagccgcuggaaucaugaaaaacccuaccgucgacggcauuaugacgaucgaucucgaccccgugauuuacgauagcaaguucgagaaacaacugggccagguuaugcuucuggugcucugugccguccagcugcugcucaugcgcacauccugggcccuuugcgaagcucugacccuggccaccgggccuaucacaacccucugggagggaucuccgggcaaguuuuggaauacaacgaucgcggugagcauggccaacauuuuccggggguccuaucuggcuggagccggccuugcuuuuagcaucaugaaaucuguggggaccggaaagagaggcacaggcucccagggggaaacccugggagagaaguggaaaaagaaacucaaucaacugagccgcaaggaguucgaccuguacaaaaaguccggcauuacagagguugaucggaccgaggccaaagaagggcucaagagaggagagaucacgcaccaugcggucucucggggcagcgccaaacuucagugguuuguggaacgcaacauggugauucccgaggggagagucaucgaccugggauguggccggggcgggugguccuauuacugcgcuggacugaaaaagguuaccgaagugcgcggcuauacaaaagggggaccuggccacgaggagcccgugccuaugucuaccuacggguggaauauugucaagcucaugagcggaaaagauguguucuaccugcccccggaaaagugugacacacuucugugcgauaucggcgaguccagcccuucucccaccguugaagaguccagaacaauccgggugcucaagauggucgagcccuggcugaaaaacaaucaguucuguauuaaggugcugaacccuuauaugcccaccguuaucgaacaccucgagcgccuucagagaaaacauggcgggaugcuggugcggaauccucugagccgcaacucuacgcacgaaauguacuggauuuccaauggaacaggcaacaucgucgccagcgugaauauggugucuagacuccugcuuaaccgguuuaccaugacccauagacgcccgacaauugagaaggacgucgaucugggggcuggaacgcggcacguuaacgccgaacccgagaccccuaauauggacgugaucggcgagagaaucaaacgcauuaaggaagaacacaacagcacauggcauuaugacgaugaaaaucccuacaagaccugggcuuaucacggguccuacgaggugaaagccacaggaucugcgagcuccaugaucaacggcgucgugaagcuccugaccaaaccuugggacguugugcccauggucacacaaauggccaugaccgauacgaccccguucggccagcagcggguguuuaaggaaaaaguugacacaagaaccccucgcagcaugcccgggacacggagagugaugggaauuaccgcugaguggcuguggcgcacgcucggccggaauaagaagccuagacugugcacacgcgaggaguucaccaaaaagguccggacaaacgccgcuaugggggccguguuuaccgaggaaaaucaaugggauuccgccaaagcggcuguugaggacgaagauuucuggauccuuguggacagagagcgcgagcugcauaagcucggaaaauguggcucuugcgucuauaacaugauggggaagagagagaaaaagcugggcgaguuuggaaaggccaaaggcagccgggccauuugguacauguggcuuggggcucgcuaccuggaguucgaggcccucggauuucugaaugaggaucacugguucuccagagaaaacucuuauagcggcguggagggggaaggacugcauaagcucggcuacauccugcgggacaucuccaaaauucccgggggcgcuauguaugccgaugacacggcgggaugggacaccagaaucacagaggaugaccuucacaaugaagagaagauuacccagcagauggauccugagcaccggcagcuggccaacgcuaucuuuaaacucacauaccaaaauaaggucgugaagguucagcgccccaccccgacaggcaccgugauggacauuaucucuagaaaagaucagcgggggagcggacaggucggcacguaugggcugaacacauucaccaauauggaagcccaacuuauccgccagauggagggagaaggcgugcuguccaaggcugaccucgagaacccucaucugcccgagaaaaagauuacccaguggcuggagacaaaagggguggagagacucaagcggauggccaucagcggcgaugacugcguugugaagcccauugaugaccgcuuugcgaacgcccugcuugcucugaaugauaugggaaaagucagaaaggacaucccucaguggcaaccgucuaaaggcuggcacgauuggcaacaggugcccuucuguucccaucacuuccacgaacucauuaugaaggacgggcggaaacugguugugccuugccgcccccaggacgagcuuaucggacgggcccggauuagccaaggcgcuggguggucucugcgcgaaaccgccugucucggaaaggcuuacgcccagauguggucccugauguauuuucauagacgggaucugcgccucgcgagcaacgccaucugcucugcugucccugugcacuggguccccacauccagaacgaccuggagcauccaugcccaccaucaguggaugacaaccgaggacaugcugacaguguggaaucggguuuggauugaagauaacccuuggauggaggacaagacccccgugacgaccugggagaaugucccguaccuuggcaaaagagaagaucaauggugugggucccugaucggccucacaagccgcgccaccugggcucagaacauuccuacagccauccaacaggugcggucucugauuggaaaugaggaguuccuugacuacaugcccagcaugaagagauuucgcaaagaggaggaauccgagggcgcgaucugguga

SEQ ID NO: 20733 - RNA, 9873 nt, Artificial Sequence
  derived and/or modified CDS sequence (opt5) from DENV-3__FJ547081__SS-prME
accagccugugccucaugaugauccugcccgccgcucuugccuuccaccugacgucccgggacggcgaaccucggaugauuguggggaagaacgaacgcggaaagucucuccuguuuaagacggcgagcggcaucaauauguguacccuuauugcuauggaucugggggaaaugugcgacgauacagugaccuacaaauguccgcacaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucucuggacaucugaagugucgccucaaaauggacaagcuggagcuuaaaggcauguccuacgccaugugcacaaacacguuugugcugaagaaagaggucagcgaaacccagcacgggacaauccucaucaagguggaguacaagggagaagauguucccuguaaaauuccuuucuccaccgaggacggccaagggaaggcucauaacggaagacugaucacagccaaucccguggucaccaaaaaggaggaacccgugaacauugaggcggaaccuccguucggcgagucuaauaucgugauugggaucggcgauaacgcucugaaaaucaauugguauaagaagggaagcuccauuggcaaaauguuugaagccacggccagaggggcuagacgcauggccauccuuggagacacagcuugggauuucggcagcguugggggaguccucaacucucugggcaagauggugcaccagauuuuuggguccgccuacaccgcgcuguucagcggcgugucuugggucaugaaaaucggaauuggcgugcuccugaccuggaucgggcuuaauagcaagaacacauccaugucuuuuagcugcauugccaucggaaucauuacccuguaucucggcgcuguugugcaggccgacauggggugugucaucaauuggaaaggaaaggagcugaagugcggcuccgggauuuucgugacaaacgagguucauacguggaccgaacaguacaaauuucaagcugauagccccaagcggcuggccacagcgaucgccggcgcuugggagaauggaguguguggcauuagaucuaccacacgcauggaaaaccuucucuggaaacagaucgccaaugagcugaacuauauccugugggaaaauaacauuaagcucaccgucgugguuggggacaucauuggagugcuggagcagggcaaacggacgcuuaccccucagcccauggagcugaaguacuccuggaaaacaugggggaaggcuaagaucgucaccgccgaaacacaaaacagcucuuucauuaucgauggaccuaauacccccgagugcccguccgccagcagagcuuggaacgugugggaaguggaggacuauggcuuuggcgucuucacaaccaauaucuggcucaaacugcgcgaaguuuacacgcagcugugugaccaccggcuuauguccgcggccgugaaggaugagagagcugugcacgccgacaugggguacuggauugagucucagaaaaacggaagcuggaagcucgaaaaagccucccugaucgaggucaagacaugcaccuggccuaagucucauacccuguggagcaauggcgugcucgaauccgauaugauuauccccaaaagccuggcugggccuauuucucagcacaacuaucgccccggauaccauacacaaaccgccggcccuuggcaccuugggaagcuggagcucgacuuuaauuauugcgagggaacgacaguugugaucaccgaaaacuguggcacacggggccccucccugagaaccacaaccgucagcgggaaacugauccacgaguggugcugucgcucuugcacgcuuccgccucuccgguacaugggagaagauggcuguugguaugggauggagauuagacccaucuccgaaaaggaggagaauauggugaaaagccugguuucugcgggaagcggcaagguggacaacuucaccauggggguccugugccucgcuauucuguuugaagaggugaugcggggaaaguucggcaaaaagcauaugaucgccggcguuuucuuuacauucgugcuucugcucuccgggcagauuaccuggcgcgauauggcccacacacugaucaugauuggaagcaaugcuucugacagaaugggcaugggggucaccuaccuggcccuuaucgcgacguuuaaaauccagcccuuccuggcucucggauuuuuccugcggaagcucacauccagagaaaaccugcuucugggcguggggcucgccauggccaccacacugcaacugccugaggauauugaacagauggcuaauggaaucgcccuuggccugaugacccucaaacugauuacccaguuugagacauaucagcucuggacggcucugaucagccuuaccuguuccaacacaauuuucacccugacaguggccuggcgcaccgcgacgcucauccuggccggcgucucucugcuuccgguuugccaaagcuccucuaugcggaagacagacuggcugcccaugaccguggcugccaugggggugccuccccucccucuguuuaucuucagccucaaggauacccugaaaagacgcuccuggccccuuaaugagggagucauggcugugggccugguuucuauucuggccagcucccuccugagaaacgacgugccuauggccgggccccuugucgcuggaggccugcucaucgcguguuacgugauuacagggaccagcgccgaucugacaguugaaaaggcugccgacgugacgugggaggaagaggccgaacagaccggagucucucauaaccucaugaucacaguggacgaugacggcaccaugcggauuaaagaugacgagacagagaauauccugaccguccuucugaagacggcucugcucaucguguccggcauuuuuccguacagcaucccugccacccugcuuguuuggcacacauggcagaaacagacccaacgcucuggggugcugugggauguccccuccccucccgaaacacagaaggcggagcucgaagagggaguguauagaauuaaacagcagggcaucuucgggaagacccaaguuggagugggcguccagaaggaggggguguuucauacaauguggcacgugacgcggggagcuguucugaccuacaacggcaaacgccucgaaccgaauugggccagcgucaagaaagaccugauuucuuauggcgggggauggagacuuuccgcccaguggcaaaagggcgaggaaguccaggugaucgcugucgagccugggaaaaaccccaagaauuuccagacaaugccuggaaccuuccagaccacaacgggcgaaauuggggccaucgcgcuggauuuuaagcccggaaccagcggcucccccaucauuaaccgggagggcaaagugguugggcuguacggaaauggcguggucacaaagaacgggggauaugugagcggcaucgcucaaaccaaugccgagccugacgggccgacacccgaacucgaggaagagauguucaaaaagcgcaaccugaccauuauggaucuucacccuggcucuggaaaaacgagaaaguaccugcccgccaucguucgggaagcuauuaagcgcagacuccggacacugauccucgccccuaccagaguggucgcugccgagauggaggaagcgcugaaaggccuucccauccgcuaucagaccacagccaccaagagcgagcauacagggcgggaaauuguggaccugaugugccacgcuaccuuuacgaugagacugcucuccccuguucgcgugccgaauuacaaccugaucauuauggaugaggcccauuucacagaccccgcuucuaucgccgcccggggauacauuagcaccagagucggcaugggggaagcugcggccaucuuuaugacagcuaccccucccggaacggccgaugccuucccucaguccaaugcucccauccaggacgaggagcgcgacauuccggaacggucuuggaacagcggcaaugaguggaucaccgauuuugccgggaaaacagugugguucgugccuuccauuaaggcgggcaacgacaucgcuaacugucuucgcaaaaauggaaagaaggucauucaacugucuagaaaaaccuuugauacagaauaucagaagaccaaacucaacgacugggauuucguugugacaaccgacaucagcgagaugggcgccaauuuuaaggccgaucgggugauugaccccagacggugccugaaacccgucauccugacggaugggccugagcgcgugauccucgcuggacccaugccuguuacagccgcguccgccgcucagagacggggccgcguggggagaaacccgcagaaggaaaaugaccaauacauuuucaccggacagccccuuaacaaugaugaggaccacgcccauuggaccgaagcuaagaugcugcuggacaacaucaauacaccugagggcauuauccccgcccucuucgaaccugagcgggagaaaagcgcugccauugauggggaauauagacugaagggcgagucucgcaaaaccuuugucgaacuuaugcggagaggagaccugcccguguggcucgcgcacaagguugccuccgagggcaucaaauacgcugaucgcaaguggugcuucgacgggcagcggaacaaucagauccuggaagagaacauggauguggagauuuggacaaaagaaggagagaagaagaaacugagaccgcgcuggcucgacgcccggacguauagcgauccucuugcucugaaggaauuuaaagacuucgccgccggcagaaagucuaucgcucuggaucucgucaccgagauugggcgcgugcccucccaccuggcgcauagaacacggaaugcccuugacaaccuggucaugcuccacaccagcgaacauggaggcaaggcuuaccgccacgccguggaggagcugccugaaacaauggagacccugcuccuucugggccugaugauccuccugacagggggagccaugcuuuuucugauuuccggcaaggggaucggaaagaccucuaucggccucauuuguguuaucgcuagcuccgggaugcuguggauggccgaaauuccccugcaauggaucgcgagcgccauugugcucgaguucuuuaugauggugcuucugaucccugagcccgaaaaacagagaacaccgcaggauaaucaacuggcuuaugucguuauuggaauccucacccuggccgcuaucauugccgcgaacgagaugggccuucuggaaacaaccaagcgggaccucggcaugucuaaagagccuggggugguguccagcacgucuuaccuggaugucgaccugcaccccgccagcgcuuggacacucuacgccguggcuaccacaguuaucacccccaugcuucgccauaccauugaaaauuccacagccaacgugucucuggcugccaucgcgaaccaggccgucgugcugaugggacucgacaagggcuggccuauuagcaaaauggaucugggggucccgcuucuggcucucggaugcuauucccaggugaauccccugacgcugaccgccgcuguucuccuucugaucacacacuacgccaucauuggcccugggcugcaggccaaggcgaccagagaggcucaaaagcggacagccgcuggaaucaugaaaaaccccaccguggacggcauuaugacgaucgaucucgacccugucauuuaugauucuaaguucgagaaacagcugggccaggugaugcuucugguucucugugccgugcagcugcugcucaugagaacaagcugggcccuuugcgaagcucugacccuggccaccgggcccaucacaacccucugggagggauccccuggcaaguuuuggaauacaacgaucgcggucagcauggccaacauuuuccgcgggucuuaccuggcuggagccggccuugcuuuuuccaucaugaaaagcguggggaccggaaagcggggcacaggcucccaaggggaaacccugggagagaaguggaaaaagaaacucaaucagcugucuagaaaggaguucgaccuguauaaaaagagcggcauuacagagguggaucgcaccgaggccaaagaagggcucaagcggggagagaucacgcaucacgcgguuuccagaggcucugccaaacuucagugguuugucgaacggaacauggugauuccggaggggcgcgugaucgaccugggauguggcagaggcggguggagcuacuauugcgcuggacugaaaaaggucaccgaaguucggggcuacacaaaagggggacccggccaugaggagccugugcccauguccaccuacggguggaauauugugaagcucaugagcggaaaagaugucuucuaucugccucccgaaaagugugacacacuucugugcgauaucggcgagucuuccccgagcccuaccguggaagagucucgcacaaucagaguucucaagaugguggagcccuggcugaaaaacaaucaguucuguauuaagguccugaaccccuacaugccuaccgugaucgaacaccucgagcggcuucaacgcaaacacggcgggaugcugguuagaaauccccugucccggaacagcacgcaugaaauguauuggauuucuaauggaacaggcaacaucguggccagcgucaauauggugucccgccuccugcuuaacagauuuaccaugacccaccggagaccuacaauugagaaggacguggaucugggggcuggaacgcgccaugucaacgccgaaccggagacccccaauauggacguuaucggcgagcggaucaaaagaauuaaggaagaacacaacucuacauggcacuacgacgaugaaaauccuuauaagaccugggcuuaccaugggagcuaugaggugaaagccacaggauccgcgagcuccaugaucaacggcguggucaagcuccugaccaaacccugggacgugguuccuauggugacacagauggccaugaccgauacgacccccuucggccagcaacgcgucuuuaaggaaaaaguggacacacggaccccgagaucuaugccugggacacgccggguuaugggaauuaccgcugaguggcuguggagaacgcucggccgcaauaagaagccccggcugugcacaagagaggaguucaccaaaaaggugcgcacaaacgccgcuaugggggccgucuuuaccgaggaaaaucagugggauagcgccaaagcggcuguggaggacgaagauuucuggaaacuuguugaccgggagagagagcugcacaaacucggaaaguguggcuccugcguguacaacaugauggggaaacgcgaaaagaagcugggcgaguuuggaaaagccaagggcucuagagccaucugguacauguggcuuggggcucgguaucuggaguucgaggcccucggauuucugaaugaggaucauugguucagccgcgaaaacuccuacucuggcgucgagggggaaggacugcacaaacucggcuauauucugagagacaucagcaagaucccugggggcgcuauguacgccgaugacacggcgggaugggacacccggauuacagaggaugaccuucauaaugaagagaaaaucacccagcagauggaucccgagcacagacaacuggccaacgcuauuuuuaagcucacauaucagaauaagguggucaaagugcagcggccuacccccacaggcaccguuauggacaucauuucccgcaaggaucagagagggagcggacaagugggcacguacucucugaacacauucaccaauauggaagcccagcuuauccggcagauggagggggaaggaguccuguccaaagcugaccucgagaacccgcaucugccugaaaagaaaaucacccaguggcuggagacaaagggcguggagcgccucaagagaauggccauuagcggggaugacugcgugguuaaacccaucgaugaccgguuugcgaacgcccugcuugcucugaaugauaugggcaaggugcgcaaagacauuccccaauggcagccuucuaagggauggcaugauuggcagcaggucccguucuguucccaccauuuccacgaacucaucaugaaagacggcagaaagcuggugguucccugccggccucaagacgagcuuauugggcgcgccagaaucagccagggagcuggcuggucucugcgggaaaccgccugucucgggaaggcuuaugcccagauguggucccugauguacuuucaccgcagagaucugcggcucgcgagcaacgccauuugcuccgcugugcccguccauugggugccuacaagccgcacgaccuggucuauccacgcccaucaccaauggaugacaaccgaggacaugcugacagucuggaauagaguguggaucgaagauaaccccuggauggaggacaaaaccccuguuacgaccugggagaaugugcccuaccuuggaaagcgggaagaucagugguguggcagccugauugggcucacauccagagccaccugggcucagaacaucccgacagccauucagcaaguccgcucucugaucggcaaugaggaguuccuugacuauaugccuagcaugaaacgguuuagaaaggaggaggaauccgagggagcgauuugguga

SEQ ID NO: 20734 - RNA, 9873 nt, Artificial Sequence
  derived and/or modified CDS sequence (opt5) from DENV-3__FJ547082__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucgccgaaguugagcccgaagacauugauugcugguguaaccucacauccaccugggugacauauggaaccugcaaucaggccggcgagcacagacgggacaagcgcucuguggcucuggccccucaugucgggaugggacuggauacgagaacccaaacauggaugagcgcugagggcgccuggcggcagguggaaaaaguugagaccugggcgcuccgccaccccggcuucacaauccuggcccuuuuucuggcucauuacaucgggaccucccucacgcagaagguggucauuuucauccugcuuaugcuggugacaccuucuaugaccaugagauguguuggagugggcaaccgggacuuugucgaagggcucagcggagccacauggguggaugugguccuggagcacggcgggugcguuaccaccauggcuaagaauaaacccacacuggacauugagcuccagaagacggaagccacccaacuggcgacacuucgcaaacuguguaucgagggaaagauuaccaacaucacaaccgauuccagaugcccuacgcagggcgaagccgugcucccggaggaacaggaccagaauuauguguguaaacacacauacgucgaucggggcugggggaacggaugcggccuguucgggaagggaagccuugugaccugcgcuaaguuucaaugucuggagcccauugagggcaaaguugugcaguaugaaaaucucaaguacaccgucaucaucacagugcauaccggggaccagcaccagguuggaaacgagacacaaggcgugacggccgaaauuaccccucaggcuucuacaaccgaggccauccugcccgaauauggcacacuggggcucgagugcuccccucgcaccggacuggacuucaaugagaugauucuucugacgaugaaaaacaaggccuggaugguccauagacagugguuuuucgaucucccccugccguggaccagcggcgcuacaaccgaaacaccuaccuggaaucggaaagagcuucuggugacguuuaagaacgcgcacgccaaaaagcaagaagucgugguucucgggucucaggagggagcuaugcacacagcccugaccggcgccacagaaauccagaauuccgggggcaccagcauuuucgcuggacaucugaagugucgccucaaaauggacaagcuggagcuuaaaggcaugucuuacgccaugugcaccaacacauuugugcugaagaaagaggucuccgaaacgcagcacgggaccauccucaucaagguggaguacaagggagaagauguucccuguaaaauuccuuucagcacagaggacggccaagggaaggcgcauaacggaagacugaucaccgcuaaucccguggucacaaaaaaggaggaacccgugaacauugaggccgaaccuccguucggcgaguccaauaucgugauugggaucggcgauaacgcccugaaaaucaauugguauaagaagggaucuagcauuggcaaaauguuugaagcuaccgcccggggggcuagacgcauggccauccuuggagacacggcgugggauuucggcuccguugggggaguccucaacagccugggcaagauggugcaccagauuuuugggucugccuacacagcucuguucuccggcgugagcugggucaugaaaaucggaauuggcgugcuccugaccuggaucgggcuuaauucuaagaacaccagcauguccuuuucuugcauugccaucggaaucauuacacuguaucucggcgcuguugugcaggccgacaccgggugugucaucaauuggaaaggaaaggagcugaagugcggcagcgggauuuucgugacaaacgagguucauacguggaccgaacaguacaaauuucaagcggauucccccaagcggcuggccacagcuaucgccggcgcuugggagaauggaguguguggcauuagaagcaccacacgcauggaaaaccuucucuggaaacagaucgccaaugagcugaacuauauccugugggaaaauaacauuaagcucaccgucgugguuggggacaucauuggagugcuggagcagggcaaacggacgcuuaccccucagcccauggagcugaaguacucuuggaaaaugugggggaaggccaagaucgucacagcugaaacccaaaacuccagcuucauuaucgauggaccuaauacacccgagugcccgucugcguccagagccuggaacgugugggaaguggaggacuauggcuuuggcgucuucaccacaaauaucuggcucaaacugcgcgaaguuuacacccagcugugugaccaccggcuuaugagcgcugccgugaaggaugagagagccgugcacgcugacaugggguacuggauugagucccagaaaaacggaucuuggaagcucgaaaaagccagccugaucgaggucaagacgugcacauggccuaagucccauacccuguggucuaauggcgugcucgaaagcgauaugauuauccccaaaucccuggcggggccuauuagccagcacaacuaucgccccggauaccauacccaaacagcuggcccuuggcaccuugggaagcuggagcucgacuuuaauuauugcgagggaaccacgguugugaucacagaaaacuguggcacccggggccccucucugagaacaaccacagucuccgggaaacugauccacgaguggugcugucgcagcugcacccuuccgccucuccgguacaugggagaagauggcuguugguaugggauggagauuagacccaucucugaaaaggaggagaauauggugaaaucccugguuagcgccggaucuggcaagguggacaacuucacgauggggguccugugccucgccauucuguuugaagaggugaugcggggaaaguucggcaaaaagcauaugaucgcuggcguuuucuuuaccuucgugcuucugcucagcgggcagauuacauggcgcgauauggcccacacccugaucaugauuggauccaaugcgagcgacagaaugggcaugggggucacauaccuggcucuuaucgccaccuuuaaaauccagcccuuccuggcccucggauuuuuccugcggaagcucacgucuagagaaaaccugcuucugggcguggggcucgcuauggccacaacccugcaacugccugaggauauugaacagauggcuaauggaaucgcccuuggccugauggcgcucaaacugauuacacaguuugagaccuaucagcucuggaccgcccugaucucccuuacauguagcaacacgauuuucacccugacaguggcuuggcgcaccgccacacucauccuggcuggcgucucccugcuuccgguuugccaaucuagcuccaugcggaagucugacuggcugcccaugaccguggccgccaugggggugccuccccucccucuguuuaucuucagccucaaggauacgcugaaaagacgcuccuggccccuuaaugagggagucauggcugugggccugguuucuauucuggcgagcucccuccugagaaacgacgugccuauggccgggccccuugucgcuggaggccugcucaucgccuguuacgugauuacagggaccagcgccgaucugaccguugaaaaggcugccgacgugacaugggaggaagaggcggaacagaccggagucucucauaaccucaugaucacaguggacgaugacggcacgaugcggauuaaagaugacgagaccgagaauauccugacaguccuucugaagaccgcucugcucaucguguccggcauuuuuccguacagcaucccugccacacugcuuguuuggcacaccuggcagaaacagacgcgcagaucuggggugcugugggauguccccuccccucccgaaacccaaaaggccgagcucgaagagggaguguaucggauuaaacagcagggcaucuucgggaagacacagguuggagugggcguccaaaaggaggggguguuucauaccauguggcacgugacacgcggagcuguucugaccuacaacggcaaaagacucgaaccgaauugggccagcgucaagaaagaccugauuucuuauggcgggggauggcggcuuuccgcgcaguggcagaagggcgaggaagugcaagugaucgcugucgagccugggaaaaaccccaagaauuuccagacaaugccuggaacguuccagaccacaaccggcgaaauuggggccaucgcccuggauuuuaagcccggaaccagcggcucccccaucauuaaccgcgagggcaaagugguugggcuguacggaaauggcguggucacaaagaacgggggauaugugagcggcaucgcucagacgaaugccgagccugacgggccgacccccgaacucgaggaagagauguucaaaaagagaaaccugacaauuauggaucuucacccuggcucuggaaaaacccggaaguaccugcccgcuaucguucgcgaagccauuaagagacggcucagaacacugauccucgcgccuacccgcguggucgccgcugagauggaggaagcccugaaaggccuucccauccgguaucaaacgacagcuaccaagagcgagcauaccgggagagaaauuguggaccugaugugccacgccacauuuaccaugcgccugcucuccccuguucgggugccgaauuacaaccugaucauuauggaugaggcccauuucacagaccccgcuucuaucgcggccagaggauacauuagcacccgcgucggcaugggggaagcugccgccaucuuuaugacggcuacaccucccggaaccgccgaugcguucccucaguccaaugcucccauccaggacgaggagcgggacauuccggaaagaucuuggaacagcggcaaugaguggaucacagauuuugccgggaaaaccgugugguucgugccuuccauuaaggccggcaacgacaucgcuaacugucuucgcaaaaauggaaagaaggucauucagcugucucggaaaacguuugauaccgaauaucaaaagacaaaacucaacgacugggauuucguugugaccacagacaucagcgagaugggcgccaauuuuaaggcggauagagugauugacccccggcgcugccugaaacccgucauccugaccgaugggccugagagagugauccucgccggacccaugccuguuacagcugccuccgcugcccagcggcgcggcagaguggggcggaacccgcagaaggaaaaugaccaguacauuuucaccggacaaccccuuaacaaugaugaggaccacgcucauuggacggaagccaagaugcugcuggacaacaucaauacaccugagggcauuauccccgcgcucuucgaaccugagagagagaaaagcgccgcuauugauggggaauaucgccugaagggcgagucucggaaaaccuuugucgaacuuaugagacgcggagaccugcccguguggcucgcccacaagguugcuuccgagggcaucaaauacaccgaucggaaguggugcuucgacgggcagagaaacaaucagauccuggaagagaacauggauguggagauuuggacaaaagaaggagagaagaagaaacugcgcccgcgguggcucgacgccagaaccuauagcgauccucuugcccugaaggaauuuaaagacuucgcugcgggccgcaagucuaucgcccuggaucucgucacagagauugggagagugcccucccaccuggcucaucggacgcgcaaugcccuugacaaccuggucaugcuccacaccagcgaacauggaggcaaagccuacagacacgcuguggaggagcugccugaaacaauggagacccugcuccuucugggccugaugauccuccugacagggggagccaugcuuuuucugauuuccggcaaggggaucggaaagaccucuaucggccucauuuguguuaucgcgagcuccgggaugcuguggauggccgaaauuccccugcaguggaucgcuagcgccauugugcucgaguucuuuaugauggugcuucugaucccugagcccgaaaaacaacggacgccgcaggauaaucagcuggcuuaugucguuauuggaauccucacccuggccgcgaucauugccgcuaacgagaugggccuucuggaaacaaccaagcgcgaccucggcaugucuaaagagccugggguggugucccccacaagcuaccuggaugucgaccugcaccccgccucugcuuggacccucuacgccguggcuacgacaguuaucaccccuaugcuuagacauacaauugaaaauagcaccgccaacgugucccuggcggccaucgcuaaccaagccgucgugcugaugggacucgacaagggcuggccgauuucuaaaauggaucugggggucccccuucuggcucucggaugcuauagccaggugaauccucugacccugacagccgccguucuccuucugaucacgcacuacgcgaucauuggccccgggcugcaggcuaaggccacccgggaggcucagaagagaacagccgccggaaucaugaaaaacccuaccguggacggcauuaugacaaucgaucucgaccccgucauuuaugauuccaaguucgagaaacaacugggccaggugaugcuucugguucucugugcugugcagcugcugcucaugcgcaccucuugggcccuuugcgaagcgcugacgcuggccacagggccuaucaccacccucugggagggaagcccgggcaaguuuuggaauacaaccaucgcugucuccauggccaacauuuuccgggggagcuaccuggcuggagccggccuugcguuuucuaucaugaaauccguggggacaggaaagagaggcacgggcagccagggggaaacccugggagagaaguggaaaaagaaacucaaucaacugucccgcaaggaauucgaccuguauaaaaagucuggcauuacagagguggaucggaccgaggccaaagaagggcucaagagaggagagaucacacaucacgcuguuagccggggcuccgccaagcuucagugguuugucgaacgcaacauggugauucccgaggggagagugaucgaccugggauguggccggggcggguggucuuacuauugcgcuggacugaaaaaggucaccgaaguucgcggcuacacgaaagggggaccuggccaugaggagcccgugccuaugagcaccuacggguggaauauugugaagcucauguccggaaaagaugucuucuaucugcccccggaaaagugugacacacuucugugcgauaucggcgagagcucuccuucccccaccguggaagagagcagaacaauccggguucucaagaugguggagcccuggcugaaaaacaaucaguucuguauuaagguccugaacccuuacaugcccaccgugaucgaacaccucgagcgccuucagagaaaacacggcgggaugcugguucggaauccucugucucgcaacuccacacaugaaauguauuggauuagcaauggaaccggcaacaucguggccucugucaauauggugagcagacuccugcuuaaccgguuuacgaugacacacagacgcccgaccauugagaaggacguggaucugggggcuggaacccggcaugucaacgccgaacccgagacaccuaauauggacguuaucggcgagagaaucaaacgcauuaaggaagagcacaacuccacguggcacuacgacgaugaaaaucccuauaagaccugggcguaccaugggucuuaugaggugaaagccacaggaagcgcuuccagcaugaucaacggcguggucaagcuccugaccaaaccuugggacgugguucccauggugacacaaauggccaugaccgauacaaccccguucggccagcagcgggucuuuaaggaaaaaguggacacgagaaccccucgcuccaugcccgggacacggagaguuaugggaauuaccgcugaguggcuguggcgcacacucggccggaauaagaagccuagacugugcacccgcgaggaauucacgaaaaaggugcggacaaacgccgccaugggggcggucuuuaccgaggaaaaucaaugggauucugcuaaagccgccguggaggacgaagauuucuggaagcuuguugacagagagcgcgagcugcacaaacucggaaaguguggcagcugcguguacaacaugauggggaaaagagaaaagaagcugggcgaguuuggaaaagcuaagggcucccgggccaucugguacauguggcuuggggcucgcuaucuggaauucgaggcccucggauuucugaaugaggaucauugguucucuagagaaaacagcuacuccggcgucgagggggaaggacugcacaaacucggcuauauucugcgggacaucucuaagauccccgggggcgcgauguacgccgaugacacagcuggaugggacaccagaauuacggaggaugaccuucauaaugaagagaaaaucacccagcagauggauccugagcaccggcagcuggccaacgcuauuuuuaagcucacauaucaaaauaagguggucaaagugcagcgccccaccccgacaggcaccguuauggacaucauuagcagaaaggaucagcggggguccggacaggugggcacauacgggcugaacaccuucacgaauauggaagcccaacuuauccgccagauggagggagaaggcguccugagcaaagcggaccucgagaacccucaccugucugaaaagaaaaucacacaguggcuggagaccaaggggguggagagacucaagcggauggccauuuccggcgaugacugcgugguuaaacccaucgaugaccgcuuugcuaacgcccugcuugcucugaaugauaugggaaaggugagaaaagacauuccccaguggcaaccuagcaagggcuggcaugauuggcagcaggucccguucuguucucaccauuuccacgaacucaucaugaaagacgggcggaagcuggugguucccugccgcccucaggacgagcuuauuggaagagcccggaucucccaaggcgcuggguggagccugcgcgaaaccgccugucucggaaaggcguaugcccagauguggucucugauguacuuucacagacgggaucugcgccucgcuuccaacgccauuugcagcgccgugcccguccauugggugccuacauccagaaccacauggagcauccacgcucaucaccaguggaugacgaccgaggacaugcugacagucuggaaucggguguggaucgaagauaaccccuggauggaggacaaaaccccuguuacaaccugggagaaugugcccuaccuuggcaagagagaagaucaauggugugggucucugauuggccucacgagccgcgccaccugggcgcagaacaucccgacagcuauucagcagguccggucccugaucggaaaugaggaauuccuugacuauaugccuucuaugaaaagauuucgcaaggaggaggaaagcgagggcgccauuugguga

SEQ ID NO: 20735 - RNA, 9873 nt, Artificial Sequence
  derived and/or modified CDS sequence (opt5) from DENV-3__FJ547083__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagagacggcgcgacaagagaucuguggcccuggcuccucacgucgggaugggacuggauacccggacacaaaccuggaugagcgccgagggcgcuuggcgccagguggaaaaaguugagacaugggcccucagacaucccggcuucaccauccuggcgcuuuuucuggcccacuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcauggcgggugcguuaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagagcuauguguguaaacacaccuacgucgaucgcggcugggggaauggaugcggccuguucgggaagggaucucuugugaccugcgccaaguuucaaugucuggagcccauugagggcaaaguugugcaguaugaaaaccucaaguacacagucaucaucaccgugcacacaggggaccagcaucagguuggaaaugagacgcaaggcgugaccgcugaaauuacaccucaggccuccaccacagaggcuauccugcccgaauauggcacccuggggcucgagugcagcccuagaacgggacuggacuucaacgagaugauucuucugaccaugaaaaauaaggccuggaugguccaccggcagugguuuuucgaucucccccugccguggacaucuggcgccaccacagaaaccccuacguggaaccgcaaagagcuucuggugacauuuaagaaugcucaugcgaaaaagcaagaagucgugguucucgggucccaggagggagccaugcacaccgcucugacaggcgccaccgaaauccagaacagcgggggcaccucuauuuucgccggacaccugaaguguagacucaaaauggacaagcuggagcuuaaaggcauguccuacgcuaugugcacaaauacguuugugcugaagaaagaggucagcgaaacccagcaugggacaauccucaucaagguggaguacaagggagaagaugcccccuguaaaauuccuuucuccaccgaggacggccaagggaaggcgcacaacggacggcugaucacagcuaaccccguugugaccaaaaaggaggaacccgucaauauugaggccgaaccuccguucggcgagucuaacaucgugauugggaucggcgauaaugcccugaaaaucaacugguauaagaagggaagcuccauuggcaaaauguuugaagcuacggccagaggggcucgccggauggccauccuuggagacacagcgugggauuucggcagcguggggggaguucucaauucucugggcaagaugguccaucagauuuuuggguccgccuacaccgcucuguucagcggcgugucuugggugaugaaaaucggaauuggcguccuccugaccuggaucgggcuuaacagcaagaauacauccaugucuuuuagcugcauugccaucggaaucauuacccuguaucucggcgcugugguucaggccgacauggggugugugaucaacuggaaaggaaaggagcugaagugcggcuccgggauuuucgucacaaaugaggugcacacguggaccgaacaguacaaauuucaagcggauagccccaagagacuggccacagcuaucgccggcgcuugggagaacggaguuuguggcauucgcucuaccacacggauggaaaaucuucucuggaaacagaucgccaacgagcugaauuauauccugugggaaaacaauauuaagcucaccguggucgugggggacacgaucggaguucuggagcagggcaaaagaacccuuacaccucagcccauggagcugaaguacuccuggaaaaccugggggaaggccaagauugugacagcugaaacccaaaacagcucuuucaucauugauggaccuaacacacccgagugcccguccgcgagccgcgccuggaaugucugggaaguggaggacuauggcuuuggcguguucaccacgaacaucuggcucaaacugcgggaagucuacacacagcugugugaccauagacuuauguccgcugccguuaaggaugagcgcgccgugcacgcugacaugggguacuggaucgagucucagaaaaauggaagcuggaagcucgaaaaagccucccugauugaggugaagaccugcaccuggccuaagucucacacacuguggagcaacggcguccucgaauccgauaugaucauucccaaaagccuggcggggccuaucucucagcauaaucaccggcccggauaucauacccaaacggcuggcccuuggcaccuugggaagcuggagcucgacuuuaacuacugcgagggaacaaccgugguuauuacagaaaauuguggcaccagaggccccucccugcgcacaaccacggugagcgggaaacugauccacgaguggugcugucggucuugcacccuuccgccucucagauauaugggagaagauggcuguugguacgggauggagauccggcccauuuccgaaaaggaggagaacauggucaaaagccuggugucugccggaagcggcaagguugacaauuucacaaugggggugcugugccucgccauccuguuugaagaggucaugcgcggaaaguucggcaaaaagcauaugauugcuggcguguucuuuaccuucguucuucugcucuccgggcagaucacauggagagauauggcccacacccugauuaugaucggaagcucugcguccgaccggaugggcaugggggugacguaucuggcucuuauugccacauuuaaaauccagcccuuccuggcccucggauuuuuccugagaaagcucaccagccgcgaaaaccugcuucugggcgucgggcucgcuauggccacaacccugcaacugccugaggauaucgaacagauggcuaauggaauugcccuuggccugauggcgcucaaacugaucacccaguuugagacauaccagcucuggacggcccugauuucccuuaccuguucuaacacaauguucacccugacaguggcuuggcggaccgccacgcucauccuggcuggcgugagccugcuuccggucugccaauccucuagcaugagaaagacagacuggcugcccauggccguugccgcuaugggggugccuccccucccucuguuuauuuucucccucaaggauacccugaaacgcagaucuuggccccuuaaugagggagugauggcggucggccuggugagcauccuggccuccagccuccugcggaacgacguuccuauggcugggccccuuguggccggaggccugcucaucgccuguuaugucauuaccgggacaucugcugaucugaccguggaaaaggccgcggacaucacaugggaggaagaggcugaacagacgggaguuucccauaaucucaugauuaccguggacgaugacggcacaaugcgcaucaaagaugacgagaccgagaacauucugacaguccuucugaagaccgcccugcucaucgugagcggcgucuuuccguacucuaucccugccacgcugcuuguguggcacaccuggcagaaacagacacaaagauccgggguucugugggaugugcccagcccucccgaaacccagaaggcugagcucgaagagggagucuaccggauuaaacagcagggcaucuucgggaagacacaagugggaguuggcgugcagaaggagggggucuuucauaccauguggcacgugacacgcggagccgugcugacguauaacggcaaaagacucgaaccgaauugggcgucuguuaagaaagaccugauuuccuacggcgggggauggcggcuuagcgcucaguggcaaaagggcgaggaaguccaggugaucgccguggagccugggaaaaaccccaagaauuuccagaccaugccuggaacauuccagaccaccacaggcgaaauuggggccaucgcucuggauuuuaagcccggaacguccggcagccccauuaucaaccgcgagggcaaagucguggggcuguauggaaauggcguugugaccaagaacgggggauacgucucuggcaucgcccaaacaaaugcugagccugacgggccgacccccgaacucgaggaagagauguucaaaaagagaaaccugacaauuauggaucuucacccuggcagcggaaaaacccggaaguaucugcccgccaucgugcgcgaagcgauuaagagacggcucagaacgcugauccucgccccuacacgcguuguggcugccgagauggaggaagcucugaaaggccuucccauucgguaccagaccaccgccacaaaguccgagcauaccgggagagaaaucgucgaccugaugugccacgccacauuuaccaugcgccugcucucuccugugcggguuccgaauuauaaccugaucauuauggaugaggcucauuucacggaccccgcgagcaucgccgcuagaggauacauuuccacacgcgugggcaugggggaagccgccgcuaucuuuaugaccgccacaccucccggaaccgcggaugcuuucccucagucuaaugcccccauucaggacgaggagcgggacaucccggaaagaagcuggaacuccggcaaugaguggaucacggauuuugccgggaaaaccgucugguucgugccuucuauuaaggcuggcaacgacaucgccaauugucuucgcaaaaacggaaagaaggugauucaacugagccggaaaacauuugauaccgaauaccagaagacaaaacucaacgacugggauuucgucguuaccacagacaucuccgagaugggcgcgaauuuuaaggccgauagagugauugacccccggcgcugccugaaacccgugauccugaccgaugggccugagagagucauucucgcuggacccaugccugugacggccgcuagcgccgcucagcggcgcggcagaguugggcggaacccgcagaaggaaaaugaccaauauaucuucacaggacagccccuuaacaaugaugaggaccacgcccauuggaccgaagcgaagaugcugcuggacaacaucaauaccccugagggcauuauccccgcccucuucgaaccugagagagagaaaucugcugccauugauggggaauaccgccugaagggcgagucccggaaaacauuuguggaacuuaugagacgcggagaccugcccgucuggcucgcucacaagguggccagcgagggcaucaaauauaccgaucggaaguggugcuucgacgggcagagaaacaaucagauucuggaagagaacauggauguugagaucuggacaaaagaaggagagaagaagaaacugcgcccgcgguggcucgacgccagaacguacucugauccucuugcucugaaggaauuuaaagacuucgcggccggccgcaaguccaucgcucuggaucucgugaccgagauugggagaguccccagccaccuggcccaucggacacgcaaugcccuugacaaccuggugaugcuccacaccuccgaacauggaggcagagcuuaucggcacgccgucgaggagcugccugaaacaauggagacccugcuccuucugggccugaugauccuccugacggggggagcgaugcuuuuucugauuucuggcaaagggaucggaaagaccagcauuggccucaucugugugaucgccuccagcgggaugcuguggauggcugaaauuccccugcaauggaucgccucugcuauuguucucgaguucuuuaugauggugcuucugaucccugagcccgaaaagcagcgcacaccgcaggauaaucaacuggccuacguggucauuggaauccucacccuggcggccauuaucgcugccaacgagaugggccuucuggaaacaaccaaaagagaccucggcauguccaaggagccugggguugugagccccacgucuuaucuggauguggaccugcaccccgcuagcgccuggacacucuacgcugucgccaccacagugaucaccccuaugcuucggcauaccauugaaaauuccacagcgaacguuucucuggccgcuaucgccaaucaggcugugguccugaugggacucgacaaaggcuggccgauuagcaagauggaucugggggugccccuucuggcccucggaugcuacucccaggucaacccucugacgcugaccgccgcggugcuccuucugaucacacacuaugcuauuaucggccccgggcugcaggccaaagcuaccagagaggcccaaaagcgcacagccgcuggaaucaugaagaacccuaccguugacggcauuaugacgaucgaucucgaccccgugauuuacgauucuaaauucgagaagcagcugggccaggucaugcuucuggugcucugugccguucagcugcugcucaugcggacaagcugggcgcuuugcgaagcccugacccuggcuaccgggccuaucacaacccucugggagggauccccgggcaaauuuuggaauacaacgauugccgugagcauggcuaacaucuucagagggucuuaucuggccggagcgggccuugccuuuuccaucaugaagagcgucgggaccggaaaacgcggcacaggcucccaaggggaaacccugggagagaaguggaagaaaaagcucaaucagcugucucggaaagaauucgaccuguacaagaaaagcggcauuacagagguggauagaaccgaggcuaaggaagggcucaaacggggagagaucacgcaucacgccgugucccgcggcucugcuaagcuucagugguuuguugaaagaaacauggucauucccgaggggcgggugaucgaccugggauguggccgcggcggguggagcuauuacugcgccggacugaagaaagugaccgaagucagaggcuauacaaaggggggaccuggccaugaggagcccguuccuauguccaccuacggguggaauauugugaaacucaugagcggaaaggauguguucuaccugcccccggaaaaaugugacacacuucugugcgauaucggcgagucuuccccuagccccaccgucgaagagucucggacaauucgcgugcucaagaugguugagcccuggcugaagaacaaucaguucuguaucaaagugcugaacccuuauaugcccaccgucaucgaacaccucgagagacuucaacggaagcacggcgggaugcuggugcgcaauccucuguccagaaacagcacgcaugaaauguacuggauuucuaauggaacaggcaacaucguugcuagcgugaauauggucucccggcuccugcuuaacagauuuaccaugacccaccgccggccgacaauugagaaagacguggaucugggggccggaacgagacaugugaaugcggaacccgagaccccuaacauggacgucaucggcgagcgcauuaagcggaucaaagaagagcacaacucuacauggcacuaugacgaugaaaaucccuacaagaccugggccuaucaugggagcuacgagguuaaggcuacaggauccgccagcuccaugaucaacggcguggugaaacuccugaccaagccuugggacgucgugcccaugguuacacagauggcuaugaccgauacgaccccguucggccagcaaagaguguuuaaagaaaaggucgacacacgcaccccucggucuaugcccgggacaagacgcgugaugggaauuaccgccgaguggcuguggcggacgcucggcagaaauaaaaagccucgccugugcacacgggaggaauucaccaagaaaguuagaacaaacgccgcgaugggggcuguguuuaccgaggaaaaucagugggauagcgccaaggccgcugucgaggacgaagauuucuggaaacuuguggaccgcgagagagagcugcacaagcucggaaaauguggcuccugcguuuauaacaugauggggaagcgggaaaaaaagcugggcgaguuuggaaaggccaaaggcucucgcgcuaucugguacauguggcuuggggccagauaccuggaauucgaggcgcucggauuucugaaugaggaucauugguucagccgggaaaacuccuauucuggcguggagggggaaggacugcacaagcucggcuacauucugagagacaucagcaaaauucccgggggcgccauguaugcugaugacacggccggaugggacacccggaucacagaggaugaccuucauaaugaagagaagaucacccagcagauggauccugagcaccgccaacuggcuaacgccauuuuuaaacucacauaccagaauaaggucgugaagguccagagacccaccccgacaggcaccgugauggacaucauuucccggaaagaucagcgcgggagcggacaaguuggcacguaugggcugaacacauucaccaauauggaagcgcagcuuaucagacagauggagggagaaggcgugcugucuaaggccgaccucgagaacccucaccugcccgaaaaaaagauuacccaguggcuggagacaaaaggggucgagcggcucaagcgcauggcuaucuccggcgaugacugcguggugaagcccaucgaugacagauuugccaaugcucugcuugcccugaacgauaugggaaaaguucggaaggacauuccucaauggcagccgagcaaaggcuggcaugauuggcagcaggugcccuucuguucucaccauuuccacgaacucaucaugaaggacgggcgcaaacuggucgugccuugcagaccccaagacgagcuuauuggacgggcucgcaucucccagggcgccggguggagccugagagaaaccgcgugucucggaaaggccuacgcucagauguggucucugauguauuuucaccggcgcgaucugagacucgccuccaacgccauuugcagcgcuguuccugugcauuggguccccacaucccggacgaccuggagcauccacgcccaucaccaauggaugacaaccgaggacaugcugacaguguggaauagagucuggauugaagauaacccuuggauggaggacaagacccccgugacgaccugggagaauguuccguaccuuggcaaacgcgaagaucaguggugugggucucugaucggccucacaagccgggcgaccugggcucagaacaucccuacagccauucagcaagugagaucccugaucggaaaugaggaauuccuugacuacaugcccucuaugaagcgcuuucggaaagaggaggaaagcgagggcgccauuugguga

SEQ ID NO: 20736 - RNA, 9873 nt, Artificial Sequence
  derived and/or modified CDS sequence (opt5) from DENV-3__FJ547084__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagcggggaucuagcauuggcaagauguuugaagccacggcuagaggggcccgccggauggcuauccuuggagacacagccugggauuucggcuccguugggggaguccucaacagccugggcaaaauggugcaccagauuuuugggucugcguacaccgcccuguucuccggcgugagcugggucaugaagaucggaauuggcgugcuccugaccuggaucgggcuuaauucuaaaaacacaagcauguccuuuucuugcauugcuaucggaaucauuacccuguaucucggcgccguugugcaggcugacauggggugugucaucaauuggaagggaaaagagcugaagugcggcagcgggauuuucgugacaaacgagguucauacguggaccgaacaguacaaguuucaagccgauucccccaaaagacuggcgacagccaucgcuggcgccugggagaauggaguguguggcauucgcagcaccacacggauggaaaaccuucucuggaagcagaucgcuaaugagcugaacuauauccugugggaaaauaacauuaaacucaccgucgugguuggggacacgaucggagugcuggagcagggcaagagaacccuuacaccucagcccauggagcugaaauacucuuggaagaccugggggaaagccaagauugucacagccgaaacccaaaacuccagcuucaucauugauggaccuaauacacccgagugcccgucugcuucccgcgcguggaacgugugggaaguggaggacuauggcuuuggcgucuucaccacgaauaucuggcucaagcugcgggaaguuuacacacagcugugugaccacagacuuaugagcgccgcugugaaagaugagcgcgccgugcacgccgacaugggguacuggaucgagucccagaagaacggaucuuggaaacucgaaaaggcuagccugauugaggucaaaaccugcaccuggccuaagucccauacacuguggucuaauggcgugcucgaaagcgauaugaucauucccaagucccuggccgggccuaucagccagcacaacuaucggcccggauaccauacccaaacggcgggcccuuggcaccuugggaaacuggagcucgacuuuaauuauugcgagggaacaaccguugugauuacagaaaacuguggcaccagaggccccucucugcgcacaaccacggucuccgggaagcugauccacgaguggugcugucggagcugcacccuuccgccucucagauacaugggagaagauggcuguugguaugggauggagauccggcccauuucugaaaaagaggagaauauggugaagucccugguuagcgcuggaucuggcaaaguggacaacuucacaauggggguccugugccucgccauccuguuugaagaggugaugcgcggaaaguucggcaagaaacauaugauuguuggcguguucuuuaccuucguccuucugcucagcgggcagaucacauggagagauauggcccacacccugauuaugaucggauccaaugcuagcgaccggaugggcaugggggugacguaccuggcccuuauugcgacauuuaagauccagcccuuccuggcucucggauuuuuccugagaaaacucaccucucgcgaaaaccugcuucugggcguggggcucgccauggccacaacccugcaacugccugaggauaucgaacagauggcuaauggaauugcccuuggccugauggcucucaagcugaccacacaguuugagacguaucagcucuggaccgcccugaucucccuuacauguagcaacaccauuuucacacugaccgucgcguggcggacggccacacucauccuggcuggcguuucccugcuuccggugugccaaucuagcuccaugagaaaaaccgacuggcugcccaugaccguggccgcuaugggggucccuccccucccucuguuuauuuucucucucaaggauacacugaagcgcagaagcuggccccuuaaugagggagugauggccguuggccugguguccauccuggccucuagccuccugcggaacgacgucccuauggcugggccccuuguggcgggaggccugcucaucgccuguuacguuauuaccgggacauccgcugaucugacgguggaaaaagccgccgacgucaccugggaggaagaggcugaacagacaggagugagccauaaccucaugaucaccgucgacgaugacggcacaaugcgcauuaaggaugacgagaccgagaauauccugacggugcuucugaaaaccgcccugcucauuguuucuggcaucuuuccguacuccaucccugcgacacugcuuguguggcacaccuggcagaagcagacacaaagaagcgggguccugugggaugugcccucuccucccgaaacccagaaagcugagcucgaagagggaguuuaucggauuaagcagcagggcaucuucgggaaaacacaagugggagucggcgugcagaaggaggggguguuucauacgauguggcacguuacccgcggagccguccugacauacaacggcaagagacucgaaccgaauugggccuccgugaaaaaggaccugauuagcuauggcgggggauggcggcuuucugcucaguggcaaaaaggcgaggaagugcaggucaucgccguggagccugggaagaaccccaaaaauuuccagaccaugccuggaaccuuccagacaacgaccggcgaaauuggggcgaucgcucuggauuuuaagcccggaacauccggcagccccauuaucaaccgcgagggcaagguuguggggcuguacggaaauggcgucgugaccaaaaacgggggauauguuuccggcaucgcccaaacaaaugccgagccugacgggccgacccccgaacucgaggaagagauguucaagaaaagaaaccugacgauuauggaucuucacccuggcagcggaaagacacggaaauaccugcccgcuaucgugcgcgaagccauuaagagacggcucagaacccugauccucgcuccuacccgcgucguggccgcggagauggaggaagcccugaagggccuucccauucgguaucagacaaccgcuacaaaaucugagcauaccgggagagaaaucguugaccugaugugccacgccacguuuacaaugcgccugcucagcccugugcgggucccgaauuacaaccugaucauuauggaugaggcucauuucaccgaccccgccuccaucgccgcuagaggauacauuucuacacgcgugggcaugggggaagcggccgcuaucuuuaugaccgccacgccucccggaaccgccgaugcuuucccucagagcaaugcccccauucaggacgaggagcgggacaucccggaaagauccuggaacucuggcaaugaguggaucacagauuuugcggggaagaccgugugguucgucccuagcauuaaagcuggcaacgacaucgccaacugucuucgcaagaauggaaaaaagguuauucaacugucccggaagacauuugauaccgaauaucagaaaacaaagcucaacgacugggauuucguggugaccacggacaucucugagaugggcgccaauuuuaaagcugauagagucauugacccccggcgcugccugaagcccgugauccugacagaugggccugagagaguuauucucgccggacccaugccugugaccgcggccagcgcugcccagcggcgcggcagagucgggcggaacccgcagaaagaaaaugaccaauacaucuucaccggacagccccuuaacaaugaugaggaccacgcucauuggacagaagccaagaugcugcuggacaacaucaauaccccugagggcauuauccccgcucucuucgaaccugagagagagaaguccgccgcgauugauggggaauaucgccugaaaggcgagagccggaagacauuuguggaacuuaugagacgcggagaccugcccguuuggcucgcccacaaaguggcuucugagggcaucaaguacacggaucggaaauggugcuucgacgggcagagaaacaaucagauucuggaagagaacauggaugucgagaucuggaccaaggaaggagagaaaaagaagcugcgcccgcgguggcucgacgccagaacauauuccgauccucuugcucugaaagaauuuaaggacuucgccgccggccgcaaaagcaucgcucuggaucucgugaccgagauugggagaguccccucucaccuggcgcaucggacacgcaaugcccuugacaaccuggugaugcuccacaccuccgaacauggaggcaaggcuuacagacacgccguugaggagcugccugaaacgauggagacccugcuccuucugggccugaugauccuccugacagggggagccaugcuuuuucugauuagcggcaaagggaucggaaagaccuccauuggccucaucugugugaucgcuucuagcgggaugcuguggauggccgaaauuccccugcaauggaucgcguccgccauugugcucgaguucuuuaugaugguccuucugaucccugagcccgaaaagcagcggacaccgcaggauaaucaacuggcuuauguugugauuggaauccucacccuggccgcuauuaucgccgcgaacgagaugggccuucuggaaacgacaaaacgcgaccucggcaugagcaaggagccugggguggucucucccaccuccuaccuggauguggaccugcaccccgccagcgcuuggacacucuacgccguugcuaccaccgugaucacaccuaugcuuagacauacgauugaaaauucuaccgccaacgucagccuggcugccaucgcgaaccaggccgugguccugaugggacucgacaaaggcuggccgauuuccaagauggaucugggggugccccuucuggcucucggaugcuauucucagguuaauccucugacacugaccgccgcugugcuccuucugaucacacacuacgccauuaucggccccgggcugcaggccaaagcgacccgggaggcucaaaagagaacggccgcuggaaucaugaagaacccuacagucgacggcauuaugaccaucgaucucgaccccgugauuuaugauagcaaauucgagaagcagcugggccagguuaugcuucuggugcucugugccguccagcugcugcucaugcgcaccuccugggcccuuugcgaagcucugacacuggccaccgggccuaucacaacgcucugggagggaucuccgggcaaauuuuggaauaccacaauugcggugagcauggccaacaucuuccggggguccuaccuggcuggagccggccuugcuuuuagcaucaugaagucuguggggaccggaaaaagaggcacaggcucccaaggggaaacccugggagagaaguggaagaaaaagcucaaucagcugagccgcaaagaauucgaccuguauaagaaauccggcauuacggagguugaucggaccgaggccaaggaagggcucaaaagaggagagaucacacaucacgcggucucucggggcagcgccaagcuucagugguuuguggaacgcaacauggugauucccgaggggagagucaucgaccugggauguggccggggcgggugguccuacuauugcgcuggacugaagaaaguuaccgaagugcgcggcuacacaaaggggggaccuggccaugaggagcccgugccuaugucuaccuacggguggaauauugucaaacucaugagcggaaaggauguguucuaucugcccccggaaaaaugugacacacuucugugcgauaucggcgaguccagcccuucucccaccguugaagaguccagaacgauucgggugcucaagauggucgagcccuggcugaagaacaaucaguucuguaucaaagugcugaacccuuacaugcccacaguuaucgaacaccucgagcgccuucaaagaaagcacggcgggaugcuggugcggaauccucugagccgcaacucuacccaugaaauguauuggauuuccaauggaaccggcaacaucgucgccagcgugaauauggugucuagacuccugcuuaaccgguuuacaaugacgcacagacgcccgaccauugagaaagacgucgaucugggggcuggaacacggcauguuaacgccgaacccgagaccccuaauauggacgugaucggcgagagaauuaagcgcaucaaagaagagcacaacagcacauggcacuacgacgaugaaaaucccuauaagaccugggcuuaccauggguccuaugaggugaaggccacaggaucugcgagcuccaugaucaacggcgucgugaaacuccugaccaagccuugggacguugugcccauggucacgcagauggccaugaccgauacaaccccguucggccagcaacggguguuuaaagaaaagguugacacaagaaccccucgcagcaugcccgggacgcggagagugaugggaauuacagcugaguggcuguggcgcacccucggccggaauaaaaagccuagacugugcacacgcgaggaauucaccaagaaaguccggacgaacgccgcuaugggggccguguuuaccgaggaaaaucagugggauuccgccaaggcggcuguugaggacgaagauuucuggaaacuuguggacagagagcgcgagcugcacaagcucggaaaauguggcucuugcgucuacaacaugauggggaagagagaaaaaaagcugggcgaguuuggaaaggccaaaggcagccgggccaucugguacauguggcuuggggcucgcuaucuggaauucgaggcccucggauuucugaaugaggaucauugguucuccagagaaaacucuuacagcggcguggagggggaaggacugcacaagcucggcuauauucugcgggacaucuccaaaauucccgggggcgcuauguacgccgaugacacagcgggaugggacaccagaaucacagaggaugaccuucauaaugaagagaagaucacccagcagauggauccugagcaccggcaacuggccaacgcuauuuuuaaacucacauaucagaauaaggucgugaagguucagcgccccaccccgacgggcacagugauggacaucauuucuagaaaagaucagcgggggagcggacaagucggcaccuacgggcugaacaccuucacaaauauggaagcccagcuuauccgccagauggagggagaaggcgugcuguccaaggcugaccucgagaacccucaccugcccgaaaaaaagauuacccaguggcuggagacaaaagggguggagagacucaagcggauggccaucagcggcgaugacugcguugugaagcccaucgaugaccgcuuugcgaacgcccugcuugcucugaaugauaugggaaaagucagaaaggacauuccucaauggcagccgucuaaaggcuggcaugauuggcagcaggugcccuucuguucccaccauuuccacgaacucaucaugaaggacgggcggaaacugguugugccuugccgcccccaagacgagcuuauuggaagagcccggaucagccagggcgcuggguggucucugcgcgaaacggccugucucggaaaggcuuaugcccagauguggucccugauguacuuucacagacgggaucugcgccucgcgagcaacgccauuugcucugcugucccugugcauuggguccccaccuccagaacaaccuggagcauccacgcccaucaccaauggaugacaaccgaggacaugcugacgguguggaaucggguuuggauugaagauaacccuuggauggaggacaagacccccgugacaaccugggagaaugucccguaccuuggcaaaagagaagaucaguggugugggucccugaucggccucacaagccgcgccaccugggcucagaacaucccuacggccauucagcaagugcggucucugaucggaaaugaggaauuccuugacuauaugcccagcaugaagagauuucgcaaagaggaggaauccgagggcgcgauuugguga

SEQ ID NO: 20737 - RNA, 9873 nt, Artificial Sequence
  derived and/or modified CDS sequence (opt5) from DENV-3__FJ478456__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucgccgaaguugagcccgaagacauugauugcugguguaaccucacauccaccugggugacauauggaaccugcaaucaggccggcgagcacagacgggacaagcgcucuguggcucuggccccucaugucgggaugggacuggauacgagaacccaaacauggaugagcgcugagggcgccuggcggcagguggaaaaaguugagaccugggcgcuccgccaccccggcuucacaauccuggcccuuuuucuggcucauuacaucgggaccucccucacgcagaagguggucauuuucauccugcuuaugcuggugacaccuucuaugaccaugagauguguuggagugggcaaccgggacuuugucgaagggcucagcggagccacauggguggaugugguccuggagcacggcgggugcguuaccaccauggcuaagaauaaacccacacuggacauugagcuccagaagacggaagccacccaacuggcgacacuucgcaaacuguguaucgagggaaagauuaccaacaucacaaccgauuccagaugcccuacgcagggcgaagccgugcucccggaggaacaggaccagaauuauguguguaaacacacauacgucgaucggggcugggggaacggaugcggccuguucgggaagggaagccuugugaccugcgcuaaguuucaaugucuggagcccauugagggcaaaguugugcaguaugaaaaucucaaguacaccgucaucaucacagugcauaccggggaccagcaccagguuggaaacgagacacaaggcgugacggccgaaauuaccccucaggcuucuacaaccgaggccauccugcccgaauauggcacacuggggcucgagugcuccccucgcaccggacuggacuucaaugagaugauucuucugacgaugaaaaacaaggccuggaugguccauagacagugguuuuucgaucucccccugccguggaccagcggcgcuacaaccgaaacaccuaccuggaaucggaaagagcuucuggugacguuuaagaacgcgcacgccaaaaagcaagaagucgugguucucgggucucaggagggagcuaugcacacagcccugaccggcgccacagaaauccagaauuccgggggcaccagcauuuucgcuggacaucugaagugucgccucaaaauggacaagcuggagcuuaaaggcaugucuuacgccaugugcaccaacacauuugugcugaagaaagaggucuccgaaacgcagcacgggaccauccucaucaagguggaguacaagggagaagauguucccuguaaaauuccuuucagcacagaggacggccaagggaaggcgcauaacggaagacugaucaccgcuaaucccguggucacaaaaaaggaggaacccgugaacauugaggccgaaccuccguucggcgaguccaauaucgugauugggaucggcgauaacgcccugaaaaucaauugguauaagaagggaucuagcauuggcaaaauguuugaagcuaccgcccggggggcuagacgcauggccauccuuggagacacggcgugggauuucggcuccguugggggaguccucaacagccugggcaagauggugcaccagauuuuugggucugccuacacagcucuguucuccggcgugagcugggucaugaaaaucggaauuggcgugcuccugaccuggaucgggcuuaauucuaagaacaccagcauguccuuuucuugcauugccaucggaaucauuacacuguaucucggcgcuguugugcaggccgacaccgggugugucaucaauuggaaaggaaaggagcugaagugcggcagcgggauuuucgugacaaacgagguucauacguggaccgaacaguacaaauuucaagcggauucccccaagcggcuggccacagcuaucgccggcgcuugggagaauggaguguguggcauuagaagcaccacacgcauggaaaaccuucucuggaaacagaucgccaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgcugaaacacaaaacuccagcuucauuaucgauggaccuaauacccccgagugcccgucugcguccagagccuggaacgugugggaaguggaggacuauggcuuuggcgucuucacaaccaauaucuggcucaaacugcgcgaaguuuacacgcagcugugugaccaccggcuuaugagcgcugccgugaaggaugagagagccgugcacgcugacaugggguacuggauugagucccagaaaaacggaucuuggaagcucgaaaaagccagccugaucgaggucaagacaugcaccuggccuaagucccauacccuguggucuaauggcgugcucgaaagcgauaugauuauccccaaaucccuggcggggccuauuagccagcacaacuaucgccccggauaccauacacaaaccgcuggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgccggaucuggcaagguggacaacuucaccauggggguccugugccucgccauucuguuugaagaggugaugcggggaaaguucggcaaaaagcauaugaucgcuggcguuuucuuuacauucgugcuucugcucagcgggcagauuaccuggcgcgauauggcccacacacugaucaugauuggauccaaugcgagcgacagaaugggcaugggggucaccuaccuggcucuuaucgccacguuuaaaauccagcccuuccuggcccucggauuuuuccugcggaagcucacaucuagagaaaaccugcuucugggcguggggcucgcuauggccaccacacugcaacugccugaggauauugaacagauggcuaauggaaucgcccuuggccugauggcgcucaaacugauuacccaguuugagaccuaucagcucuggacagcccugaucucccuuacguguagcaacaccauuuucacacugaccguggcuuggcgcacagccacccucauccuggcuggcgucuccauccugccgguuugccaaucuagcuccaugcggaagucugacuggcuucccaugacgguggccgccaugggggugccuccccugccucucuuuauuuucagccugaaggauacacucaaaagacgcuccuggccccugaaugagggagucauggcugugggccuuguuucuauccuggcgagcucccugcucagaaacgacgugccuauggccgggccccuggucgcuggaggccuucugauugccuguuacgugaucaccgggaccagcgccgaucucacaguugaaaaggcugccgacgugaccugggaggaagaggcggaacagacaggagucucucauaaccugaugauuacgguggacgaugacggcaccaugcggaucaaagaugacgagacagagaauauccucaccguccugcuuaagacagcucugcugauuguguccggcaucuuuccguacagcauuccugccacccuccugguuuggcacacguggcagaaacagacccgcagaucuggggugcuuugggauguccccuccccucccgaaacacaaaaggccgagcuggaagagggaguguaucggaucaaacagcagggcauuuucgggaagacccagguuggagugggcguccaaaaggaggggguguuucauacaauguggcacgugacccgcggagcuguucucacauacaacggcaaaagacuggaaccgaauugggccagcgucaagaaagaccucaucucuuauggcgggggauggcggcuguccgcgcaguggcagaagggcgaggaagugcaagugauugcugucgagccugggaaaaaccccaagaauuuccagacgaugccuggaaccuuccagacaaccaccggcgaaaucggggccaucgcccuugauuuuaagcccggaacaagcggcucccccauuaucaaccgcgagggcaaagugguugggcuguacggaaauggcguggucacgaagaacgggggauaugugagcggcauugcucagaccaaugccgagccugacgggccgacacccgaacuggaggaagagauguucaaaaagagaaaccucaccaucauggaucugcacccuggcucuggaaaaacacggaaguaccuucccgcuauuguucgcgaagccaucaagagacggcugagaacccucauccuggcgccuacgcgcguggucgccgcugagauggaggaagcccucaaaggccugcccauucgguaucaaacaaccgcuaccaagagcgagcauacagggagagaaaucguggaccuuaugugccacgccaccuuuacaaugcgccugcuguccccuguucgggugccgaauuacaaccucauuaucauggaugaggcccauuucaccgaccccgcuucuauugcggccagaggauacaucagcacgcgcgucggcaugggggaagcugccgccaucuuuaugacagcuaccccucccggaacagccgaugcguucccucaguccaaugcucccauucaggacgaggagcgggacaucccggaaagaucuuggaacagcggcaaugaguggauuaccgauuuugccgggaaaacggugugguucgugccuuccaucaaggccggcaacgacauugcuaacugucugcgcaaaaauggaaagaaggucauccagcuuucucggaaaaccuuugauacagaauaucaaaagaccaaacugaacgacugggauuucguugugacaaccgacauuagcgagaugggcgccaauuuuaaggcggauagagugaucgacccccggcgcugccucaaacccgucauccugacagaugggccugagagagugauucuggccggacccaugccuguuaccgcugccuccgcugcccagcggcgcggcagaguggggcggaacccgcagaaggaaaaugaccaguacaucuucacgggacaaccccucaacaaugaugaggaccacgcucauuggacagaagccaagaugcuucuggacaacauuaauaccccugagggcaucauucccgcgcuguucgaaccugagagagagaaaagcgccgcuaucgauggggaauaucgccucaagggcgagucucggaaaaccuuugucgaacugaugagacgcggagaccuucccguguggcuggcccacaagguugcuuccgagggcaucaaauacacagaucggaaguggugcuucgacgggcagagaaacaaucagauucucgaagagaacauggauguggagaucuggaccaaagaaggagagaagaagaaacugcgcccgcgguggcuggacgccagaacauauagcgauccucucgcccuuaaggaauuuaaagacuucgcugcgggccgcaagucuauugcccuggaucuggucacggagaucgggagagugcccucccaccucgcucaucggacccgcaaugcccuggacaaccuugucaugcugcacacaagcgaacauggaggcaaagccuacagacacgcuguggaggagcucccugaaaccauggagacacugcugcuccuuggccugaugauucugcucaccgggggagccaugcuguuucuuaucuccggcaaggggaucggaaagacgucuauuggccugaucuguguuauugcgagcuccgggaugcucuggauggccgaaaucccccugcaguggauugcuagcgccaucgugcuggaguucuuuaugauggugcuccuuauuccugagcccgaaaaacaacggaccccgcaggauaaucagcuggcuuaugucguuaucggaauccugacacucgccgcgauuaucgccgcuaacgagaugggccugcuugaaaccacaaagcgcgaccugggcaugucuaaagagccugggguggugucccccaccagcuaccucgaugucgaccugcaccccgccucugcuuggacgcuguacgccguggcuacaaccguuauuacaccuaugcucagacauaccaucgaaaauagcaccgccaacgugucccuugcggccauugcuaaccaagccgucgugcugaugggacuggacaagggcuggccgaucucuaaaauggaucucggggucccccugcuugcucugggaugcuauagccaggugaauccucucacacugacggccgccguucugcuccuuaucacccacuacgcgauuaucggccccgggcugcaggcuaaggccacacgggaggcucagaagagaaccgccgccggaauuaugaaaaacccuacaguggacggcaucaugaccauugaucuggaccccgucaucuaugauuccaaguucgagaaacaacucggccaggugaugcugcuuguucugugugcugugcagcuccugcugaugcgcacgucuugggcccucugcgaagcgcuuacacuggccaccgggccuaucaccacacugugggagggaagcccgggcaaguuuuggaauaccacaauugcugucuccauggccaacaucuuccgggggagcuaccucgcuggagccggccuggcguuuucuauuaugaaauccguggggacgggaaagagaggcaccggcagccagggggaaacacuuggagagaaguggaaaaagaaacugaaucaacucucccgcaaggaauucgaccuguauaaaaagucuggcaucaccgagguggaucggacagaggccaaagaagggcugaagagaggagagauuacccaucacgcuguuagccggggcuccgccaagcuccagugguuugucgaacgcaacauggugauccccgaggggagagugauugaccuuggauguggccggggcggguggucuuacuauugcgcuggacugaaaaaggucacggaaguucgcggcuacaccaaagggggaccuggccaugaggagcccgugccuaugagcacauacggguggaauaucgugaagcugauguccggaaaagaugucuucuaucuccccccggaaaagugugacacccugcuuugcgauaucggcgagagcucuccuucccccacaguggaagagagcagaaccauucggguucugaagaugguggagcccuggcucaaaaacaaucaguucuguaucaagguccugaacccuuacaugcccacagugauugaacaccuggagcgccuccagagaaaacacggcgggaugcuuguucggaauccucugucucgcaacuccacccaugaaauguauuggaucagcaauggaacgggcaacauuguggccucugucaauauggugagcagacugcuccugaaccgguuuacaaugacccacagacgcccgaccaucgagaaggacguggaucuuggggcuggaacacggcaugucaacgccgaacccgagacgccuaauauggacguuaucggcgagagaauuaaacgcaucaaggaagagcacaacuccaccuggcacuacgacgaugaaaaucccuauaagacaugggcguaccaugggucuuaugaggugaaagccaccggaagcgcuuccagcaugauuaacggcguggucaagcugcucacaaaaccuugggacgugguucccauggugacccaaauggccaugacagauaccacgccguucggccagcagcgggucuuuaaggaaaaaguggacaccagaacaccucgcuccaugcccgggacccggagaguuaugggaaucacagcugaguggcuguggcgcacccugggccggaauaagaagccuagacucugcacgcgcgaggaauucacaaaaaaggugcggaccaacgccgccaugggggcggucuuuacagaggaaaaucaaugggauucugcuaaagccgccguggaggacgaagauuucuggaagcugguugacagagagcgcgagcuucacaaacugggaaaguguggcagcugcguguacaacaugauggggaaaagagaaaagaagcucggcgaguuuggaaaagcuaagggcucccgggccauuugguacauguggcugggggcucgcuaucuugaauucgaggcccugggauuucucaaugaggaucauugguucucuagagaaaacagcuacuccggcgucgagggggaaggacugcacaaacugggcuauauccuccgggacaucucuaagauucccgggggcgcgauguacgccgaugacaccgcuggaugggacacgagaaucaccgaggaugaccugcauaaugaagagaaaauuacacagcagauggauccugagcaccggcagcuugccaacgcuaucuuuaagcugaccuaucaaaauaagguggucaaagugcagcgccccacaccgaccggcacaguuauggacauuaucagcagaaaggaucagcggggguccggacaggugggcaccuacgggcucaacacguucacaaauauggaagcccaacugauccgccagauggagggagaaggcguccuuagcaaagcggaccuggagaacccucaccucucugaaaagaaaauuacccaguggcuggagaccaaggggguggagagacugaagcggauggccaucuccggcgaugacugcgugguuaaacccauugaugaccgcuuugcuaacgcccuccuggcucuuaaugauaugggaaaggugagaaaagacaucccccaguggcaaccuagcaagggcuggcaugauuggcagcaggucccguucuguucucaccauuuccacgaacugauuaugaaagacgggcggaagcucgugguucccugccgcccucaggacgagcugaucggaagagcccggauuucccaaggcgcuggguggagccuucgcgaaacagccugucugggaaaggcguaugcccagauguggucucucauguacuuucacagacgggaucugcgccuggcuuccaacgccaucugcagcgccgugcccguccauugggugccuaccuccagaacaacguggagcauccacgcucaucaccaguggaugaccacagaggacaugcucaccgucuggaaucggguguggauugaagauaaccccuggauggaggacaaaacaccuguuaccacgugggagaaugugcccuaccugggcaagagagaagaucaauggugugggucucuuaucggccugaccagccgcgccacaugggcgcagaacauuccgaccgcuauccagcagguccggucccucauuggaaaugaggaauuccuggacuauaugccuucuaugaaaagauuucgcaaggaggaggaaagcgagggcgccaucugguga

SEQ ID NO: 20738 - RNA, 9873 nt, Artificial Sequence
  derived and/or modified CDS sequence (opt5) from DENV-3__FJ547085__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcucggggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacacagggugugucaucaauuggaaaggaaaggagcugaagugcggcagcgggauuuucgugacgaacgagguucauaccuggacagaacaguacaaauuucaagccgauucccccaagcggcuggcgaccgccaucgcuggcgccugggagaauggaguguguggcauuagaagcacaacccgcauggaaaaccuucucuggaaacagaucgcuaaugagcugaacuauauccugugggaaaauaacauuaagcucacggucgugguuggggacaucauuggagugcuggagcagggcaaacggacccuuacaccucagcccauggagcugaaguacucuuggaaaaccugggggaaggccagaaucgucacagccgaaacccaaaacuccagcuucauuaucgauggaccuaauacacccgagugcccgaacaccucucgcgcuuggaaugugugggaaguggaggacuauggcuuuggcgucuucacgacaaacaucuggcucaagcugcgggaaguuuacacccagcugugugaccacagacuuauguccgcggccgugaaagaugagcgcgcugugcacgccgacaugggguacuggauugagagccagaagaauggauccuggaaacucgaaaaggccucucugaucgaggucaaaaccugcacauggccuaagagccauacccugugguccaacggcgugcucgaaucugauaugauuauccccaagagccuggcugggccuauuucccagcacaauuaucggcccggauaccauacgcaaacagccggcccuuggcaccuugggaaacuggagcucgacuuuaacuauugcgagggaaccacaguugugaucaccgaaaauuguggcacaagaggccccagccugcgcaccacgaccgucucugggaagcugauccacgaguggugcugucgguccugcacacuuccgccucucagauacaugggagaagauggcuguugguaugggauggagauucggcccaucagcgaaaaagaggagaacauggugaagucucugguuuccgcgggaagcggcgaaguggacaauuucaccauggggguccugugccucgcuauucuguuugaggaagugaugcgcggaaaauucggcaagaagcauaugaucgccggcguuuucuuuacauucgugcuucugcucucugggcagauuaccuggagagauauggcccacacgcugaucaugauuggaagcaacgcuacagaccggaugggcaugggggucaccuaccuggcccuuaucgcgacauuuaaaauccagcccuuccuggcucucggauuuuuccugagaaagcucaccucccgcgagaaucugcuucugggcguggggcucgccauggccaccacacugcaacugccugaagauauugagcagauggcuaacggaaucgcccuuggccugauggcucucaaacugauuacgcaguuugagaccuaucagcucuggacagcccugaucagccuuaccuguucuaauacaauuuucacccugacgguggcguggcggacagccacccucauccuggcuggcgucucccugcuuccgguuugccaaagcuccucuaugagaaagaccgacuggcugcccaugacaguggccgcuaugggggugccuccccucccucuguuuaucuucagccucaaagauacccugaagcgcagauccuggccccuuaacgaaggagucauggccgugggccugguuucuauucuggccagcucccuccugcggaacgacgugccuauggcugggccccuugucgcgggaggccugcucaucgccuguuacgugauuacagggacgucugcugaucugaccguugagaaggccgccgacgugacaugggaagaggaagcugagcagaccggagucagccauaaucucaugaucacaguggacgaugacggcaccaugcgcauuaaagaugacgagacggaaaacauccugaccguccuucugaagacagcccugcucaucguguccggcauuuuuccguacagcaucccugcgacccugcuuguuuggcacacauggcagaaacagacccaaagaucuggggugcugugggauguccccuccccucccgagacacagaaggcugaacucgaggagggaguguaucggauuaaacagcagggcaucuucgggaagacgcaaguuggagugggcguccagaaagaagggguguuucauaccauguggcacgugacacgcggagccguucugaccuacaauggcaagagacucgagccgaacugggccagcgucaagaaagaccugauuucuuauggcgggggauggcggcuuuccgcucaguggcaaaagggcgaagaggugcaggugaucgccgucgaaccugggaaaaaucccaagaacuuccagaccaugccuggaacauuccagacgaccacaggcgagauuggggcgaucgcucuggauuuuaaacccggaaccagcggcucucccaucauuaaucgcgagggcaaggugguugggcuguacggaaacggcguggucacaaagaaugggggauauguguccggcaucgcccaaaccaacgccgaaccugacgggccgacgcccgagcucgaagaggaaauguucaaaaagagaaaucugacaauuauggaucuucacccuggcagcggaaaaacccggaaguaccugcccgcuaucguucgcgaggccauuaaaagacggcucagaacccugauccucgcuccuacacgcguggucgccgcggagauggaagaggcccugaagggccuucccauccgguaucagaccacagcuaccaaguccgaacauacggggagagagauuguggaccugaugugccacgccacauuuaccaugcgccugcucagcccuguucgggugccgaacuacaaucugaucauuauggaugaagcucauuucacagaccccgccucuaucgccgcuagaggauacauuagcacccgcgucggcaugggggaggcggccgcuaucuuuaugacggccaccccucccggaacagccgaugcuuucccucaguccaacgcccccauccaggacgaggaacgggacauuccggagagaucuuggaauagcggcaacgaauggaucaccgauuuugcggggaaaacagugugguucgugccuuccauuaaggcuggcaacgacaucgccaauugucuucgcaaaaacggaaagaaagucauucaacugucucggaagaccuuugauacagaguaucagaagaccaaacucaaugacugggauuucguugugacgacagacaucagcgagaugggcgccaacuuuaaggcugauagagugauugacccccggcgcugccugaaacccgucauccugaccgaugggccugaaagagugauccucgccggacccaugccuguuaccgcggccuccgcugcccagcggcgcggcagaguggggcggaauccgcagaaggagaacgaccaauacauuuucacaggacagccccuuaauaacgaugaagaccacgcucauuggaccgaggccaaaaugcugcuggacaauaucaacacaccugaaggcauuauccccgcucucuucgagccugagagagaaaagucugccgcgauugauggggaguaucgccugaagggcgaaagccggaaaacguuugucgagcuuaugagacgcggagaccugcccguguggcucgcccacaagguugcuuccgaaggcaucaaauacaccgaucggaaguggugcuucgacgggcagagaaauaaccagauccuggaggagaauauggauguggaaauuuggacaaaagagggagaaaagaaaaagcugcgcccgcgguggcucgacgccagaaccuauagcgauccucuugcucugaaggaguuuaaagacuucgccgccggccgcaagucuaucgcucuggaucucgucacagaaauugggagagugcccacccaccuggcgcaucggacgcgcaacgcccuugacaaucuggucaugcuccacaccuccgagcauggaggcaaagcuuacagacacgccguggaggaacugccugagacaauggaaacccugcuccuucugggccugaugauccuccugacagggggagccaugcuuuuucugauuagcggcaaggggaucggaaaaaccucuaucggccucauuuguguuaucgcuuccagcgggaugcuguggauggccgagauuccccugcaauggaucgcguccgccauugugcucgaguucuuuaugauggugcuucugaucccugaacccgagaagcagcggacgccgcaggauaaccaacuggcuuaugucguuauuggaauccucacacuggccgcuaucauugccgcgaaugaaaugggccuucuggagaccacaaagcgcgaccucggcaugucuaaagaaccugggguggugagccccaccuccuaccuggaugucgaccugcaccccgccagcgcuuggacccucuacgccguggcuacaacgguuaucaccccuaugcuuagacauacaauugagaacucuaccgccaacgugucccuggcugccaucgcgaaucaggccgucgugcugaugggacucgacaagggcuggccgauuagcaaaauggaucugggggucccccuucuggcucucggaugcuauucucaggugaacccucugacacugaccgccgcuguucuccuucugaucacgcacuacgccaucauuggccccgggcugcaggccaaggcgacacgggaggcucaaaaaagaaccgccgcuggaaucaugaagaauccuaccguggacggcauuaugacaaucgaucucgaccccgucauuuaugauagcaaguucgaaaaacagcugggccaggugaugcuucugguucucugugccgugcagcugcugcucaugcgcaccuccugggcccuuugcgaggcucugacacuggccacggggccuaucaccacacucugggaaggaucuccgggcaaguuuuggaacaccacaaucgcggucagcauggccaauauuuuccggggguccuaccuggcuggagccggccuugcuuuuucuaucaugaaaagcguggggaccggaaagagaggcacgggcucccaaggggagacccugggagaaaaauggaagaagaaacucaaccagcugagccgcaaggaguucgaccuguauaaaaagucuggcauuacagagguggaucggaccgaagccaaagaggggcucaagagaggagaaaucacacaucacgcgguuucccggggcaccgccaaacuucagugguuugucgagcgcaauauggugauucccgaagggagagugaucgaccugggauguggccggggcggguggagcuacuauugcgcuggacugaagaaggucacagagguucgcggcuacaccaaagggggaccuggccaugaggaacccgugccuauguccacguacggguggaacauugugaagcucaugucuggaaaagaugucuucuaucugcccccggagaagugugacacacuucugugcgauaucggcgaaagcuccccuucucccaccguggaggagagcagaaccauccggguucucaaaaugguggaacccuggcugaagaauaaccaguucuguauuaagguccugaauccuuacaugcccgccgugaucgagcaccucgaacgccuucaaagaaaacacggcgggaugcugguucggaacccucugucccgcaauagcacacaugagauguauuggauuucuaacggaacgggcaauaucguggcuuccgucaacauggugagcagacuccugcuuaaccgguuuaccaugacacacagacgcccgaccauugaaaaggacguggaucugggggccggaacacggcaugucaaugcugagcccgagaccccuaacauggacguuaucggcgaaagaaucaaacgcauuaaggaggaacacaauucuacauggcacuacgacgaugagaaccccuauaaaaccugggccuaccauggguccuaugaagugaaggcgacgggaagcgccucuagcaugaucaauggcguggucaagcuccugaccaaaccuugggacgugguucccauggugacacagauggcuaugaccgauacaaccccguucggccagcaacgggucuuuaaggagaaaguggacacgagaacaccucgcuccaugcccgggacccggagaguuauggagauuacagccgaauggcuguggcgcacccucggacggaacaagaaaccuagacugugcacgcgcgaggaauucaccaagaaggugcggacaaaugcugccaugggcgccgucuuuaccgaggaaaaccagugggauucugcgaaagcugccguggaggacgaggauuucuggaagcuuguugacagagaacgcgagcugcacaaacucgggaaguguggaagcugcguguacaauaugaugggcaaaagagaaaagaaacugggggaguuuggcaaggccaagggaucccgggcuaucugguacauguggcuuggcgcccgcuaucuggaguucgaagcucucggguuucugaacgaggaucauugguucagcagagaaaauuccuacucuggagucgagggcgaagggcugcacaaacucggauauauucugcgggacaucagcaagauccccggcggggccauguacgcggaugacacagccggcugggacaccagaauuacagaggaugaccuucauaacgaggaaaaaaucacccagcagauggauccugagcaccggcaacuggcuaaugccauuuuuaagcucacguaucagaacaaaguggucaaggugcagcgccccacaccgaccggaaccguuauggacaucauuuccagaaaggaucagcggggcucugggcaagugggaacauacggccugaauaccuucacaaacauggaagcucagcuuauccgccagauggagggggaaggaguccugagcaaagccgaccucgagaacccucaccugcccgagaagaaaaucacgcaguggcuggaaaccaagggcguggagagacucaaacggauggcgauuuccggggaugacugcgugguuaagcccaucgaugaccgcuuugccaaugcucugcuugcccugaacgauaugggcaaggugagaaaagacauuccucaauggcagccgucuaagggauggcaugauuggcagcagguccccuucuguagccaccauuuccacgaacucaucaugaaagacggccggaagcuggugguuccuugccgcccccaagacgagcuuauugggagagcucggaucucccagggagccggcuggagccugcgcgaaacagcuugucucgggaaagccuaugcgcagauguggucucugauguacuuucacagacgggaucugcgccucgccuccaaugcuauuugcagcgccgugccuguccauugggugcccaccucuagaacaaccugguccauccacgcccaucaccaauggaugacgaccgaggacaugcugacagucuggaaccggguguggaucgaggauaauccuuggauggaagacaagacccccguuacaaccugggagaacgugccguaccuuggaaagagagaagaucagugguguggcagccugauugggcucacgucucgcgcuacaugggcccagaauaucccuaccgcgauucagcaaguccggucccugaucggcaacgaggaguuccuugacuauaugcccagcaugaaaagauuucgcaaggaagaggaauccgagggagcuauuugguga

SEQ ID NO: 20739 - RNA, 9873 nt, Artificial Sequence
  derived and/or modified CDS sequence (opt5) from DENV-3__EU482595__SS-prME
accagccugugccucaugaugaugcugcccgccgcucuugccuuccaccugacaucccgggacggcgaaccucggaugaucguggggaagaacgaacgcggaaaaucucuccuguuuaagacggcgagcggcauuaauauguguacccuuaucgcuauggaucugggggaaaugugcgacgauacagugaccuacaaauguccgcacauuacagaaguugaacccgaagacaucgauugcugguguaaccucaccuccacaugggugaccuauggaacgugcaaucaggccggcgaacaccggcgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauucuggcgcuuuuucuggcccauuacguggggacgucccucacacagaaggucgugaucuucauccugcuuaugcugguuaccccuucuaugacaaugagaugugugggagucggcaaccgggacuuuguggaagggcucagcggagcuaccuggguggaugucguucuggagcacggcgggugcgugaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuaugucuguaaacacaccuacguggaucggggcugggggaacggaugcggccuguucgggaagggaagccuuguuaccugcgccaaguuucaaugucuggagcccauugagggcaaagugguccaguaugaaaaucucaaguacacagugaucauuaccguucauacaggggaccagcaccaggugggaaacgagacgcaaggcgucaccgcugaaaucacaccucaggccucuaccacagaggcuauccugcccgaauauggcacccuggggcucgagugcuccccucgcacgggacuggacuucaaugagaugauucuucugaccaugaaaaacaaggccuggauggugcauagacagugguuuuucgaucucccccugccguggacaagcggcgccaccacagaaaccccuacguggaaucggaaagagcuucuggucacauuuaagaacgcucacgcgaaaaagcaagaagugguugugcucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuuguccugaagaaagagguguccgaaacccagcacgggacaauccucauuaagguugaguacaagggagaagaugugcccuguaaagucccuuucagcaccgaggacggccaagggaaggcccauaacggaagacugaucacagcgaaucccguggugaccaaaaaggaggaacccguuaacaucgaggcugaaccuccguucggcgaguccaauauugucaucgggauuggcgauaacgcccugaaaaucaauugguauaagaagggaucuagcauuggcaaaauguuugaagccacggcuagaggggccagacgcauggcuauccuuggagacacagccugggauuucggcuccgucgggggagugcucaacagccugggcaagaugguccaccagaucuuugggucugcguacaccgcccuguucuccggcgugagcuggguuaugaaaauuggaaucggcgugcuccugaccuggauugggcuuaauucuaagaacacaagcauguccuuuucuugcaucgucauuggaaucauuacccuguaucucggcgcugugguucaggccgacauggggugugugaucaauuggaaaggaaaggagcugaagugcggcagcgggaucuucgucacaaacgaggugcauacguggaccgaacaguacaaauuucaagcugauucccccaagcggcuggccacagcgauugccggcgcuugggagaauggaguuuguggcaucagaagcaccacacgcauggaaaaccuucucuggaaacagauugccaaugagcugaacuauauccugugggaaaauaacauuaagcucaccguggucgugggggacaucaucggagugcuggagcagggcaaacggauucuuacgccucagcccauggagcugaaguacucuuggaaaaccugggggaaggcuaagaucgucacagccgaaacccaaaacuccagcuucauuaucgauggaccuaauacacccgagugcccgucugccuccagagcuuggaacguuugggaaguggaggacuauggcuuuggcguguucagcaccaauauuuggcucaaacugcgcgaagucuacacacagcugugugaccaccggcuuauguccgcggccgugaaggaugagagagcuguucacgccgacaugggguacuggaucgagucucagaaaaacggaagcuggaagcucgaaaaagccucccugaucgaggugaagaccugcacguggccuaagucucauacacuguggagcaauggcguccucgaauccgauaugauuauccccaaaagccuggcugggccuauuucucagcacaacuaucgccccggauaccauacccaaaccgccggcccuuggcaccuugggaagcuggagcucgacuuuaauuauugcgagggaacaaccgugguuaucacggaaaacuguggcacacggggccccucccugagaaccacaaccgugagcgggaaacugauucacgaguggugcugucgcucuugcacacuuccgccucuccgguacaugggagaagauggcuguugguaugggauggagaucagacccaucuccgaaaaggaggagaauauggucaaaagccuggugucugcgggaagcggcaagguugacaacuucaccaugggggugcugugccucgcuauucuguuugaagaggucaugcggggaaaguucggcaaaaagcauaugaucgccggcguguucuuuacguucgugcuucugcucuccgggcagauuaccuggcgcgauauggcccacacacugaucaugauuggaagcaaugcuucugacagaaugggcaugggggucaccuaccuggcccuuaucgcgacauuuaaaauucagcccuuccuggcucucggauuuuuccugcggaagcucaccuccagagaaaaccugcuucugggcguugggcucgccauggccacgacacugcaacugccugaggauaucgaacagauggcuaauggaaucgcccuuggccugauggcucucaaacugauuacccaguuugagacauaucagcucuggaccgcccugaucagccuuaccuguuccaacacaauuuucacgcugaccguggcguggcgcacagccacccucauccuggcuggcgugucucugcuuccggucugccaaagcuccucuaugcggaagacagacuggcugcccaugaccguggccgcuauggggguuccuccccucccucuguuuauuuucagccucaaggauacgcugaaaagacgcuccuggccccuuaaugagggagugauggccgucggccuggugucuauccuggccagcucccuccugagaaacgacguuccuauggcugggccccuuguggcgggaggccugcucaucgccuguuacgucauuacagggaccagcgcugaucugaccguggaaaaggccgccgacgucacaugggaggaagaggcugaacagaccggagugucucauaaccucaugaucacaguugacgaugacggcacgaugcggauuaaagaugacgagaccgagaauauccugacagugcuucugaagaccgcccugcucauugucuccggcaucuuuccguacagcaucccugcgacacugcuuguguggcacaccuggcagaaacagacgcaacgcucugggguucugugggaugugcccuccccucccgaaacccagaaggcugagcucgaagagggagucuauagaauuaaacagcagggcaucuucgggaagacacaagugggagugggcguucagaaggagggggucuuucauaccauguggcacgugacacggggagccgugcugaccuacaacggcaaacgccucgaaccgaauugggccagcgucaagaaagaccugauuucuuauggcgggggauggagacuuuccgcucaguggcaaaagggcgaggaagugcagguuaucgccguggagccugggaaaaaccccaagaauuuccagacaaugccuggaacguuccagaccacaaccggcgaaauuggggcgaucgcucuggauuuuaagcccggaaccagcggcucccccauuaucaaccgggagggcaaagucguggggcuguacggaaauggcguugugacaaagaacgggggauaugucagcggcaucgcccaaacgaaugccgagccugacgggccggcucccgaacucgaggaagagauguucaaaaagcgcaaccugaccauuauggaucuucacccuggcucuggaaaaacaagaaaguaccugcccgccaucgugcgggaagcuauuaagcgcagacuccggacccugauccucgccccuacaagaguuguggcggccgagauggaggaagcucugaaaggccuucccauucgcuaucagaccacggccacaaagagcgagcauaccgggcgggaaaucgucgaccugaugugccacgcuaccuuuacaaugagacugcucuccccugugcgcgugccgaauuacaaccugaucauuauggaugaggcccauuucaccgaccccgccucuaucgcugcgcggggauacauuagcacaagagucggcaugggggaagccgcugccaucuuuaugaccgccacgccucccggaacagcugaugccuucccucaguccaaugcgcccauucaggacgaggagcgcgacaucccggaacggucuuggaacagcggcaaugaguggaucaccgauuuugcugggaaaacaguuugguucgugccuuccauuaaggccggcaacgacaucgccaacugucuucgcaaaaauggaaagaaggugauucaacugucuagaaaaaccuuugauacggaauaucagaagaccaaacucaacgacugggauuucgucgugacaaccgacaucagcgagaugggcgcuaauuuuaaggccgaucggguuauugaccccagacggugccugaaacccgugauccugacagaugggccugagcgcgucauucucgcgggacccaugccugugaccgccgcuuccgccgcucagagacggggccgcguugggagaaacccgcagaaggaaaaugaccaauacaucuucacaggacagccccuuaacaaugaugaggaccacgcccauuggaccgaagcuaagaugcugcuggacaacaucaauacgccugagggcauuauccccgcccucuucgaaccugagcgggagaaaagcgcggccauugauggggaauauagacugaagggcgagucucgcaaaacauuuguggaacuuaugcggagaggagaccugcccgucuggcucgcucacaagguggccuccgagggcaucaaauacaccgaucgcaaguggugcuucgacgggcagcggaacaaucagauucuggaagagaacauggaugucgagaucuggaccaaagaaggagagaagaagaaacugagaccgcgcuggcucgacgcucggacauauagcgauccucuugcccugaaggaauuuaaagacuucgccgcuggcagaaagucuaucgcgcuggaucucgugaccgagauugggcgcguucccucccaccuggcccauagaacacggaaugcucuugacaaccuggugaugcuccacacgagcgaacauggaggcaaagccuaccgccacgccguggaggagcugccugaaaccauggagacacugcuccuucugggccugaugauccuccugaccgggggagcuaugcuuuuucugauuuccggcaaggggaucggaaagacaucuauuggccucaucugugucaucgccagcuccgggaugcuguggauggcggaaauuccccugcaauggaucgccagcgcuauuguucucgaguucuuuaugauggugcuucugaucccugagcccgaaaaacagagaaccccgcaggauaaucaacuggccuauguggucauuggaauccucacgcuggcugccauuaucgcggccaacgagaugggccuucuggaaaccacaaagcgggaccucggcaugucuaaagagccuggggugguuucccccaccagcuaccuggauguggaccugcaccccgcuucugccuggacacucuacgcugucgccaccacggugaucacaccuaugcuucgccauaccauugaaaauagcacagcuaacgucucccuggccgcgaucgccaaccaggcugugguucugaugggacucgacaagggcuggccgauuucuaaaauggaucugggggugccccuucuggcccucggaugcuauagccaggucaauccucugacccugaccgcugccgugcuccuucugaucacacacuacgccauuaucggccccgggcugcaggcgaaggcuacgagagaggcccaaaagcggaccgcugccggaaucaugaaaaacccuacaguugacggcauuaugaccaucgaucucgaccccgugauuuaugauuccaaguucgagaaacagcugggccaggucaugcuucuggugcucugugccgugcagcugcugcucaugagaacaucuugggcucuuugcgaagcccugacccuggcgacggggccuaucacaacccucugggagggaagcccgggcaaguuuuggaauaccacaauugccguuuccauggcuaacaucuuccgcgggagcuaccuggccggagcuggccuugccuuuucuaucaugaaauccgucgggaccggaaagcggggcacaggcagccaaggggaaacgcugggagagaaguggaaaaagaaacucaaucagcuguccagaaaggaguucgaccuguauaaaaagucuggcauuaccgagguggaucgcacagaggcgaaagaagggcucaagcggggagagaucacccaucacgccgugagcagaggcuccgcuaaacuucagugguuugucgaacggaacaugguuauucccgaggggcgcgugaucgaccugggauguggcagaggcggguggucuuacuauugcgccggacugaaaaaggugacagaaguccggggcuacaccaaagggggaccuggccaugaggagcccgugccuaugagcacguacggguggaauauuguuaagcucauguccggaaaagauguguucuaucugcccccggaaaagugugacacccuucugugcgauaucggcgagagcucuccuucccccacagucgaagagagccgcaccauuagagugcucaagaugguugagcccuggcugaaaaacaaucaguucuguaucaaggugcugaacccuuacaugcccacagucaucgaacaccucgagcggcuucaacgcaaacacggcgggaugcuggugagaaauccucugucucggaacuccacccaugaaauguauuggauuagcaauggaacaggcaacaucguggcuucugucaauaugguuagccgccuccugcuuaacagauuuaccaugacgcaccggagaccgacaauugagaaggacguggaucugggggccggaacccgccaugugaacgcugaacccgagaccccuaauauggacgucaucggcgagcggauuaaaagaaucaaggaagaacacaacuccacauggcacuacgacgaugaaaaucccuauaagacgugggccuaccaugggucuuaugaggugaaagcgaccggaagcgccuccagcaugaucaacggcguugugaagcuccugacaaaaccuugggacgucgugcccaugguuacccagauggcuaugacagauaccacaccguucggccagcaacgcguguuuaaggaaaaagucgacacccggacgccuagauccaugcccgggacccgccgggugaugggaauuacagccgaguggcuguggagaacccucggccgcaauaagaagccucggcugugcacaagagaggaguucaccaaaaagguucgcacgaacgcugccaugggggccguguuuacagaggaaaaucagugggauucugcgaaagcugccgucgaggacgaagauuucuggauccuuguggaccgggagagagagcugcacaagcucggaaaauguggcagcugcgucuacaacaugauggggaagcgcgagaagaagcugggcgaguuuggaaaggccaaaggcuccagagcuauuugguacauguggcuuggggcccgguaucuggaguucgaggcucucggauuucugaaugaggaucauugguucucucgcgaaaacagcuacuccggcguggagggggaaggacugcacaagcucggcuauauccugagagacauuucuaaaauccccgggggcgccauguacgcggaugacaccgccggaugggacacacggaucaccgaggaugaccuucauaaugaagagaagauuacgcagcagauggauccugagcacagacaacuggcuaacgccaucuuuaaacucaccuaucagaauaagguugugaagguccagcggcccacaccgaccggcacagugauggacauuaucagccgcaaagaucagagaggguccggacaagugggcaccuacgggcugaacacauucaccaauauggaagcucagcuuauucggcagauggagggagaaggcguucugagcaaggccgaccucgagaacccucaucugcccgagaaaaagaucacgcaguggcuggagacaaaagggguggagcgccucaagagaauggcgaucucuggcgaugacugcgucgugaagcccauugaugaccgguuugccaacgcucugcuugcccugaaugauaugggaaaaguucgcaaggacaucccucaauggcagccguccaaaggcuggcaugauuggcaacaggugcccuucuguagccaccauuuccacgaacucauuaugaaggacgggagaaaacuggucgugccuugccggccccaagacgagcuuaucggacgcgcuagaauuucucagggcgccggguggucccugcgggaaaccgcuugucucggaaaggccuaugcgcagauguggagccugauguacuuucaccgcagagaucugcggcucgccucuaacgcuaucugcuccgccgucccugugcauuggguucccaccagccgcacaaccugguccauucacgcccaucaccaauggaugacaacggaggacaugcugaccguguggaauagagucuggaucgaagauaacccuuggauggaggacaagacacccgugaccacaugggagaauguuccguaccuuggcaaacgggaagaucaguggugugggagccugaucggccucaccucuagagcuacgugggcccagaacauuccuaccgcgauccagcaagugcgcagccugauuggaaaugaggaguuccuugacuauaugcccuccaugaagcgguuuagaaaagaggaggaaucugagggcgcuaucugguga

SEQ ID NO: 20740 - RNA, 9873 nt, Artificial Sequence
  derived and/or modified CDS sequence (opt5) from DENV-3__EU482596__SS-prME
accagccugugccucaugaugauccugcccgccgcucuugccuuccaccugacgucccgggacggcgaaccucggaugauuguggggaagaacgaacgcggaaagucucuccuguuuaagacggcgagcggcaucaauauguguacccuuauugcuauggaucugggggaaaugugcgacgauacagugaccuacaaguguccgcacaucacagaaguugaacccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcaagguggacaacuucaccauggggguccugugccucgccauucuguuugaagaggugaugcggggaaaguucggcaaaaagcauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaaaauccagcccuuccuggcccucggauuuuuccugcggaagcucacaucuagagaaaaccugcuucugggcguggggcucgccauggcuaccacacugcaacugccugaggauauugaacagauggccaauggaaucgcucuuggccugauggcccucaaacugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaagacggacuggcugcccaugacaguggcugccaugggggugccuccccucccucuguuuaucuucucucucaaggauacccugaaaagacgcagcuggccccuuaaugagggagucauggccgugggccugguuuccauucuggcuucuagccuccugagaaacgacgugccuauggcggggccccuugucgccggaggccugcucaucgcuuguuacgugauuaccgggacauccgccgaucugaccguugaaaaggccgcugacgugacaugggaggaagaggccgaacagacgggagucagccauaaccucaugaucaccguggacgaugacggcacaaugcggauuaaagaugacgagaccgagaauauccugacaguccuucugaagaccgcgcugcucaucgugucuggcauuuuuccguacuccaucccugcuacgcugcuuguuuggcacaccuggcagaaacagacacaacgcagcggggugcugugggauguccccucuccucccgaaacccagaaggccgagcucgaagagggaguguauagaauuaaacagcagggcaucuucgggaagacacaaguuggagugggcguccagaaggaggggguguuucauaccauguggcacgugacacggggagccguucugacguacaacggcaaacgccucgaaccgaauugggcuuccgucaagaaagaccugauuagcuauggcgggggauggagacuuucugcccaguggcaaaagggcgaggaaguccaggugaucgcggucgagccugggaaaaaccccaagaauuuccagaccaugccuggaacauuccagaccaccacaggcgaaauuggggcuaucgcccuggauuuuaagcccggaacguccggcagccccaucauuaaccgggagggcaaagugguugggcuguacggaaauggcguggucaccaagaacgggggauauguguccggcaucgcccaaacaaaugcugagccugacgggccgacccccgaacucgaggaagagauguucaaaaagcgcaaccugacaauuauggaucuucacccuggcagcggaaaaaccagaaaguaccugcccgccaucguucgggaagcuauuaagcgcagacuccggacgcugauccucgccccuacaagaguggucgcggccgagauggaggaagcucugaaaggccuucccauccgcuaucagaccaccgccacaaagucugagcauaccgggcgggaaauuguggaccugaugugccacgcuacauuuaccaugagacugcucagcccuguucgcgugccgaauuacaaccugaucauuauggaugaggcccauuucacggaccccgccuccaucgcugcgcggggauacauuucuacaagagucggcaugggggaagccgcugccaucuuuaugaccgccacaccucccggaaccgcugaugccuucccucagagcaaugcgcccauccaggacgaggagcgcgacauuccggaacgguccuggaacucuggcaaugaguggaucacggauuuugcugggaaaaccgugugguucgugccuagcauuaaggccggcaacgacaucgccaacugucuucgcaaaaauggaaagaaggucauucaacuguccagaaaaacauuugauaccgaauaucagaagacaaaacucaacgacugggauuucguugugaccacagacaucucugagaugggcgcuaauuuuaaggccgaucgggugauugaccccagacggugccugaaacccgucauccugaccgaugggccugagcgcgugauccucgcgggacccaugccuguuacggccgcuagcgccgcucagagacggggccgcguggggagaaacccgcagaaggaaaaugaccaauacauuuucacaggacagccccuuaacaaugaugaggaccacgcccauuggaccgaagcuaagaugcugcuggacaacaucaauaccccugagggcauuauccccgcccucuucgaaccugagcgggagaaauccgcggccauugauggggaauauagacugaagggcgagagccgcaaaacauuugucgaacuuaugcggagaggagaccugcccguguggcucgcucacaagguugccucugagggcaucaaauacaccgaucgcaaguggugcuucgacgggcagcggaacaaucagauccuggaagagaacauggauguggagauuuggacaaaagaaggagagaagaagaaacugagaccgcgcuggcucgacgcucggacguauuccgauccucuugcccugaaggaauuuaaagacuucgccgcuggcagaaagagcaucgcgcuggaucucgucaccgagauugggcgcgugcccucucaccuggcccauagaacacggaaugcucuugacaaccuggucaugcuccacaccuccgaacauggaggcaaagccuaccgccacgccguggaggagcugccugaaacaauggagacccugcuccuucugggccugaugauccuccugacagggggagcuaugcuuuuucugauuagcggcaaggggaucggaaagaccuccaucggccucauuuguguuaucgccucuagcgggaugcuguggauggcggaaauuccccugcaauggaucgccuccgcuauugugcucgaguucuuuaugauggugcuucugaucccugagcccgaaaaacagagaacaccgcaggauaaucaacuggccuaugucguuauuggaauccucacccuggcugccaucauugcggccaacgagaugggccuucuggaaacaaccaagcgggaccucggcaugagcaaagagccugggguggugucucccacguccuaccuggaugucgaccugcaccccgcuagcgccuggacacucuacgcuguggccaccacaguuaucaccccuaugcuucgccauaccauugaaaauucuacagcuaacgugagccuggccgcgaucgccaaccaggcugucgugcugaugggacucgacaagggcuggccgauuuccaaaauggaucugggggucccccuucuggcccucggaugcuauucucaggugaauccucugacgcugaccgcugccguucuccuucugaucacacacuacgccaucauuggccccgggcugcaggcgaaggcuaccagagaggcccaaaagcggacagcugccggaaucaugaaaaacccuaccguggacggcauuaugacgaucgaucucgaccccgucauuuaugauagcaaguucgagaaacagcugggccaggugaugcuucugguucucugugccgugcagcugcugcucaugagaacauccugggcucuuugcgaagcccugacccuggcgaccgggccuaucacaacccucugggagggaucuccgggcaaguuuuggaauacaacgaucgccgucagcauggcuaacauuuuccgcggguccuaccuggccggagcuggccuugccuuuagcaucaugaaaucuguggggaccggaaagcggggcacaggcucccaaggggaaacccugggagagaaguggaaaaagaaacucaaucagcugagcagaaaggaguucgaccuguauaaaaaguccggcauuacagagguggaucgcaccgaggcgaaagaagggcucaagcggggagagaucacgcaucacgccguuucuagaggcagcgcuaaacuucagugguuugucgaacggaacauggugauucccgaggggcgcgugaucgaccugggauguggcagaggcgggugguccuacuauugcgccggacugaaaaaggucaccgaaguucggggcuacacaaaagggggaccuggccaugaggagcccgugccuaugucuaccuacggguggaauauugugaagcucaugagcggaaaagaugucuucuaucugcccccggaaaagugugacacacuucugugcgauaucggcgaguccagcccuucucccaccguggaagagucccgcacaaucagaguucucaagaugguggagcccuggcugaaaaacaaucaguucuguauuaagguccugaacccuuacaugcccaccgugaucgaacaccucgagcggcuucaacgcaaacacggcgggaugcugguuagaaauccucugagccggaacucuacgcaugaaauguauuggauuuccaauggaacaggcaacaucguggcuagcgucaauauggugucucgccuccugcuuaacagauuuaccaugacccaccggagaccgacaauugagaaggacguggaucugggggccggaacgcgccaugucaacgcugaacccgagaccccuaauauggacguuaucggcgagcggaucaaaagaauuaaggaagaacacaacagcacauggcacuacgacgaugaaaaucccuauaagaccugggccuaccauggguccuaugaggugaaagcgacaggaucugccagcuccaugaucaacggcguggucaagcuccugaccaaaccuugggacgugguucccauggugacacagauggcuaugaccgauacgaccccguucggccagcaacgcgucuuuaaggaaaaaguggacacacggaccccuagaagcaugcccgggacacgccggguuaugggaauuaccgccgaguggcuguggagaacgcucggccgcaauaagaagccucggcugugcacaagagaggaguucaccaaaaaggugcgcacaaacgcugccaugggggccgucuuuaccgaggaaaaucagugggauuccgcgaaagcugccguggaggacgaagauuucuggaaacuuguugaccgggagagagagcugcacaaacucggaaaguguggcucuugcguguacaacaugauggggaaacgcgaaaagaagcugggcgaguuuggaaaagccaagggcagcagagcuaucugguacauguggcuuggggcccgguaucuggaguucgaggcucucggauuucugaaugaggaucauugguucucccgcgaaaacucuuacagcggcgucgagggggaaggacugcacaaacucggcuauauucugagagacaucuccaagauccccgggggcgccauguacgcggaugacacggccggaugggacacccggauuacagaggaugaccuucauaaugaagagaaaaucacccagcagauggauccugagcacagacaacuggcuaacgccauuuuuaagcucacauaucagaauaagguggucaaagugcagcggcccaccccgacaggcaccguuauggacaucauuucucgcaaggaucagagagggagcggacaagugggcacguacgggcugaacacauucaccaauauggaagcucagcuuauccggcagauggagggagaaggcguccuguccaaagccgaccucgagaacccucaucugcccgaaaagaaaaucacccaguggcuggagacaaaggggguggagcgccucaagagaauggcgauuagcggcgaugacugcgugguuaaacccaucgaugaccgguuugccaacgcucugcuugcccugaaugauaugggaaaggugcgcaaagacauuccucaauggcagccgucuaagggcuggcaugauuggcagcagguccccuucuguucccaccauuuccacgaacucaucaugaaagacgggagaaagcuggugguuccuugccggccccaagacgagcuuauuggacgcgcuagaaucagccagggcgccggguggucucugcgggaaaccgcuugucucggaaaggccuaugcgcagauguggucccugauguacuuucaccgcagagaucugcggcucgccagcaacgcuauuugcucugccgugccuguccauugggugcccacaucccgcacgaccuggagcauccacgcccaucaccaauggaugacaaccgaggacaugcugacagucuggaauagaguguggaucgaagauaacccuuggauggaggacaaaacccccguuacgaccugggagaaugugccguaccuuggcaagcgggaagaucaguggugugggucccugauuggccucacaagcagagcuaccugggcccagaacaucccuacagcgauucagcaaguccgcucucugaucggaaaugaggaguuccuugacuauaugcccagcaugaaacgguuuagaaaggaggaggaauccgagggcgcuauuugguga

SEQ ID NO: 20741 - RNA, 9873 nt, Artificial Sequence
  derived and/or modified CDS sequence (opt5) from DENV-3__JQ922554__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcauauuaccgaacucgagcccgaagacaucgauugcugguguaaccugacauccaccuggguuacguauggaaccugcaaucaggcuggcgagcacagacgggacaagcgcucuguggcccuggccccucauguggggaugggacucgauacaagaacccaaacauggaugagcgcugagggcgccuggcggcaggucgaaaaaguggagaccugggcucugcgccaccccggcuucacgauucuugcccuguuucucgcgcauuacaucgggacaucccugacccagaagguugugaucuucauucuucugaugcucgucacaccuucuaugaccaugagaugugugggaguuggcaaccgggacuuuguggaagggcugagcggagccaccugggucgauguggugcuggagcacggcgggugcgucacaacgauggcuaagaauaaacccacccucgacaucgagcugcagaagacagaagccacccaacuugcuacacugcgcaaacucuguauugagggaaagaucaccaacauuacgacagauuccagaugcccuacccagggcgaagccauccugccggaggaacaggaccagaauuauguuuguaaacacaccuacguggaucggggcugggggaacggaugcggccuuuucgggaagggaagccuggugacaugcgcgaaguuucaaugucucgagucuauugagggcaaagucgugcagcaugaaaaucugaaguauaccguuaucaucacagugcacacgggggaccagcaucaggucggaaacgagacccaaggcgugacagccgaaauuaccucccaggcuagcacagccgaggcuauccugcccgaauacggcacccucgggcuggagugcucuccucgcacgggacuugacuucaaugagaugauucugcucaccaugaaaaacaaggccuggaugguucacagacagugguuuuucgaucugccccuuccuuggacauccggcgccaccacaaaaacccccacguggaaucggaaggaacugcucgugacauuuaaaaacgcucacgcgaagaagcaagaggucgugguccuggggagccaggaaggagccaugcauaccgcucugacaggcgccaccgagauccagaccucugggggcacauccauuuucgccggacaccucaaaugucgccugaagauggacaaacuugaacugaagggcaugagcuaugcuaugugccucaauacguuugugcugaaaaaggagguuuccgagacccagcaugggacaauccugaucaagguggaauacaaaggagaggaugccccguguaagauuccuuucucuaccgaagacggccaagggaaagcgcacaacggaagacuuaucacagcuaaccccgucgugaccaagaaagaggagccuguuaauauugaagccgagccccccuucggcgaaagcaacaucgugauugggaucggcgauaaggcccucaagaucaauugguaccggaaaggauccagcauuggcaagauguuugaggcuacggccagaggggcucgccggauggccauccugggagacacagcgugggauuucggcucugucgggggagugcugaacucccucggcaaaauggugcaucagauuuuugggagcgccuauaccgcucuguucucuggcguuagcuggaucaugaagauuggaaucggcguccuucugaccuggauugggcucaauuccaaaaacacaucuauggccuuuagcugcaucgcuaucggaauuaucacccuguacgugggcguggucgugcaggccgacaugggguguguuauuaauuggaagggaaaggaacugaaaugcggcuccgggaucuucgugacaaacgagguccacacguggaccgagcaguauaaguuucaagcggauagcccuaaaagacuugccacagcuauugccggcgcuugggaaaauggaguguguggcauccgcucuaccacacggauggagaaccuccuguggaagcagaucgccaaugaacugaacuacauucucugggagaauaacaucaaacugaccguuguggucggggacauuacgggagugcuugaacagggcgagagaacccugacaccgcagcccauggagcucaaguauuccuggaaaaccugggggaaggccaagaucguuacagcugaaacccaaaauagcucuuucauuaucgauggaccuuccacacccgagugcccuagcgcgucccgcgccuggaacgugugggaagucgaggacuacggcuuuggcguguucaccacgaacaucuggcugaaacugcgggaaguguauacacagcuuugugaccacagacucaugucugcugccgucaaggaugagcgcgccguucaugcugacaugggguacuggauugagagccagaaaaauggauccuggaagcuggaaaaagccucucugaucgaggugaagaccugcaccuggcccaagagccacacacucugguccaacggcgugcuggaaagcgauaugauuaucccgaaaucucuugcggggccuauuucccagcauaaucaccggcccggauaccacacccaaacggcuggcccuuggcaucuggggaagcucgagcuggacuuuaacuauugcgagggaacaaccgucgugaucagcgaaaauuguggcacaagaggccccucucugcgcaccacaaccguuuccgggaaacuuauccacgaguggugcugucggagcugcacgcucccuccccugagauacaugggagaagauggcuguugguaugggauggagauucggccgaucaacgaaaaggaggagaauauggugaaaucucuggccagcgccggauccggcaaggucgacaacuucaccaugggggugcucugccuggcuauucuuuuugaagagguuaugcgcggaaaguucagaaaaaagcauaugaucgccggcgugcuguucacauuuguccuccugcugagcggccagauuaccuggcgggauauggcgcacacacuuaucaugauugggucuaaugcuuccgacagaaugggaaugggcgugaccuaccuggcccucaucgccacguucaaaauccagccuuuucuggcucucggguucuuucugcgcaagcuuacaagccgggaaaaccugcuccugggaguuggccuggccauggcugccacccuuagacugcccgaggauauugaacaaauggcgaaugggaucgcccucggacugauggcucucaaacugauuacacaguucgagaccuaucagcuuuggaccgcccuggugucccucacauguucuaacacgaucuuuacccugacagucgcuuggcgcaccgccacacugauucuugccggcaucagccugcuccccgugugccaguccucuagcaugagaaagaccgacuggcugccuaugacgguggcugcgaugggcgucccgccccucccucuguucaucuuuucccuuaaggauacacugaaacggcgcucuuggccccugaaugaggggguuauggccgugggacucgugagcauucuggcuuccagccuucugagaaacgacgucccuauggccggcccccucguggccgggggacugcucaucgcuuguuacguuauuaccggcaccucugccgaucugacaguggaaaaggcggcugacgucaccugggaggaagaggccgaacaaacaggggugucccauaaucuuaugaucacgguugacgaugacggaaccaugcggauuaaagaugacgagacagagaacauccugaccgugcugcucaagacagcccugcuuaucgucagcggcauuuucccuuauucuauccccgcuacccugcucguguggcacacguggcagaaacagacccagcgcuccggcguccugugggaugugccgagcccucccgaaacacaaaaggccgagcucgaagaggggguuuacagaauuaaacagcagggaaucuuuggcaagacccaggugggggucggagugcaaaaggagggcguuuuccacacaauguggcaugugacccggggggcgguccugacacacaacggaaaacgccuugaaccuaauugggcuucugugaagaaagaccugauuuccuacggcggcggguggagacugagcgcccagugggccaagggaggcgagacgcaggugaucgcuguugaacccgggaaaaacccgaagaauuuucaaaccaugccuggaauuuuccagacaaccaccggcgagaucggggccaucgcucucgauuucaagcccggaacauccggcagcccuauuaucaaccgggaaggcaaagucguggggcuguauggaaauggcguggucacgaagaacgggggauacgugucuggcauugcccagaccaaugcggagcuugacgggcccacacccgagcuggaagaggaaauguuuaaaaagcgcaaccucaccaucauggaucugcauccuggcagcggaaaaacaagaaaguaucucccggccauuguucgggaggcuaucaagagacgccugcggacccuuauccuggcccccacgagaguggucgcugccgaaauggaggaggcccugaaaggccucccuauucgcuaccagacaaccgcuaccaaguccgaacacacagggcgggagaucguggaccugaugugccaugcgaccuucacaaugagacuucugucucccguucgcggaagcaauuauaaccucauuaucauggaugaagcccacuuuaccgacccugcuuccauugccgccaucggcuacaucucuacgcggguggggaugggagaggcugccgcgauuuucaugacagcuacccccccuggcacagucgaugccuuuccgcaaagcauccccccuauucaggacgaagagagagacauccccgagcgcuccuggaauucugggaacgaauggauuaccgauuucgugggcaaaacgguuugguuugugccuagcaucaaggccggaaaugacauugcuaacugucugcggaaaaauggcaagaaggucauccagcuguccagaaaaaccuucgauacagaguaucagaagaccaaacucaacgacugggauuuuguggugacaaccgacaucagcgaaaugggggccaacuucaaggcggaucgggucauuuaccuucgcagaugccugaaacccguuauccugacaaauggaccggagcgggugauucucgccggcccuaugcccgugaccgucgcuucugccgcucaacgcagagggcgggugggaagaaacccccagaaggagaaugaccaguacaucuuuaugggccagccucugaacaaugaugaagaccacgcccauuggacggaggcuaagaugcuucuggauaacauuaauacacccgaagggaucaucccugcccucuucgagccggaacgcgagaaauccgcggccauugacggcgaguaucggcugaagggagaaagcagaaaaaccuucguugagcugaugcgccggggcgaccuccccguguggcuugcucacaaggucgccucugaagggaucaaauacaccgauagaaaguggugcuuugacggagagcgcaacaaucaaauucuggaagagaacauggauguggagaucuggacaaaagaaggcgagaagaagaauuggcggccuagauggcuggacgcucgcaccuauuccgauccccucgcccugaaagaauucaaggacuuugccgcugggagaaaaagcauugcgcuugaucugguuacagagaucggacgggugccuucccaucucgcccacacgguccgcaacgcucuggacaaucuggugaugcuccacaccucugaacauggcggcagagccuaccggcacgccgucgaggagcuucccgaaacaauggagacccugcugcuccuggggcuuaugauccugcucacaggaggcgcuaugcuguuccugauuagcgggaagggaaucggcaaaaccuccauugggcucaucugugugauugccagcucuggaaugcuuuggauggcggauguuccgcugcaguggaucgccuccgcuauugugcuggaauuuuucaugauggugcuccugaucccugagcccgagaagcagcgcacgccucaggacaaccaacuugccuaugucguuaucggcauucugacccucgcugccaucguggcggccaaugaaaugggccugcuggagacaaccaagagagaucucgggaugagcaaagaacccggaguggucucuccuacaagcuaccuugacguggaucugcaucccgcuuccgccuggacccuguaugcuguugccacgccggugauuacaccuaugcuccggcacaccaucgagaacucuacagcuaaugucagccuggccgcgauugccaaccaggcugugguccuuaugggccuggacaagggguggcccaucuccaaaauggaccucggagugccccugcuggcccucggcugcuacucucagguuaacccucuuacccuggcugccgccgugcugcuccuggucacccauuacgcgaucauugggccgggacuucaagcuaaggccacaagagaagcucagaaacgcacggccgccggcaucaugaagaaucccaccguggauggcauuaugacaaucgaccuggauccuguuauuuaugacagcaaguuugagaaacagcucgggcaggugaugcugcugguccucugugcugugcaacuucugcugaugcggaccuccuggccccucugcgaggugcuggcccuugcgacaggaccuaucaccacgcugugggaaggcagccccgggaaguucuggaacacaaccaucgccguuucuauggcuaauauuuuuagaggauccuaccucgccggcgcugggcuggccuucagcaucaugaaauccgucggaaccggcaagcgcggcacagggucucagggagagacccugggcgaaaaauggaagaagaaacucaaccagcuuagccggaaggaguuugaucuguauaaaaaguccgggauuacagaaguggacagaacggaggcgaaagagggacugaagcggggcgaaaucacccaccacgccgugucucgcgggagcgcuaaacuccagugguucgucgagagaaauaugguuuuuccugaaggacgggugauugaucugggcuguggccgcgggggaugguccuacuauugcgccggccuuaagaaggugacagaggucagaggguacaccaaaggaggcccggggcaugaagagcccgugccuaugagcacauauggauggaacaucguuaagcugaugucuggcaaagacguguucuaccuccccccugagaagugugauacccugcugugcgacauuggcgaauccagccccucuccgacggucgaggaaucccggaccauccgcgugcucaaaaugguugagccuugggugaagaauaaccaauucuguaucaagguccuuaaucccuacaugcccagcgugauugagcaccuggaaaaccugcagagaaaacaugggggaauccucgugcggaauccucugucucgcaacagcacacacgagauguauuggauuuccaauggcaccgggaacaucgucucuagcguuaauaugguguccagacuucugcucaaccgguuuacaaugacccacagacgccccacaauugaaaaggauguggaccugggagcuggcacccggcaugucaacgccgagccugaaacgccgaauauggaugugaucggggagagaaucaaacgcauuaaggaggaacacagcuccacauggcauuacgacgacgagaaccccuauaaaaccugggcuuaccacggaucuuaugaaguuaaggccaccggcagcgcguccucuaugaucaauggcguggucaagcugcucacaaaaccuugggaugugguucccauggugacgcagauggccaugaccgacacaaccccuuucgggcagcaacgggucuuuaaggagaaaguggauacaagaaccccccgcccgaugccuggaacacggaagguuauggaaauuaccgcugaguggcuguggagaacgcuuggccgcaacaaacggcccagacugugcacccgcgaggaauucacaaagaaggugcggaccaaugccgcuaugggggccgucuuuacagaggaaaaccagugggacagcgccagagcggcuguggaggaugaagaguucuggaaacucgucgaccgcgagagagaacugcauaagcuuggaaaauguggcuccugcguguacaauaugauggggaagcgggagaaaaagcugggcgaauuuggaaaagccaaggauucucgcgccaucugguauauguggcucggcgcuagauaccuggaguucgaggcccugggguuucucaacgaagaccacugguucagccgggagaauuccuacagcggaguugaaggcgaggggcugcacaagcuuggauauauucugagagauaucucuaaaaucccuggcggggcuauguacgccgacgauaccgcgggcugggacacgcggauuacagaagacgaucuccauaacgaggagaagaucacccagcaaauggcccgcgaacacagacagcuggcuaaugccauuuuuaaacuuacauaucagaacaagguggucaaagugcagcggcccaccccuaagggaacggugauggacaucauuucccgcaaggaucaaagaggcagcgggcagguuggaaccuacggccugaauacauucaccaacauggaggcucagcucauccggcagauggaaggggagggagugcugucuaaagccgaccuggaaaauccccauccgcucgagaagaaaaucacacaauggcuggagaccaagggcgucgaacgccuuaaaagaauggcgauuuccggggaugacugcgugguuaagccuaucgaugaccgguuugccaacgcucugcucgcccugaacgauaugggcaaggugcgcaaagacauuccccaguggcagcccagcaagggauggcacgauuggcagcaagucccuuucuguucucaccauuuccacgagcuuaucaugaaagacggcagaaagcugguggucccgugccggccccaggaugaacuccuggggaaagcucgcauuucccagggagccggcuggagccugagagagacagcuugucucgggaaggccuaugcgcagauguggacccugauguacuuucaucggcgcgaccuuagacuggccuccaaugcuaucugcagcgccgugccuguucacugggugcccacgucucggacaaccuggagcauucaugcccaccaccaauggaugaccacagaagacaugcucaccgucuggaacagaguguggaucgaggauaauccuuggauggaggacaagacacccguuacgaccugggaagaugugccuuaucugggaaaacgcgaggaccagugguguggcucccuuaucgggcugacaucucgggcuaccugggcccagaacauucucacagcgauccaacaggucagaagccugauuggcaaugaagaguuccuggauuacaugcccuccaugaagcgcuuucggaaagaggaagagucugaaggagcuaucugguga

SEQ ID NO: 20742 - RNA, 9873 nt, Artificial Sequence
  derived and/or modified CDS sequence (opt5) from DENV-3__EU529683__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcucggggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacacagggugugucaucaauuggaaaggaaaggagcugaagugcggcagcgggauuuucgugacgaacgagguucauaccuggacagaacaguacaaauuucaagccgauucccccaagcggcuggcgaccgccaucgcuggcgccugggagaauggaguguguggcauuagaagcacaacccgcauggaaaaccuucucuggaaacagaucgcuaaugagcugaacuauauccugugggaaaauaacauuaagcucacggucgugguuggggacaucauuggagugcuggagcagggcaaacggacccuuacaccucagcccauggagcugaaguacucuuggaaaaccugggggaaggccagaaucgucacagccgaaacccaaaacuccagcuucauuaucgauggaccuaauacacccgagugcccgaacaccucucgcgcuuggaaugugugggaaguggaggacuauggcuuuggcgucuucacgacaaacaucuggcucaagcugcgggaaguuuacacccagcugugugaccacagacuuauguccgcggccgugaaagaugagcgcgcugugcacgccgacaugggguacuggauugagagccagaagaauggauccuggaaacucgaaaaggccucucugaucgaggucaaaaccugcacauggccuaagagccauacccugugguccaacggcgugcucgaaucugauaugauuauccccaagagccuggcugggccuauuucccagcacaauuaucggcccggauaccauacgcaaacagccggcccuuggcaccuugggaaacuggagcucgacuuuaacuauugcgagggaaccacaguugugaucaccgaaaauuguggcacaagaggccccagccugcgcaccacgaccgucucugggaagcugauccacgaguggugcugucgguccugcacacuuccgccucucagauacaugggagaagauggcuguugguaugggauggagauucggcccaucagcgaaaaagaggagaacauggugaagucucugguuuccgcgggaagcggcgaaguggacaauuucaccauggggguccugugccucgcuauucuguuugaggaagugaugcgcggaaaauucggcaagaagcauaugaucgccggcguuuucuuuacauucgugcuucugcucucugggcagauuaccuggagagauauggcccacacgcugaucaugauuggaagcaacgcuacagaccggaugggcaugggggucaccuaccuggcccuuaucgcgacauuuaaaauccagcccuuccuggcucucggauuuuuccugagaaagcucaccucccgcgagaaucugcuucugggcguggggcucgccauggccaccacacugcaacugccugaagauauugagcagauggcuaacggaaucgcccuuggccugauggcucucaaacugauuacgcaguuugagaccuaucagcucuggacagcccugaucagccuuaccuguucuaauacaauuuucacccugacgguggcguggcggacagccacccucauccuggcuggcgucucccugcuuccgguuugccaaagcuccucuaugagaaagaccgacuggcugcccaugacaguggccgcuaugggggugccuccccucccucuguuuaucuucagccucaaagauacccugaagcgcagauccuggccccuuaacgaaggagucauggccgugggccugguuucuauucuggccagcucccuccugcggaacgacgugccuauggcugggccccuugucgcgggaggccugcucaucgccuguuacgugauuacagggacgucugcugaucugaccguugagaaggccgccgacgugacaugggaagaggaagcugagcagaccggagucagccauaaucucaugaucacaguggacgaugacggcaccaugcgcauuaaagaugacgagacggaaaacauccugaccguccuucugaagacagcccugcucaucguguccggcauuuuuccguacagcaucccugcgacccugcuuguuuggcacacauggcagaaacagacccaaagaucuggggugcugugggauguccccuccccucccgagacacagaaggcugaacucgaggagggaguguaucggauuaaacagcagggcaucuucgggaagacgcaaguuggagugggcguccagaaagaagggguguuucauaccauguggcacgugacacgcggagccguucugaccuacaauggcaagagacucgagccgaacugggccagcgucaagaaagaccugauuucuuauggcgggggauggcggcuuuccgcucaguggcaaaagggcgaagaggugcaggugaucgccgucgaaccugggaaaaaucccaagaacuuccagaccaugccuggaacauuccagacgaccacaggcgagauuggggcgaucgcucuggauuuuaaacccggaaccagcggcucucccaucauuaaucgcgagggcaaggugguugggcuguacggaaacggcguggucacaaagaaugggggauauguguccggcaucgcccaaaccaacgccgaaccugacgggccgacgcccgagcucgaagaggaaauguucaaaaagagaaaucugacaauuauggaucuucacccuggcagcggaaaaacccggaaguaccugcccgcuaucguucgcgaggccauuaaaagacggcucagaacccugauccucgcuccuacacgcguggucgccgcggagauggaagaggcccugaagggccuucccauccgguaucagaccacagcuaccaaguccgaacauacggggagagagauuguggaccugaugugccacgccacauuuaccaugcgccugcucagcccuguucgggugccgaacuacaaucugaucauuauggaugaagcucauuucacagaccccgccucuaucgccgcuagaggauacauuagcacccgcgucggcaugggggaggcggccgcuaucuuuaugacggccaccccucccggaacagccgaugcuuucccucaguccaacgcccccauccaggacgaggaacgggacauuccggagagaucuuggaauagcggcaacgaauggaucaccgauuuugcggggaaaacagugugguucgugccuuccauuaaggcuggcaacgacaucgccaauugucuucgcaaaaacggaaagaaagucauucaacugucucggaagaccuuugauacagaguaucagaagaccaaacucaaugacugggauuucguugugacgacagacaucagcgagaugggcgccaacuuuaaggcugauagagugauugacccccggcgcugccugaaacccgucauccugaccgaugggccugaaagagugauccucgccggacccaugccuguuaccgcggccuccgcugcccagcggcgcggcagaguggggcggaauccgcagaaggagaacgaccaauacauuuucacaggacagccccuuaauaacgaugaagaccacgcucauuggaccgaggccaaaaugcugcuggacaauaucaacacaccugaaggcauuauccccgcucucuucgagccugagagagaaaagucugccgcgauugauggggaguaucgccugaagggcgaaagccggaaaacguuugucgagcuuaugagacgcggagaccugcccguguggcucgcccacaagguugcuuccgaaggcaucaaauacaccgaucggaaguggugcuucgacgggcagagaaauaaccagauccuggaggagaauauggauguggaaauuuggacaaaagagggagaaaagaaaaagcugcgcccgcgguggcucgacgccagaaccuauagcgauccucuugcucugaaggaguuuaaagacuucgccgccggccgcaagucuaucgcucuggaucucgucacagaaauugggagagugcccacccaccuggcgcaucggacgcgcaacgcccuugacaaucuggucaugcuccacaccuccgagcauggaggcaaagcuuacagacacgccguggaggaacugccugagacaauggaaacccugcuccuucugggccugaugauccuccugacagggggagccaugcuuuuucugauuagcggcaaggggaucggaaaaaccucuaucggccucauuuguguuaucgcuuccagcgggaugcuguggauggccgagauuccccugcaauggaucgcguccgccauugugcucgaguucuuuaugauggugcuucugaucccugaacccgagaagcagcggacgccgcaggauaaccaacuggcuuaugucguuauuggaauccucacacuggccgcuaucauugccgcgaaugaaaugggccuucuggagaccacaaagcgcgaccucggcaugucuaaagaaccugggguggugagccccaccuccuaccuggaugucgaccugcaccccgccagcgcuuggacccucuacgccguggcuacaacgguuaucaccccuaugcuuagacauacaauugagaacucuaccgccaacgugucccuggcugccaucgcgaaucaggccgucgugcugaugggacucgacaagggcuggccgauuagcaaaauggaucugggggucccccuucuggcucucggaugcuauucucaggugaacccucugacacugaccgccgcuguucuccuucugaucacgcacuacgccaucauuggccccgggcugcaggccaaggcgacacgggaggcucaaaaaagaaccgccgcuggaaucaugaagaauccuaccguggacggcauuaugacaaucgaucucgaccccgucauuuaugauagcaaguucgaaaaacagcugggccaggugaugcuucugguucucugugccgugcagcugcugcucaugcgcaccuccugggcccuuugcgaggcucugacacuggccacggggccuaucaccacacucugggaaggaucuccgggcaaguuuuggaacaccacaaucgcggucagcauggccaauauuuuccggggguccuaccuggcuggagccggccuugcuuuuucuaucaugaaaagcguggggaccggaaagagaggcacgggcucccaaggggagacccugggagaaaaauggaagaagaaacucaaccagcugagccgcaaggaguucgaccuguauaaaaagucuggcauuacagagguggaucggaccgaagccaaagaggggcucaagagaggagaaaucacacaucacgcgguuucccggggcagcgccaaacuucagugguuugucgagcgcaauauggugauucccgaagggagagugaucgaccugggauguggccggggcgggugguccuacuauugcgcuggacugaagaaggucaccgagguucgcggcuacacaaaagggggaccuggccaugaggaacccgugccuaugucuaccuacggguggaacauugugaagcucaugagcggaaaagaugucuucuaucugcccccggagaagugugacacgcuucugugcgauaucggcgaauccucuccuagccccacaguggaggaguccagaaccauccggguucucaaaaugguggaacccuggcugaagaauaaccaguucuguauuaagguccugaauccuuacaugcccgccgugaucgagcaccucgaacgccuucaaagaaaacacggcgggaugcugguucggaacccucugagccgcaauucuacccaugagauguauuggauuuccaacggaacaggcaauaucguggcuagcgucaacauggugucuagacuccugcuuaaccgguuuacgaugacccacagacgcccgacaauugaaaaggacguggaucugggggccggaacccggcaugucaaugcugagcccgagacaccuaacauggacguuaucggcgaaagaaucaaacgcauuaaggaggaacacaauuccaccuggcacuacgacgaugagaaccccuauaaaacaugggccuaccaugggagcuaugaagugaaggcgaccggaucugccagcuccaugaucaauggcguggucaagcuccugacgaaaccuugggacgugguucccauggugacccagauggcuaugacagauaccacaccguucggccagcaacgggucuuuaaggagaaaguggacaccagaacgccucgcucuaugcccgggacacggagaguuauggagauuaccgccgaauggcuguggcgcacacucggacggaacaagaaaccuagacugugcacccgcgaggaauucacgaagaaggugcggaccaaugcugccaugggcgccgucuuuacagaggaaaaccagugggauagcgcgaaagcugccguggaggacgaggauuucuggaagcuuguugacagagaacgcgagcugcacaaacucgggaaguguggauccugcguguacaauaugaugggcaaaagagaaaagaaacugggggaguuuggcaaggccaagggaagccgggcuaucugguacauguggcuuggcgcccgcuaucuggaguucgaagcucucggguuucugaacgaggaucauugguucuccagagaaaauucuuacagcggagucgagggcgaagggcugcacaaacucggauauauucugcgggacaucuccaagauccccggcggggccauguacgcggaugacaccgccggcugggacacaagaauuaccgaggaugaccuucauaacgaggaaaaaaucacacagcagauggauccugagcaccggcaacuggcuaaugccauuuuuaagcucaccuaucagaacaaaguggucaaggugcagcgccccacgccgacaggaaccguuauggacaucauuucuagaaaggaucagcggggcagcgggcaagugggaaccuacggccugaauacauucaccaacauggaagcucagcuuauccgccagauggagggggaaggaguccuguccaaagccgaccucgagaacccucaccugcccgagaagaaaaucacacaguggcuggaaacgaagggcguggagagacucaaacggauggcgauuucuggggaugacugcgugguuaagcccaucgaugaccgcuuugccaaugcucugcuugcccugaacgauaugggcaaggugagaaaagacauuccucaauggcagccgagcaagggauggcaugauuggcagcagguccccuucuguucccaccauuuccacgaacucaucaugaaagacggccggaagcuggugguuccuugccgcccccaagacgagcuuauugggagagcucggaucagccagggagccggcuggucucugcgcgaaaccgcuugucucgggaaagccuaugcgcagauguggucccugauguacuuucacagacgggaucugcgccucgccagcaaugcuauuugcucugccgugccuguccauugggugcccacauccagaaccacauggagcauccacgcccaucaccaauggaugaccacggaggacaugcugaccgucuggaaccggguguggaucgaggauaauccuuggauggaagacaagacacccguuaccacaugggagaacgugccguaccuuggaaagagagaagaucagugguguggcucucugauugggcucaccucccgcgcuacgugggcccagaauaucccuacagcgauucagcaaguccggagccugaucggcaacgaggaguuccuugacuauaugcccuccaugaaaagauuucgcaaggaagaggaaagcgagggagcuauuugguga

SEQ ID NO: 20743 - RNA, 9873 nt, Artificial Sequence
  derived and/or modified CDS sequence (opt5) from DENV-3__EU529684__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcucggggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagaaacuggcgacagccaucgcuggcgccugggagaauggaguguguggcauucggagcaccacaagaauggaaaaccuucucuggaagcagaucgcuaaugagcugaacuauauccugugggaaaauaacauuaaacucaccgucgugguuggggacaucauuggagugcuggagcagggcaagcgcacgcuuaccccucagcccauggagcugaaauacucuuggaagacaugggggaaggccaaaaucgucaccgccgaaacacaaaacuccagcuucauuaucgauggaccuaauacccccgagugcccgucugcuucccgggcguggaacgugugggaaguggaggacuauggcuuuggcgucuucacaaccaauaucuggcucaagcugagagaaguuuacacgcagcugugugaccaccgccuuaugagcgccgcugugaaagaugagcgggccgugcacgccgacaugggguacuggauugagucccagaagaacggaucuuggaaacucgaaaaggcuagccugaucgaggucaagacaugcaccuggccuaaaucccauacccuguggucuaauggcgugcucgaaagcgauaugauuauccccaagucccuggccgggccuauuagccagcacaacuauagacccggauaccauacacaaaccgcgggcccuuggcaccuugggaaacuggagcucgacuuuaauuauugcgagggaacgacaguugugaucaccgaaaacuguggcacacgcggccccucucugcggaccacaaccgucuccgggaagcugauccacgaguggugcuguagaagcugcacgcuuccgccucuccgcuacaugggagaagauggcuguugguaugggauggagauucggcccaucucugaaaaagaggagaauauggugaagucccugguuagcgcuggaucuggcgaaguggacaacuucaccauggggguccugugccucgccauucuguuugaggaagugaugagaggaaaguucggcaaaaagcauaugaucgccggcguuuucuuuacauucgugcuucugcucagcgggcagauuaccuggcgggauauggcucacacacugaucaugauuggauccaaugccagcgaccgcaugggcaugggggucaccuaccuggcgcuuaucgcuacguuuaaaauccagcccuuccuggcccucggauuuuuccugagaaagcucacaucucgggagaaccugcuucugggcguggggcucgccauggcuaccacacugcaacugccugaagauauugagcagauggccaauggaaucgcucuuggccugauggcccucaaacugauuacccaguuugagaccuaucagcucuggacagcgcugaucucccuuacguguagcaacaccauuuucacacugaccguggccuggagaacagcuacccucauccuggccggcgucucccugcuuccgguuugccaaucuagcuccaugcgcaagacggacuggcugcccaugacaguggcugccaugggggugccuccccucccucuguuuaucuucucucucaaggauacccugaaacggagaagcuggccccuuaaugaaggagucauggccgugggccugguuuccauucuggcuucuagccuccugcgcaacgacgugccuauggcggggccccuugucgccggaggccugcucaucgcuuguuacgugauuaccgggacauccgccgaucugaccguugagaaggccgcugacgugacaugggaagaggaagccgagcagacgggagucagccauaaccucaugaucaccguggacgaugacggcacaaugagaauuaaagaugacgagaccgaaaauauccugacaguccuucugaagaccgcgcugcucaucgugucuggcauuuuuccguacuccaucccugcuacgcugcuuguuuggcacaccuggcagaaacagacacaacggagcggggugcugugggauguccccucuccucccgagacccagaaggccgaacucgaggagggaguguaucgcauuaaacagcagggcaucuucgggaagacacaaguuggagugggcguccagaaggaagggguguuucauaccauguggcacgugacaagaggagccguucugacguacaacggcaaacggcucgagccgaauugggcuuccgucaagaaagaccugauuagcuauggcgggggauggcgccuuucugcccaguggcaaaagggcgaagaggugcaggugaucgcggucgaaccugggaaaaaccccaagaauuuccagaccaugccuggaacauuccagaccaccacaggcgagauuggggcuaucgcccuggauuuuaagcccggaacguccggcagccccaucauuaacagagagggcaaaaucguggggcuguacggaaauggcguugugaccaagaacgggggauaugucuccggcauugcccaaacaaaugcugaaccugacgggccgacccccgagcucgaagaggaaauguucaaaaagcggaaccugacaaucauggaucuucacccuggcagcggaaaaacccgcaaguaccugcccgccauugugagagaggcuaucaagcggcgccucagaacgcugauccucgccccuacacggguuguggcggccgagauggaagaggcucugaaaggccuucccauuagauaucagaccaccgccacaaagucugaacauaccgggcgcgagaucgucgaccugaugugccacgcuacauuuaccaugcggcugcucagcccugugagaguuccgaauuacaaccugauuaucauggaugaagcccauuucacggaccccgccuccauugcugcgcgcggauacaucucuacacgggugggcaugggggaggccgcugccaucuuuaugaccgccacaccucccggaaccgcugaugccuucccucagagcaaugcgcccauucaggacgaggaaagagacaucccggagcgcuccuggaacucuggcaaugaauggauuacggauuuugcugggaaaaccgucugguucgugccuagcaucaaggccggcaacgacauugccaacugucuucggaaaaauggaaagaaggugauccaacuguccagaaaaacauuugauaccgaguaucagaagacaaaacucaacgacugggauuucgucguuaccacagacauuucugagaugggcgcuaauuuuaaggccgaucgcgugaucgacccccggagaugccugaaacccgugauccugaccgaugggccugaacgggucauucucgcgggacccaugccugugacggccgcuagcgccgcucagcgcagaggccggguugggcgcaacccgcagaaggagaaugaccaauacaucuucacaggacagccccuuaacaaugaugaagaccacgcccauuggaccgaggcuaagaugcugcuggacaacauuaauaccccugaaggcaucauucccgcccucuucgagccugagagagaaaaauccgcggccaucgauggggaguaucggcugaagggcgaaagcagaaaaacauuuguggagcuuaugcgccggggagaccugcccgucuggcucgcucacaagguggccucugaaggcaucaaauacaccgauagaaaguggugcuucgacgggcagcgcaacaaucagauucuggaggagaacauggauguugaaaucuggacaaaagagggagaaaagaagaaacugcggccgagauggcucgacgcucgcacguauuccgauccucuugcccugaaggaguuuaaagacuucgccgcuggccggaagagcauugcgcuggaucucgugaccgaaaucgggagaguccccacacaccuggcccaucgcaccagaacagcucuugacaaucuggugaugcuccacaccucugagcauggaggcaaagccuaccggcacgccgucgaggaacugccugagacgauggaaacccugcuccuucugggccugaugauucuccugacagggggagcuaugcuuuuucugaucuccggcaaggggaucggaaagaccagcauuggccucaucugugugauugccuccucugggaugcuguggauggcggagaucccccugcaauggauugccagcgcuaucguucucgaguucuuuaugauggugcuucugauuccugaacccgagaaacagcgcacaccgcaggauaaccaacuggccuauguggucaucggaauccucacccuggcugccauuaucgcggccaaugaaaugggccuucuggagacgacaaagagagaccucggcauguccaaagaaccugggguugugagccccaccucuuaccuggauguggaccugcaccccgcuuccgccuggacacucuacgcugucgccaccaccgugauuacaccuaugcuucggcauacgaucgagaacagcaccgcuaauguuucucuggccgcgauugccaaccaggcugugguccugaugggacucgacaagggcuggccgaucagcaaaauggaucugggggugccccuucuggcccucggaugcuauucccaggucaacccucugacacugaccgcugccgugcuccuucugaucacacacuacgccauuaucggccccgggcugcaggcgaaggcuacccgcgaggcccaaaagagaacggcugccggaauuaugaaaaauccuacaguugacggcaucaugaccauugaucucgaccccgugaucuaugauucuaaguucgaaaaacagcugggccaggucaugcuucuggugcucugugccguucagcugcugcucaugcggaccagcugggcucuuugcgaggcccugacacuggcgaccgggccuaucacaacgcucugggaaggauccccgggcaaguuuuggaacaccacaauugccgugucuauggcuaauaucuucagagggagcuaccuggccggagcuggccuugccuuuuccauuaugaaaagcgucgggaccggaaagcgcggcacaggcucucaaggggagacccugggagaaaaguggaaaaagaaacucaaccagcugucccggaaggaguucgaccuguauaaaaagagcggcaucacggagguggauagaaccgaagcgaaagaggggcucaagcgcggagaaauuacacaucacgccgugucccggggcucugcuaagcuucagugguuuguugagagaaauauggucauccccgaagggcgggugauugaccugggauguggccgcggcggguggagcuacuauugcgccggacugaaaaaggugaccgaggucagaggcuacacaaaagggggaccuggccaugaggaacccguuccuauguccaccuacggguggaacaucgugaagcucaugucuggaaaagauguguucuaucugcccccggagaagugugacacacuucugugcgauaucggcgaaagcuccccuagccccaccgucgaggagucucggacgauucgcgugcucaagaugguugaacccuggcugaaaaauaaccaguucuguaucaaggugcugaauccuuacaugcccacagucauugagcaccucgaaagacuucaacggaaacacggcgggaugcuggugcgcaacccucuguccagaaauagcacccaugagauguauuggaucucuaacggaaccggcaauauuguugcuuccgugaacauggucagccggcuccugcuuaaucgcuuuacaaugacgcacagacggccgaccaucgaaaaggacguggaucugggggccggaacaagacaugugaacgcugagcccgagaccccuaacauggacgucaucggcgaacgcauuaaacggaucaaggacgagcacaauucuacauggcacuacgaugacgaaaaccccuauaagaccugggccuaccaugggagcuaugagguuaaagcgacaggauccgccucuagcaugauuaauggcguggugaagcuccugaccaaaccuugggaugucgugcccaugguuacgcagauggcuaugaccgacacaaccccguucggccagcaaagaguguuuaaggaaaaagucgauacacgcaccccucgguccaugcccgggacgagacgcgugaugggaaucacagccgaguggcuguggcggacccucggcagaaacaagaagccucgccugugcacacgggaggaauucaccaaaaagguuagaacgaaugcugccaugggggccguguuuaccgaggaaaaccagugggacagcgcgaaagcugccgucgaggaugaagacuucuggaagcuuguggaucgcgagcgggagcugcacaaacucggaaaguguggcuccugcguuuacaauaugauggggaaaagagaaaagaagcugggcgaguuuggaaaagccaagggcucucgcgcuauuugguacauguggcuuggggccagauaucuggaauucgaggcucucggauuucugaacgaggaccauugguucagccgggaaaauuccuacucuggcguggagggggaaggacugcacaaacucggcuauauccugcgcgauaucagcaagauucccgggggcgccauguacgcggacgacacagccggaugggauaccagaaucacagaggacgaucuucauaacgaagagaaaauuacccagcagauggacccugagcaccggcaacuggcuaaugccaucuuuaagcucacauaucagaacaaggucgugaaaguccagagacccaccccgacgggcacagugauggauauuaucucccggaaggaccagcgcgggucuggacaaguuggcaccuacgggcugaauaccuucacaaacauggaagcucagcuuaucagacagauggagggagaaggcgugcugagcaaagccgaucucgagaauccucaccugcccgaaaagaaaauuacccaguggcuggagacaaagggggucgagcggcucaagcgcauggcgaucuccggcgacgauugcguggugaaacccauugacgauagauuugccaacgcucugcuugcccugaacgacaugggaaagguucggaaagauaucccucaauggcagccgagcaagggcuggcaugacuggcagcaggugcccuucuguucucaccauuuccacgaacucauuaugaaagacgggcgcaagcuggucgugccuugcagaccccaagaugagcuuaucggacgggcucgcauuucccagggcgccggguggagccugagagaaacggcuugucucggaaaggccuaugcgcagauguggucucugauguacuuucaccggcgcgaccugagacucgccuccaaugcuaucugcagcgccguuccugugcauuggguccccaccucucggacaaccugguccauccacgcccaucaccaauggaugacaaccgaggauaugcugacgguguggaaccgcgucuggauugaagacaauccuuggauggaggauaaaacccccgugacaaccugggagaacguuccguaccuuggcaagagagaagaccaguggugugggagccugaucggccucacaucccgggcuaccugggcccagaauauuccuacggcgauccagcaagugagaagccugauuggaaacgaggaauuccuugauuauaugcccucuaugaaacgcuuucggaaggaggaggaaagcgagggcgcuaucugguga

SEQ ID NO: 20744 - RNA, 9873 nt, Artificial Sequence
  derived and/or modified CDS sequence (opt5) from DENV-3__FJ182015__SS-prME
accagccugugccucaugaugauccugcccgccgcucuugccuuccaccugacaucccgggacggcgagccucggaugauuguggggaagaacgaacgcggaaagucucuccuguuuaagacggcgagcggcaucaauauguguacccuuauugcuauggaucugggggaaaugugcgacgauacagugaccuacaaguguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaacggcaagcgccucgagccgaauugggcuuccgucaaaaaggaccugauuagcuauggcgggggauggagacuuucugcccaguggcaaaaaggcgaagagguccaggugaucgcggucgaaccugggaagaaccccaaaaauuuccagaccaugccuggaacauuccagaccaccacaggcgagauuggggcuaucgcccuggauuuuaagcccggaacguccggcagccccaucauuaaccgggagggcaaggugguugggcuguacggaaauggcguggucaccaaaaacgggggauauguguccggcaucgcccaaacaaaugcugaaccugacgggccgacccccgagcucgaagaggaaauguucaagaaacgcaaccugacaauuauggaucuucacccuggcagcggaaagaccagaaaauaccugcccgccaucguucgggaggcuauuaagcgcagacuccggacgcugauccucgccccuacaagaguggucgcggccgagauggaagaggcucugaagggccuucccauccgcuaucagaccaccgccacaaaaucugaacauaccgggcgggagauuguggaccugaugugccacgcuacauuuaccaugagacugcucagcccuguucgcgugccgaauuacaaccugaucauuauggaugaagcccauuucacggaccccgccuccaucgcugcgcggggauacauuucuacaagagucggcaugggggaggccgcugccaucuuuaugaccgccacaccucccggaaccgcugaugccuucccucagagcaaugcgcccauccaggacgaggaacgcgacauuccggagcgguccuggaacucuggcaaugaauggaucacggauuuugcugggaagaccgugugguucgugccuagcauuaaagccggcaacgacaucgccaacugucuuagaaagaauggcaaaaaggucauucaacugucccgcaagacauuugauaccgaguaucagaaaacaaagcucaacgacugggauuucguugugaccacagacaucucugagaugggagcuaauuuuaaagccgaucgggugauugaccccagacggugccugaagcccgucauccugaccgaugggccugaacgcgugauccucgcgggacccaugccuguuacggccgcuagcgccgcucagagacggggccgcguggggagaaacccgcagaaagagaaugaccaauacauuuucacaggacagccccuuaacaaugaugaagaccacgcccauuggaccgaggcuaagaugcugcuggacaacaucaauaccccugaaggcauuauccccgcccucuucgagccugagcgggaaaaguccgcggccauugauggggaguauagacugaaaggcgaaagccgcaagacauuugucgagcuuaugcggagaggagaccugcccguguggcucgcucacaaaguugccucugaaggcaucaaguacaccgaucgcaaauggugcuucgacgggcagcggaacaaucagauccuggaggagaacauggauguggaaauuuggacaaaggagggagagaagaagaagcugagaccgcgcuggcucgacgcucggacguauuccgauccucuugcccugaaagaguuuaaggacuucgccgcuggcagaaaaagcaucgcgcuggaucucgucaccgaaauugggcgcgugcccacacaccuggcccauagaacccggaaugcucuugacaaccuggucaugcuccacacaucugagcauggaggcaaggccuaccgccacgccguggaggaacugccugagaccauggaaacgcugcuccuucugggccugaugauccuccugaccgggggagcuaugcuuuuucugauuuccggcaaagggaucggaaagacaagcaucggccucauuuguguuaucgccuccucugggaugcuguggauggcggagauuccccugcaauggaucgccagcgcuauugugcucgaguucuuuaugauggugcuucugaucccugaacccgagaagcagagaaccccgcaggauaaucaacuggccuaugucguuauuggaauccucacacuggcugccaucauugcggccaacgaaaugggccuucuggagaccacgaaacgggaccucggcauguccaaggaaccugggguggugagccccacaucuuaccuggaugucgaccugcaccccgcuuccgccuggacccucuacgcuguggccacaaccguuaucaccccuaugcuucgccauacaauugagaauagcacggcuaacgugucucuggccgcgaucgccaaccaggcugucgugcugaugggacucgacaaaggcuggccgauuagcaagauggaucugggggucccccuucuggcccucggaugcuauucccaggugaauccucugacccugacagcugccguucuccuucugaucacccacuacgccaucauuggccccgggcugcaggcgaaagcuacaagagaggcccaaaagcggaccgcugccggaaucaugaagaacccuacgguggacggcauuaugacaaucgaucucgaccccgucauuuaugauucuaaauucgaaaagcagcugggccaggugaugcuucugguucucugugccgugcagcugcugcucaugagaaccagcugggcucuuugcgaggcccugacccuggcgacagggccuaucaccacacucugggaaggauccccgggcaaauuuuggaauacgaccaucgccgucucuauggcuaacauuuuccgcgggagcuaccuggccggagcuggccuugccuuuuccaucaugaaaagcguggggacaggaaaacggggcaccggcucucaaggggagacacugggagaaaaguggaagaaaaagcucaaucagcuguccagaaaagaguucgaccuguauaagaaaagcggcauuaccgagguggaucgcacggaagcgaaggaggggcucaaacggggagaaaucacccaucacgccguuuccagaggcucugcuaaacuucagugguuugucgagcggaacauggugauucccgaagggcgcgugaucgaccugggauguggcagaggcggguggagcuacuauugcgccggacugaagaaagucacagagguucggggcuacaccaaagggggaccuggccaugaggaacccgugccuauguccacauacggguggaauauugugaaacucaugucuggaaaggaugucuucuaucugcccccggagaaaugugacacccuucugugcgauaucggcgaaagcuccccuagccccacaguggaggagucucgcaccaucagaguucucaagaugguggaacccuggcugaagaacaaucaguucuguauuaaaguccugaacccuuacaugcccacggugaucgagcaccucgaacggcuucaacgcaagcacggcgggaugcugguuagaaauccucugucccggaacagcacacaugagauguauuggauuucuaauggaaccggcaacaucguggcuuccgucaauauggugagccgccuccugcuuaacagauuuaccaugacacaccggagaccgacgauugaaaaagacguggaucugggggccggaacccgccaugucaacgcugagcccgagacaccuaauauggacguuaucggcgaacggaucaagagaauuaaagaggaacacaacucuaccuggcacuacgacgaugagaaucccuauaagacaugggccuaccaugggagcuaugaagugaaggcgaccggauccgccucuagcaugaucaacggcguggucaaacuccugacaaagccuugggacgugguucccauggugacccagauggcuaugacggauaccacaccguucggccagcaacgcgucuuuaaagagaagguggacacccggacaccuagauccaugcccgggacccgccggguuaugggaauuacggccgaguggcuguggagaacacucggccgcaauaaaaagccucggcugugcaccagagaagaguucacaaagaaagugcgcaccaacgcugccaugggggccgucuuuacggaagagaaucagugggauagcgcgaaggcugccguggaagacgaggauuucuggaaacuuguugaccgggagagagaacugcacaagcucggaaaauguggcuccugcguguacaacaugauggggaagcgcgagaaaaagcugggcgaauuuggaaaggccaaaggcucuagagcuaucugguacauguggcuuggggcccgguaucuggaguucgaggcucucggauuucugaaugaagaucauugguucagccgcgagaacuccuacucuggcgucgaaggggagggacugcacaagcucggcuauauucugagagacaucagcaaaauccccgggggcgccauguacgcggaugacaccgccggaugggacacacggauuaccgaagaugaccuucauaaugaggagaagaucacacagcagauggauccugaacacagacaacuggcuaacgccauuuuuaaacucaccuaucagaauaagguggucaaggugcagcggcccacaccgaccggcacgguuauggacaucauuucccgcaaagaucagagagggucuggacaagugggcacauacgggcugaacaccuucaccaauauggaggcucagcuuauccggcagauggaaggagagggcguccugagcaaggccgaccucgaaaacccucaucugcccgagaaaaagaucacacaguggcuggagaccaaagggguggaacgccucaagagaauggcgauuuccggcgaugacugcgugguuaagcccaucgaugaccgguuugccaacgcucugcuugcccugaaugauaugggaaaagugcgcaaggacauuccucaauggcagccgagcaaaggcuggcaugauuggcagcagguccccuucuguucucaccauuuccacgagcucaucaugaaggacgggagaaaacuggugguuccuugccggccccaagacgaacuuauuggacgcgcuagaaucucccagggcgccggguggagccugcgggagacagcuugucucggaaaggccuaugcgcagauguggucucugauguacuuucaccgcagagaucugcggcucgccuccaacgcuauuugcagcgccgugccuguccauugggugcccacgucucgcaccacaugguccauccacgcccaucaccaauggaugaccacagaagacaugcugaccgucuggaauagaguguggaucgaggauaacccuuggauggaggacaagacgcccguuaccacaugggaaaaugugccguaccuuggcaaacgggaggaucaguggugugggagccugauuggccucaccuccagagcuacaugggcccagaacaucccuaccgcgauucagcaaguccgcagccugaucggaaaugaagaguuccuugacuauaugcccucuaugaagcgguuuagaaaagaggaagagagcgaaggcgcuauuugguga

SEQ ID NO: 20745 - RNA, 9873 nt, Artificial Sequence
  derived and/or modified CDS sequence (opt5) from DENV-3__EU569688__SS-prME
accagccugugccucaugaugauccugcccgccgcucuugccuuccaccugacauccagagacggagagccucggaugauuguggggaagaacgaacgcggaaagucucuccuguuuaagacggcgagcggcaucaauauguguacccuuauugcuauggaucugggggaaaugugcgacgauacagucaccuacaaguguccgcacaucacagaagccgagcccgaagacauugauugcugguguaaccucaccuccacauggguuaccuauggaacgugcaaucaggccggcgagcacagacgggacaagcgcucuguggcucuggccccucauguggggaugggacuggauaccagaacacagaccuggaugagcgcugagggcgccuggcggcaggucgaaaaaguggagacaugggcgcuccgccaccccggcuucaccauccuggcccuuuuucuggcucauuacaucgggacgucccucacacagaagguugugauuuucauccugcuuaugcuggucaccccuucuaugacaaugagaugugugggaguuggcaaccgggacuuuguggaagggcucagcggagccaccugggucgauguggugcuggagcacggcgggugcgucaccacaauggcuaagaauaaacccacgcuggacauugagcuccagaagaccgaagccacacagcuggcgacccuucgcaaacuguguaucgagggaaagauuacaaacaucaccacggauuccagaugcccuacacagggcgaagccguucucccggaggaacaggaccagaauuauguguguaaacacaccuacguggaucggggcugggggaacggaugcggccuguucgggaagggaagccuugugacaugcgcuaaguuucaaugucuggagcccauugagggcaaagugguucaguaugaaaaucucaaguacacagugaucaucaccguccauacaggggaccagcaccaggugggaaacgagacgcaaggcguuaccgccgaaauuacaccucaggcuucuaccacagaggccauccugcccgaauauggcacccuggggcucgagugcuccccucgcacgggacuggacuucaaugagaugauucuucugaccaugaaaaacaaggccuggauggugcauagacagugguuuuucgaucucccccugccguggacaagcggcgcuaccacagaaaccccuacguggaaucggaaagagcuucuggucacauuuaagaacgcgcacgccaaaaagcaagaaguggucgugcucgggucucaggagggagcuaugcacaccgcccugacaggcgccaccgaaauccaaaauuccgggggcaccagcauuuucgcuggacaucugaagugucgccucaaaauggacaagcuggagcuuaaaggcaugucuuacgccaugugcacaaacacguuuguucugaagaaagagguguccgaaacccagcacgggacaauccucaucaaggucgaguacaagggagaagaugugcccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacacgaucggaguucuggagcagggcaaacggacccuuacaccucagcccauggagcugaaguacucuuggaaaaccugggggaaggccaagauugugacagcugaaacccaaaacuccagcuucaucauugauggaccuaauacacccgagugcccgucugcguccagagccuggaacgucugggaaguggaggacuauggcuuuggcguguucaccacgaauaucuggcucaaacugcgcgaagucuacacacagcugugugaccaccggcuuaugagcgcugccguuaaggaugagagagccgugcacgcugacaugggguacuggaucgagucccagaaaaacggaucuuggaagcucgaaaaagccagccugauugaggugaagaccugcaccuggccuaagucccauacacuguggucuaauggcguccucgaaagcgauaugaucauucccaaaucccuggcggggccuaucagccagcacaacuaucgccccggauaccauacccaaacggcuggcccuuggcaccuugggaagcuggagcucgacuuuaauuauugcgagggaacaaccgugguuauuacagaaaacuguggcacccggggccccucucugagaacaaccacgguguccgggaaacugauccacgaguggugcugucgcagcugcacccuuccgccucuccgguacaugggagaagauggcuguugguaugggauggagaucagacccauuucugaaaaggaggagaauauggucaaaucccuggugagcgccggaucuggcgaaguugacaacuucacaaugggggugcugugccucgccauccuguuugaggaagucaugcggggaaaguucggcaagaaacauaugauugcuggcguguucuuuaccuucguucuucugcucagcgggcagaucacauggcgcgauauggcccacacccugauuaugaucggauccaaugcgagcgacagaaugggcaugggggugacguaccuggcucuuauugccacauuuaagauccagcccuuccuggcccucggauuuuuccugcggaaacucaccucuagagagaaccugcuucugggcgucgggcucgcuauggccacaacccugcaacugccugaagauaucgagcagauggcuaauggaauugcccuuggccugauggcgcucaagcugaucacccaguuugagacauaucagcucuggacggcccugauuucccuuaccuguagcaacacaaucuucacccugacaguggcuuggcgcaccgccacgcucauucuggcuggcgugucccugcuuccggucugccaaucuagcuccaugcggaaaacagacuggcugcccaugaccguugccgccaugggggugccuccccucccucuguuuaucuucucucucaaggauacccugaagagacgcagcuggccccuuaaugaaggagugauggcugucggccugguguccauccuggcgucuagccuccugagaaacgacguuccuauggccgggccccuuguggcuggaggccugcucauugccuguuacgucaucacagggaccuccgccgaucugacaguggagaaagcugccgacguuacgugggaagaggaagcggagcagaccggagugagccauaaccucaugauuacagucgacgaugacggcaccaugcggaucaaggaugacgagacagaaaauauucugaccgugcuucugaaaacggcucugcucaucgucucuggcaucuuuccguacuccauuccugccacccugcuuguguggcacacauggcagaagcagacccaacgcagcgggguucugugggaugugcccucuccucccgagacacagaaagccgaacucgaggagggagucuauagaaucaagcagcagggcauuuucgggaaaacccaagugggaguuggcgugcagaaggaaggggucuuucauacaauguggcacgugacgcggggagcugugcugaccuacaacggcaagcgccucgagccgaauugggccuccguuaaaaaggaccugaucagcuauggcgggggauggagacuuucugcgcaguggcaaaaaggcgaagagguccaggugauugcuguggaaccugggaagaaccccaaaaauuuccagacaaugccuggaaccuuccagaccacaacgggcgagaucggggccauugcccuggauuuuaagcccggaaccuccggcagccccaucaucaaccgggagggcaaggucguggggcuguacggaaauggcguugugaccaagaacgggggauaugucuccggcauugcucaaaccaaugccgaaccugacgggccgacacccgagcucgaagaggaaauguucaagaaacgcaaccugaccaucauggaucuucacccuggcagcggaaagacgagaaaauaccugcccgcuauugugcgggaggccaucaagcgcagacuccggacacugauucucgcgccuaccagaguuguggccgcugagauggaagaggcccugaagggccuucccauccgcuaucagaccacagcuaccaaaucugaacauacagggcgggagaucgucgaccugaugugccacgccaccuuuacgaugagacugcucagcccugugcgcguuccgaauuacaaccugauuaucauggaugaagcccauuucacagaccccgcuuccauugcggcccggggauacaucucuaccagagugggcaugggggaggcugccgccauuuuuaugacagcuaccccucccggaacggccgaugcguucccucagagcaaugcucccauccaggacgaggaacgcgacaucccggagcgguccuggaacucuggcaaugaauggauuaccgauuuugccgggaagacagucugguucgugccuagcaucaaagccggcaacgacauugcuaacugucuuagaaagaauggcaaaaaggugauccaacugucccgcaagaccuuugauacagaguaucagaaaaccaagcucaacgacugggauuucgucguuacaaccgacauuucugagaugggagccaauuuuaaagcggaucgggugaucgaccccagacggugccugaagcccgugauucugacggaugggccugaacgcgucauccucgccggacccaugccugugacagcugccagcgcugcccagagacggggccgcguugggagaaacccgcagaaagagaaugaccaauacaucuucaccggacagccccuuaacaaugaugaagaccacgcucauuggaccgaggccaagaugcugcuggacaacauuaauacaccugaaggcaucauucccgcccucuucgagccugagcgggaaaaguccgccgcuaucgauggggaguauagacugaaaggcgaaagccgcaagaccuuuguggagcuuaugcggagaggagaccugcccgucuggcucgcccacaaaguggcuucugaaggcauuaaguacacagaucgcaaauggugcuucgacgggcagcggaacaaucagauccuggaggagaacauggauguugaaaucuggacgaaggagggagagaagaagaagcugagaccgcgcuggcucgacgcccggaccuauuccgauccucuugcccugaaagaguuuaaggacuucgcugcgggcagaaaaagcauugcccuggaucucgugacagaaaucgggcgcguccccacccaccuggcucauagaacacggaaugcccuugacaaccuggugaugcuccacaccucugagcauggaggcaaggccuaccgccacgcugucgaggaacugccugagacgauggaaacccugcuccuucugggccugaugauucuccugacagggggagccaugcuuuuucugaucuccggcaaagggauuggaaagaccagcaucggccucaucugugugauugcguccucugggaugcuguggauggccgagaucccccugcaauggauugcuagcgccaucguucucgaguucuuuaugauggugcuucugauuccugaacccgagaagcagagaacaccgcaggauaaucaacuggcuuauguggucaucggcauucucacccuggccgcgaucaucgccgcuaacgaaaugggccuucuggagacgacaaaacgggaccucggcauguccaaggaaccugggguugugagccccaccucuuaccuggauguggaccugcaccccgccuccgcuuggacacucuacgccgucgcuaccaccgugauuacaccuaugcuucgccauacgaucgagaauagcaccgccaacguuucucuggcggccauugcuaaccaggccgugguccugaugggacucgacaaaggcuggccgaucagcaagauggaucugggggugccccuucuggcucucggaugcuauucccaggucaauccucugacacugaccgccgccgugcuccuucugauuacacacuacgcgaucaucggccccgggcugcaggcuaaagccaccagagaggcucaaaagcggacggccgccggaauuaugaagaacccuacaguugacggcaucaugaccauugaucucgaccccgugaucuaugauucuaaauucgaaaagcagcugggccaggucaugcuucuggugcucugugcuguucagcugcugcucaugagaaccagcugggcccuuugcgaggcgcugacacuggccaccgggccuauuacaacgcucugggaaggauccccgggcaaauuuuggaauaccacaaucgcugugucuauggccaacaucuuccgcgggagcuaccuggcuggagccggccuugcguuuuccauuaugaaaagcgucgggaccggaaaacggggcacaggcucucaaggggagacccugggagaaaaguggaagaaaaagcucaaucagcuguccagaaaagaguucgaccuguauaagaaaagcggcaucacggagguggaucgcaccgaagccaaggaggggcucaaacggggagaaauuacacaucacgcuguguccagaggcucugccaaacuucagugguuuguugagcggaacauggucauccccgaagggcgcgugauugaccugggauguggcagaggcggguggagcuacuauugcgcuggacugaagaaagugaccgagguccggggcuacacaaaagggggaccuggccaugaggaacccguuccuauguccaccuacggguggaauaucgugaaacucaugucuggaaaggauguguucuaucugcccccggagcgcugugacacacuucugugcgauauuggcgaaagcuccccuagccccaccgucgaggagucuagaacgauccgggugcucaaaaugguugaacccuggcugaagaacaaucaguucuguaucaaggugcugaacccuuacaugcccacagucauugagcaccucgaacgccuucaaagaaaacacggcgggaugcuggugcggaauccucugucccgcaacagcacccaugagauguauuggaucucuaauggaaccggcaacauuguugccuccgugaauauggucagcagacuccugcuuaaccgguuuacaaugacgcacagacgcccgaccaucgaaaaggacguggaucugggggcuggaacacggcaugugaacgccgagcccgagaccccuaauauggacgucauuggcgaaagaaucaaacgcaucaaggaggaacacaacucuacauggcacuacgacgaugagaaucccuauaaaaccugggcguaccaugggagcuaugaaguuaaggccacaggauccgcuucuagcaugauuaacggcguggugaagcuccugaccaaaccuugggacgucgugcccaugguuacgcagauggccaugaccgauacaaccccguucggccagcaacggguguuuaaggagaaagucgacacaagaaccccucgcuccaugcccgggacgcggagagugaugggaaucacagcugaguggcuguggcgcacccucggccggaauaagaaaccuagacugugcacacgcgaagaguucaccaagaagguucggacgaacgccgccaugggggcgguguuuaccgaagagaaucagugggauagcgcuaaagccgccgucgaagacgaggauuucuggaaacuuguggacagagagcgcgaacugcacaaacucggaaaguguggcuccugcguuuacaacaugauggggaaaagagagaagaaacugggcgaauuuggaaaggcuaagggcucucgggccauuugguacauguggcuuggggcucgcuaucuggaguucgaggcccucggauuucugaaugaagaucauugguucagcagagagaacuccuacucuggcguggaaggggagggacugcacaaacucggcuauauccugcgggacauuagcaagauccccgggggcgcgauguacgccgaugacacagcuggaugggacaccagaaucacagaagaugaccuucauaaugaggagaaaauuacccagcagauggauccugaacaccggcaacuggccaacgcuaucuuuaagcucacauaucagaauaaagucgugaagguccagcgccccaccccgacgggcacagugauggacauuaucuccagaaaggaucagcgggggucuggacaaguuggcaccuacgggcugaacaccuucacaaauauggaggcccagcuuauucgccagauggaaggagagggcgugcugagcaaagcggaccucgaaaacccucaucugcccgagaagaaaaucacccaguggcuggagacaaagggggucgaaagacucaaacggauggccaucuccggcgaugacugcguggugaagcccauugaugaccgcuuugcuaacgcccugcuugcucugaaugauaugggaaagguuagaaaagacaucccucaauggcagccgagcaagggcuggcaugauuggcaacaggugcccuucuguucucaccauuuccacgagcucauuaugaaagacgggcggaagcuggucgugccuugccgcccccaagacgaacuuaucggacgggcgcggauuucccagggcgcuggguggagccugcgcgagacggccugucucggaaaagcguaugcccagauguggucucugauguacuuucacagacgggaucugcgccucgcuuccaacgccaucugcagcgccguuccugugcauuggguccccaccucuagaacaaccugguccauucacgcucaucaccaauggaugacaaccgaagacaugcugacgguguggaaucgggucuggaucgaggauaacccuuggauggaggacaagacccccgugacaaccugggaaaauguuccguaccuuggcaagagagaggaucaguggugugggagccugaucggccucacaucccgcgccaccugggcgcagaacauuccuacggcuauccagcaagugcggagccugauuggaaaugaagaguuccuugacuauaugcccucuaugaaaagauuucgcaaggaggaagagagcgaaggcgccaucugguga

SEQ ID NO: 20746 - RNA, 9873 nt, Artificial Sequence
  derived and/or modified CDS sequence (opt5) from DENV-3__EU529686__SS-prME
accagccugugccucaugaugauccugcccgccgcucuugccuuccaccugacaucccgggacggcgaaccucggaugauuguggggaagaacgaacgcggaaagucucuccuguuuaagacggcgagcggcaucaauauguguacccuuauugcuauggaucugggggagaugugcgacgauacagugaccuacaaguguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaacggcaagcgccucgagccgaauugggcuuccgucaaaaaggaccugauuagcuauggcgggggauggagacuuucugcccaguggcaaaaaggcgaagagguccaggugaucgcggucgaaccugggaagaaccccaaaaauuuccagaccaugccuggaacauuccagaccaccacaggcgagauuggggcuaucgcccuggauuuuaagcccggaacguccggcagccccaucauuaaccgggagggcaaggugguugggcuguacggaaauggcguggucaccaaaaacgggggauauguguccggcaucgcccaaacaaaugcugaaccugacgggccgacccccgagcucgaagaggaaauguucaagaaacgcaaccugacaauuauggaucuucacccuggcagcggaaagaccagaaaauaccugcccgccaucguucgggaggcuauuaagcgcagacuccggacgcugauccucgccccuacaagaguggucgcggccgagauggaagaggcucugaagggccuucccauccgcuaucagaccaccgccacaaaaucugaacauaccgggcgggagauuguggaccugaugugccacgcuacauuuaccaugagacugcucagcccuguucgcgugccgaauuacaaccugaucauuauggaugaagcccauuucacggaccccgccuccaucgcugcgcggggauacauuucuacaagagucggcaugggggaggccgcugccaucuuuaugaccgccacaccucccggaaccgcugaugccuucccucagagcaaugcgcccauccaggacgaggaacgcgacauuccggagcgguccuggaacucuggcaaugaauggaucacggauuuugcugggaagaccgugugguucgugccuagcauuaaagccggcaacgacaucgccaacugucuuagaaagaauggcaaaaaggucauucaacugucccgcaagacauuugauaccgaguaucagaaaacaaagcucaacgacugggauuucguugugaccacagacaucucugagaugggagcuaauuuuaaagccgaucgggugauugaccccagacggugccugaagcccgucauccugaccgaugggccugaacgcgugauccucgcgggacccaugccuguuacggccgcuagcgccgcucagagacggggccgcguggggagaaacccgcagaaagagaaugaccaauacauuuucacaggacagccccuuaacaaugaugaagaccacgcccauuggaccgaggcuaagaugcugcuggacaacaucaauaccccugaaggcauuauccccgcccucuucgagccugagcgggaaaaguccgcggccauugauggggaguauagacugaaaggcgaaagccgcaagacauuugucgagcuuaugcggagaggagaccugcccguguggcucgcucacaaaguugccucugaaggcaucaaguacaccgaucgcaaauggugcuucgacgggcagcggaacaaucagauccuggaggagaacauggauguggaaauuuggacaaaggagggagagaagaagaagcugagaccgcgcuggcucgacgcucggacguauuccgauccucuugcccugaaagaguuuaaggacuucgccgcuggcagaaaaagcaucgcgcuggaucucgucaccgaaauugggcgcgugcccacacaccuggcccauagaacccggaaugcucuugacaaccuggucaugcuccacacaucugagcauggaggcaaggccuaccgccacgccguggaggaacugccugagaccauggaaacgcugcuccuucugggccugaugauccuccugaccgggggagcuaugcuuuuucugauuuccggcaaagggaucggaaagacaagcaucggccucauuuguguuaucgccuccucugggaugcuguggauggcggagauuccccugcaauggaucgccagcgcuauugugcucgaguucuuuaugauggugcuucugaucccugaacccgagaagcagagaaccccgcaggauaaucaacuggccuaugucguuauuggaauccucacacuggcugccaucauugcggccaacgaaaugggccuucuggagaccacgaaacgggaccucggcauguccaaggaaccugggguggugagccccacaucuuaccuggaugucgaccugcaccccgcuuccgccuggacccucuacgcuguggccacaaccguuaucaccccuaugcuucgccauacaauugagaauagcacggcuaacgugucucuggccgcgaucgccaaccaggcugucgugcugaugggacucgacaaaggcuggccgauuagcaagauggaucugggggucccccuucuggcccucggaugcuauucccaggugaauccucugacccugacagcugccguucuccuucugaucacccacuacgccaucauuggccccgggcugcaggcgaaagcuacaagagaggcccaaaagcggaccgcugccggaaucaugaagaacccuacgguggacggcauuaugacaaucgaucucgaccccgucauuuaugauucuaaauucgaaaagcagcugggccaggugaugcuucugguucucugugccgugcagcugcugcucaugagaaccagcugggcucuuugcgaggcccugacccuggcgacagggccuaucaccacacucugggaaggauccccgggcaaauuuuggaauacgaccaucgccgucucuauggcuaacauuuuccgcgggagcuaccuggccggagcuggccuugccuuuuccaucaugaaaagcguggggacaggaaaacggggcaccggcucucaaggggagacacugggagaaaaguggaagaaaaagcucaaucagcuguccagaaaagaguucgaccuguauaagaaaagcggcauuaccgagguggaucgcacggaagcgaaggaggggcucaaacggggagaaaucacccaucacgccguuuccagaggcucugcuaaacuucagugguuugucgagcggaacauggugauucccgaagggcgcgugaucgaccugggauguggcagaggcggguggagcuacuauugcgccggacugaagaaagucacagagguucggggcuacaccaaagggggaccuggccaugaggaacccgugccuauguccacauacggguggaauauugugaaacucaugucuggaaaggaugucuucuaucugcccccggagaaaugugacacccuucugugcgauaucggcgaaagcuccccuagccccacaguggaggagucucgcaccaucagaguucucaagaugguggaacccuggcugaagaacaaucaguucuguauuaaaguccugaacccuuacaugcccacggugaucgagcaccucgaacggcuucaacgcaagcacggcgggaugcugguuagaaauccucugucccggaacagcacacaugagauguauuggauuucuaauggaaccggcaacaucguggcuuccgucaauauggugagccgccuccugcuuaacagauuuaccaugacacaccggagaccgacgauugaaaaagacguggaucugggggccggaacccgccaugucaacgcugagcccgagacaccuaauauggacguuaucggcgaacggaucaagagaauuaaagaggaacacaacucuaccuggcacuacgacgaugagaaucccuauaagacaugggccuaccaugggagcuaugaagugaaggcgaccggauccgccucuagcaugaucaacggcguggucaaacuccugacaaagccuugggacgugguucccauggugacccagauggcuaugacggauaccacaccguucggccagcaacgcgucuuuaaagagaagguggacacccggacaccuagauccaugcccgggacccgccggguuaugggaauuacggccgaguggcuguggagaacacucggccgcaauaaaaagccucggcugugcaccagagaagaguucacaaagaaagugcgcaccaacgcugccaugggggccgucuuuacggaagagaaucagugggauagcgcgaaggcugccguggaagacgagaacuucuggaaacuuguugaucgggagagagaacugcacaagcucggaaaauguggcuccugcguguacaauaugauggggaagcgcgagaaaaagcugggcgaauuuggaaaggccaaaggcucuagagcuaucugguacauguggcuuggggcccgguaucuggaguucgaggcucucggauuucugaacgaagaccauugguucagccgcgaaaauuccuacucuggcgucgagggggagggacugcacaagcucggcuauauucugagagauaucagcaaaauccccgggggcgccauguacgcggacgauaccgccggaugggacacacggauuaccgaagacgaucuucauaacgaggagaagaucacacagcagauggacccugaacacagacaacuggcuaaugccauuuuuaaacucaccuaucagaacaagguggucaaggugcagcggcccacaccgaccggcacgguuauggauaucauuucccgcaaagaccagagagggucuggacaagugggcacauacgggcugaauaccuucaccaacauggaggcucagcuuauccggcagauggaaggagagggcguccugagcaaggccgaucucgaaaacucccaucugccugagaaaaagaucacacaguggcuggagaccaaagggguggaacgccucaagagaauggcgauuagcggcgacgauugcgugguuaagcccaucgacgaucgguuugccaaugcucugcuugcccugaacgacaugggaaaagugcgcaaggauauuccccaauggcagccuucuaaaggcuggcaugacuggcagcaggucccguucuguucccaccauuuccacgagcucaucaugaaggaugggagaaaacuggugguucccugccggccucaagacgaacuuauuggacgcgcuagaaucagccagggcgccggguggucucugcgggagacagcuugucucggaaaggccuaugcgcagauguggucccugauguacuuucaccgcagagaccugcggcucgccagcaaugcuauuugcucugccgugcccguccauugggugccuacgucccgcaccacauggagcauccacgcccaucaccaauggaugaccacagaagauaugcugaccgucuggaacagaguguggaucgaggacaaucccuggauggaggauaagacgccuguuaccacaugggaaaacgugcccuaccuuggcaaacgggaggaccaguggugugggucccugauuggccucaccagcagagcuacaugggcccagaauaucccgaccgcgauucagcaaguccgcucucugaucggaaacgaagaguuccuugauuauaugccuagcaugaagcgguuuagaaaagaggaagaguccgaaggcgcuauuugguga

SEQ ID NO: 20747 - RNA, 9873 nt, Artificial Sequence
  derived and/or modified CDS sequence (opt5) from DENV-3__EU529687__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcucggggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaacggcaagcgccucgagccgaauugggcuuccgucaaaaaggaccugauuagcuauggcgggggauggagacuuucugcccaguggcaaaaaggcgaagaggugcaggugaucgcggucgaaccugggaagaaccccaaaaauuuccagaccaugccuggaacauuccagaccaccacaggcgagauuggggcuaucgcccuggauuuuaagcccggaacguccggcagccccaucauuaaccgggagggcaaggugguugggcuguacggaaauggcguggucaccaaaaacgggggauauguguccggcaucgcccaaacaaaugcugaaccugacgggccgacccccgagcucgaagaggaaauguucaagaaacgcaaccugacaauuauggaucuucacccuggcagcggaaagaccagaaaauaccugcccgccaucguucgggaggcuauuaagcgcagacuccggacgcugauccucgccccuacaagaguggucgcggccgagauggaagaggcucugaagggccuucccauccgcuaucagaccaccgccacaaaaucugaacauaccgggcgggagauuguggaccugaugugccacgcuacauuuaccaugagacugcucagcccuguucgcgugccgaauuacaaccugaucauuauggaugaagcccauuucacggaccccgccuccaucgcugcgcggggauacauuucuacaagagucggcaugggggaggccgcugccaucuuuaugaccgccacaccucccggaaccgcugaugccuucccucagagcaaugcgcccauccaggacgaggaaaaggacauuccggagcgcuccuggaacucuggcaaugaauggaucacggauuuugcugggaaaaccgugugguucgugccuagcauuaaggccggcaacgacaucgccaacugucuucggaaaaauggaaagaaggucauucaacuguccagaaaaacauuugauaccgaguaucagaagacaaaacucaacgacugggauuucguugugaccacagacaucucugagaugggcgcuaauuuuaaggccgaucgcgugauugacccccggagaugccugaaacccgucauccugaccgaugggccugaacgggugauccucgcgggacccaugccuguuacggccgcuagcgccgcucagcgcagaggccggguggggcgcaacccgcagaaggagaaugaccaauacauuuucacaggacagccccuuaacaaugaugaagaccacgcccauuggaccgaggcuaagaugcugcuggacaacaucaauaccccugaaggcauuauccccgcccucuucgagccugagagagaaaaauccgcggccauugauggggaguaucggcugaagggcgaaagcagaaaaacauuugucgagcuuaugcgccggggagaccugcccguguggcucgcucacaagguugccucugaaggcaucaaauacaccgauagaaaguggugcuucgacgggcagcgcaacaaucagauccuggaggagaacauggauguggaaauuuggacaaaagagggagaaaagaagaaacugcggccgagauggcucgacgcucgcacguauuccgauccucuugcccugaaggaguuuaaagacuucgccgcuggccggaagagcaucgcgcuggaucucgucaccgaaauugggagagugcccucucaccuggcccaucgcacaagaaaugcucuugacaaccuggucaugcuccacaccuccgagcauggaggcaaagccuaccggcacgccguggaggaacugccugagacaauggaaacccugcuccuucugggccugaugauccuccugacggggggagcuaugcuuuuucugauuagcggcaaggggaucggaaagaccuccaucggccucauuuguguuaucgccucuagcgggaugcuguggauggcggagauuccccugcaauggaucgccuccgcuauugugcucgaguucuuuaugauggugcuucugaucccugaacccgagaaacagcgcacaccgcaggauaaucaacuggccuaugucguuauuggaauccucacccuggcugccaucauugcggccaacgaaaugggccuucuggagacaaccaagagagaccucggcaugagcaaagaaccugggguggugucucccacguccuaccuggaugucgaccugcaccccgcuagcgccuggacacucuacgcuguggccaccacaguuaucaccccuaugcuucggcauaccauugagaauucuacagcuaacgugagccuggccgcgaucgccaaccaggcugucgugcugaugggacucgacaagggcuggccgauuuccaaaauggaucugggggucccccuucuggcccucggaugcuauucucaggugaauccucugacgcugaccgcugccguucuccuucugaucacacacuacgccaucauuggccccgggcugcaggcgaaggcuacccgcgaggcccaaaagagaacagcugccggaaucaugaaaaacccuaccguggacggcauuaugacgaucgaucucgaccccgucauuuaugauagcaaguucgaaaaacagcugggccaggugaugcuucugguucucugugccgugcagcugcugcucaugcggacauccugggcucuuugcgaggcccugacccuggcgaccgggccuaucacaacccucugggaaggaucuccgggcaaguuuuggaauacaacgaucgccgucagcauggcuaacauuuucagaggguccuaccuggccggagcuggccuugccuuuagcaucaugaaaucuguggggaccggaaagcgcggcacaggcucccaaggggagacccugggagaaaaguggaaaaagaaacucaaucagcugagccggaaggaguucgaccuguauaaaaaguccggcauuacagagguggauagaaccgaagcgaaagaggggcucaagcgcggagaaaucacgcaucacgccguuucucggggcagcgcuaagcuucagugguuugucgagagaaacauggugauucccgaagggcgggugaucgaccugggauguggccgcggcgggugguccuacuauugcgccggacugaaaaaggucaccgagguuagaggcuacacaaaagggggaccuggccaugaggaacccgugccuaugucuaccuacggguggaauauugugaagcucaugagcggaaaagaugucuucuaucugcccccggagaagugugacacacuucugugcgauaucggcgaauccagcccuucucccaccguggaggagucccggacaauccgcguucucaagaugguggaacccuggcugaaaaacaaucaguucuguauuaagguccugaacccuuacaugcccaccgugaucgagcaccucgaaagacuucaacggaaacacggcgggaugcugguucgcaauccucugagcagaaacucuacgcaugagauguauuggauuuccaauggaacaggcaacaucguggcuagcgucaauauggugucucggcuccugcuuaaccgcuuuaccaugacccacagacggccgacaauugaaaaggacguggaucugggggccggaacgagacaugucaacgcugagcccgagaccccuaauauggacguuaucggcgaacgcaucaaacggauuaaggaggaacacaacagcacauggcacuacgacgaugagaaucccuauaagaccugggccuaccauggguccuaugaagugaaagcgacaggaucugccagcuccaugaucaacggcguggucaagcuccugaccaaaccuugggacgugguucccauggugacacagauggcuaugaccgauacgaccccguucggccagcaaagagucuuuaaggagaaaguggacacacgcaccccucggagcaugcccgggacaagacgcguuaugggaauuaccgccgaguggcuguggcggacgcucggcagaaauaagaagccucgccugugcacacgggaagaguucaccaaaaaggugagaacaaacgcugccaugggggccgucuuuaccgaagagaaucagugggauuccgcgaaagcugccguggaagacgaggauuucuggaagcuuguugaccgcgagcgggaacugcacaaacucggaaaguguggcucuugcguguacaacaugauggggaaaagagagaagaagcugggcgaauuuggaaaagccaagggcagccgcgcuaucugguacauguggcuuggggccagauaucuggaguucgaggcucucggauuucugaaugaagaucauugguucucccgggagaacucuuacagcggcgucgaaggggagggacugcacaaacucggcuauauucugcgcgacaucuccaagauccccgggggcgccauguacgcggaugacacggccggaugggacaccagaauuacagaagaugaccuucauaaugaggagaaaaucacccagcagauggauccugaacaccggcaacuggcuaacgccauuuuuaagcucacauaucagaauaagguggucaaagugcagagacccaccccgacaggcaccguuauggacaucauuucucggaaggaucagcgcgggagcggacaagugggcacguacgggcugaacacauucaccaauauggaggcucagcuuaucagacagauggaaggagagggcguccuguccaaagccgaccucgaaaacccucaccugcccgagaagaaaaucacccaguggcuggagacaaaggggguggaacggcucaagcgcauggcgauuagcggcgaugacugcgugguuaaacccaucgaugacagauuugccaacgcucugcuugcccugaaugauaugggaaaggugcggaaagacauuccucaauggcagccgucuaagggcuggcaugauuggcagcagguccccuucuguucccaccauuuccacgagcucaucaugaaagacgggcgcaagcuggugguuccuugcagaccccaagacgaacuuauuggacgggcucgcaucagccagggcgccggguggucucugagagagaccgcuugucucggaaaggccuaugcgcagauguggucccugauguacuuucaccggcgcgaucugagacucgccagcaacgcuauuugcucugccgugccuguccauugggugcccacaucccggacgaccuggagcauccacgcccaucaccaauggaugacaaccgaagacaugcugacagucuggaaucgcguguggaucgaggauaacccuuggauggaggacaaaacccccguuacgaccugggaaaaugugccguaccuuggcaagagagaggaucaguggugugggucccugauuggccucacaagccgggcuaccugggcccagaacaucccuacagcgauucagcaagucagaucucugaucggaaaugaagaguuccuugacuauaugcccagcaugaaacgcuuucggaaggaggaagaguccgaaggcgcuauuugguga

SEQ ID NO: 20748 - RNA, 9873 nt, Artificial Sequence
  derived and/or modified CDS sequence (opt5) from DENV-3__KF955449__SS-prME
accagccugugccucaugaugauccugcccgccgcucuugccuuccaccugacgucccgggacggagaaccucggaugauuguggggaagaacgaacgcggaaagucucuccuguuuaagacggcgagcggcaucaauauguguacccuuauugcuauggaucugggggagaugugcgacgauacagucaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucgugcugcuuaugcugguuaccccuucuaugacaaugagaugugugggagucggcaaccgggacuuuguggaagggcucagcggagcuaccuggguggaugucguucuggagcacggcgggugcgugaccacaauggccaagaauaaacccacgcuggacaucgagcuccagaagaccgaagcuacacagcuggccacccuucgcaaacuguguauugagggaaagaucacaaacauuaccacggauuccagaugcccuacacagggcgaagcggugcucccggaggaacaggaccagaauuaugucuguaaacacaccuacguggaucggggcugggggaacggaugcggccuguucgggaagggaagccuuguuaccugcgccaaguuucaaugucuggagcccaucgagggcaaagugguccaguaugaaaaucucaaguacacagugauuaucaccguucauacaggggaccagcaccaggugggaaacgagacgcaaggcgucaccgcugaaaucacaccucaggccucuaccacagaggcuauucugcccgaauauggcacccuggggcucgagugcuccccucgcacgggacuggacuucaaugagaugauccuucugaccaugaaaaacaaggccuggauggugcauagacagugguuuuucgaucucccccugccguggacaagcggcgccaccacagaaaccccuacguggaaucggaaagagcuucuggucacauuuaagaacgcucacgcgaaaaagcaagaagugguugugcucgggucucaggagggagccaugcacaccgcucugacaggcgccaccgaaauucaaaauuccgggggcaccagcaucuucgccggacaucugaagugucgccucaaaauggacaagcuggagcuuaaaggcaugucuuacgcuaugugcacaaacacguuuguccugaagaaagagguguccgaaacccagcacgggacaauucucaucaagguugaguacaagggagaagaugugcccuguaaaaucccuuucagcaccgaggacggccaagggaaggcccauaacggaagacugauuacagcgaaucccgucgugaccaaaaaggaggaacccgugaacaucgaggcugaaccuccguucggcgaguccaauauuguuaucgggauuggcgauaacgcccugaaaaucaauugguauaagaagggaucuagcaucggcaaaauguuugaagccacggcuagaggggccagacgcauggcuauucuuggagacacagccugggauuucggcuccgucgggggagugcucaacagccugggcaagauggugcaccagaucuuugggucugcguacaccgcccuguucuccggcgucagcugggugaugaaaauuggaaucggcguucuccugaccuggauugggcuuaauucuaagaacacaagcauguccuuuucuugcaucgcuauuggaaucaucacccuguaucucggcgccgugguccaggcugacauggggugugugauuaauuggaaaggaaaggagcugaagugcggcagcgggaucuucguuacaaacgaggugcauacguggaccgaacaguacaaauuucaagccgauucccccaagcggcuggcgacagccauugcuggcgccugggagaauggagucuguggcaucagaagcaccacacgcauggaaaaccuucucuggaaacagauugcuaaugagcugaacuauauccugugggaaaauaacaucaagcucaccgugguugugggggacauuaucggaguccuggagcagggcaaacggacgcuuaccccucagcccauggagcugaaguacucuuggaaaacaugggggaaggccaagauugugaccgccgaaacacaaaacuccagcuucaucauugauggaccuaauacccccgagugcccgucugcuuccagagcguggaacgugugggaagucgaggacuauggcuuuggcguuuucacaaccaauaucuggcucaaacugcgcgaaguguacacgcagcugugugaccaccggcuuaugagcgccgcugugaaggaugagagagccguccacgccgacaugggguacuggaucgagucccagaaaaacggaucuuggaagcucgaaaaagcuagccugauugaggugaagacaugcaccuggccuaagucccauacccuguggucuaauggcguucucgaaagcgauaugaucauucccaaaucccuggccgggccuaucagccagcacaacuaucgccccggauaccauacacaaaccgcgggcccuuggcaccuugggaagcuggagcucgacuuuaauuauugcgagggaacgacaguggucauuaccgaaaacuguggcacacggggccccucucugagaaccacaaccguguccgggaaacugauccacgaguggugcugucgcagcugcacgcuuccgccucuccgguacaugggagaagauggcuguugguaugggauggagaucagacccauuucugaaaaggaggagaauaugguuaaaucccuggugagcgcuggaucuggcgaagucgacaacuucaccaugggggugcugugccucgccauccuguuugaggaaguuaugcggggaaaguucggcaagaaacauaugauugccggcguguucuuuacauucguccuucugcucagcgggcagaucaccuggcgcgauauggcucacacacugauuaugaucggauccaaugccagcgacagaaugggcaugggggugaccuaccuggcgcuuauugcuacguuuaagauccagcccuuccuggcccucggauuuuuccugcggaaacucacaucuagagagaaccugcuucugggcguggggcucgccauggcuaccacacugcaacugccugaagauaucgagcagauggccaauggaauugcucuuggccugauggcccucaagcugaucacccaguuugagaccuaucagcucuggacagcgcugauuucccuuacguguagcaacaccaucuucacacugaccgucgccuggcgcacagcuacccucauucuggccggcguuucccugcuuccggugugccaaucuagcuccaugcggaaaacggacuggcugcccaugacaguggcugccaugggggucccuccccucccucuguuuaucuucucucucaaggauacccugaagagacgcagcuggccccuuaaugaaggagugauggccguuggccugguguccauccuggcuucuagccuccugagaaacgacgucccuauggcggggccccuuguggccggaggccugcucauugcuuguuacguuaucaccgggacauccgccgaucugaccguggagaaagccgcugacgucacaugggaagaggaagccgagcagacgggagugagccauaaccucaugauuaccgucgacgaugacggcacaaugcggaucaaggaugacgagaccgaaaauauucugacagugcuucugaaaaccgcgcugcucaucguuucuggcaucuuuccguacuccauuccugcuacgcugcuuguguggcacaccuggcagaagcagacacaacgcagcgggguccugugggaugugcccucuccucccgagacccagaaagccgaacucgaggagggaguuuauagaaucaagcagcagggcauuuucgggaaaacacaagugggagucggcgugcagaaggaagggguguuucauaccauguggcacguuacacggggagccguccugacguacaacggcaagcgccucgagccgaauugggcuuccgugaaaaaggaccugaucagcuauggcgggggauggagacuuucugcccaguggcaaaaaggcgaagaggugcaggucauugcgguggaaccugggaagaaccccaaaaauuuccagaccaugccuggaacauuccagaccaccacaggcgagaucggggcuauugcccuggauuuuaagcccggaacguccggcagccccaucaucaaccgggagggcaagguuguggggcuguacggaaauggcgucgugaccaaaaacgggggauauguuuccggcauugcccaaacaaaugcugaaccugacgggccgacccccgagcucgaagaggaaauguucaagaaacgcaaccugacaaucauggaucuucacccuggcagcggaaagaccagaaaauaccugcccgccauugugcgggaggcuaucaagcgcagacuccggacgcugauucucgccccuacaagagucguggcggccgagauggaagaggcucugaagggccuucccauccgcuaucagaccaccgccacaaaaucugaacauaccgggcgggagaucguugaccugaugugccacgcuacauuuaccaugagacugcucagcccugugcgcgucccgaauuacaaccugauuaucauggaugaagcccauuucacggaccccgccuccauugcugcgcggggauacaucucuacaagagugggcaugggggaggccgcugccauuuuuaugaccgccacaccucccggaaccgcugaugccuucccucagagcaaugcgcccauccaggacgaggaacgcgacaucccggagcgguccuggaacucuggcaaugaauggauuacggauuuugcugggaagaccgugugguucgucccuagcaucaaagccggcaacgacauugccaacugucuuagaaagaauggcaaaaagguuauccaacugucccgcaagacauuugauaccgaguaucagaaaacaaagcucaacgacugggauuucguggugaccacagacauuucugagaugggagcuaauuuuaaagccgaucgggucaucgaccccagacggugccugaagcccgugauucugaccgaugggccugaacgcguuauccucgcgggacccaugccugugacggccgcuagcgccgcucagagacggggccgcgucgggagaaacccgcagaaagagaaugaccaauacaucuucacaggacagccccuuaacaaugaugaagaccacgcccauuggaccgaggcuaagaugcugcuggacaacauuaauaccccugaaggcaucauucccgcccucuucgagccugagcgggaaaaguccgcggccaucgauggggaguauagacugaaaggcgaaagccgcaagacauuuguggagcuuaugcggagaggagaccugcccguuuggcucgcucacaaaguggccucugaaggcauuaaguacaccgaucgcaaauggugcuucgacgggcagcggaacaaucagauccuggaggagaacauggaugucgaaaucuggacaaaggagggagagaagaagaagcugagaccgcgcuggcucgacgcucggacguauuccgauccucuugcccugaaagaguuuaaggacuucgccgcuggcagaaaaagcauugcgcuggaucucgugaccgaaaucgggcgcguccccucucaccuggcccauagaacacggaaugcucuugacaaccuggugaugcuccacaccuccgagcauggaggcaaggccuaccgccacgccguugaggaacugccugagacaauggaaacccugcuccuucugggccugaugauucuccugacagggggagcuaugcuuuuucugaucagcggcaaagggauuggaaagaccuccaucggccucaucugugugauugccucuagcgggaugcuguggauggcggagaucccccugcaauggauugccuccgcuaucgugcucgaguucuuuaugaugguccuucugauuccugaacccgagaagcagagaacaccgcaggauaaucaacuggccuauguugugaucggcauucucacccuggcugccaucaucgcggccaacgaaaugggccuucuggagacaaccaaacgggaccucggcaugagcaaggaaccugggguggucucucccacguccuaccuggauguggaccugcaccccgcuagcgccuggacacucuacgcuguugccaccacagugauuaccccuaugcuucgccauaccaucgaaaauucuacagcuaacgucagccuggccgcgauugccaaccaggcugugguccugaugggacucgacaaaggcuggccgaucuccaagauggaucugggggugccccuucuggcccucggaugcuauucucagguuaauccucugacgcugaccgcugccgugcuccuucugauuacacacuacgccaucaucggccccgggcugcaggcgaaagcuaccagagaggcccaaaagcggacagcugccggaauuaugaagaacccuaccgucgacggcaucaugacgauugaucucgaccccgugaucuaugauagcaaauucgagaagcagcugggccagguuaugcuucuggugcucugugccguccagcugcugcucaugagaacauccugggcucuuugcgaggcccugacccuggcgaccgggccuauuacaacccucugggaaggaucuccgggcaaauuuuggaauacaacgaucgccgugagcauggcuaacaucuuccgcggguccuaccuggccggagcuggccuugccuuuagcauuaugaagucuguggggaccggaaaacggggcacaggcucccaaggggagacccugggagaaaaguggaagaaaaagcucaaucagcugagcagaaaagaguucgaccuguauaagaaauccggcaucacagagguugaucgcaccgaagcgaaggaggggcucaaacggggagaaauuacgcaucacgccgucucuagaggcagcgcuaaacuucagugguuuguggagcggaacauggugauccccgaagggcgcgucauugaccugggauguggcagaggcgggugguccuacuauugcgccggacugaagaaaguuaccgaggugcggggcuacacaaaagggggaccuggccaugaggaacccgugccuaugucuaccuacggguggaauaucgucaaacucaugagcggaaaggauguguucuaucugcccccggagaaaugugacacacuucugugcgauauuggcgaauccagcccuucucccaccguugaggagucccgcacaaucagagugcucaagauggucgaacccuggcugaagaacaaucaguucuguaucaaagugcugaacccuuacaugcccaccguuauugagcaccucgaacggcuucaacgcaagcacggcgggaugcuggugagaaauccucugagccggaacucuacgcaugagauguauuggaucuccaauggaacaggcaacauugucgcuagcgugaauauggugucucgccuccugcuuaacagauuuaccaugacccaccggagaccgacaaucgaaaaagacgucgaucugggggccggaacgcgccauguuaacgcugagcccgagaccccuaauauggacgugauuggcgaacggaucaagagaaucaaagaggaacacaacagcacauggcacuacgacgaugagaaucccuauaagaccugggccuaccauggguccuaugaagugaaggcgacaggaucugccagcuccaugauuaacggcgucgugaaacuccugaccaagccuugggacguugugcccauggucacacagauggcuaugaccgauacgaccccguucggccagcaacgcguguuuaaagagaagguugacacacggaccccuagaagcaugcccgggacacgccgggugaugggaaucaccgccgaguggcuguggagaacgcucggccgcaauaaaaagccucggcugugcacaagagaagaguucaccaagaaaguccgcacaaacgcugccaugggggccguguuuaccgaagagaaucagugggauuccgcgaaggcugccguugaagacgaggauuucuggaaacuuguggaccgggagagagaacugcacaagcucggaaaauguggcucuugcgucuacaacaugauggggaagcgcgagaaaaagcugggcgaauuuggaaaggccaaaggcagcagagcuauuugguacauguggcuuggggcccgguaucuggaguucgaggcucucggauuucugaaugaagaucauugguucucccgcgagaacucuuacagcggcguggaaggggagggacugcacaagcucggcuauauccugagagacauuuccaaaauccccgggggcgccauguacgcggaugacacggccggaugggacacccggaucacagaagaugaccuucauaaugaggagaagauuacccagcagauggauccugaacacagacaacuggcuaacgccaucuuuaaacucacauaucagaauaaggucgugaagguucagcggcccaccccgacaggcaccgugauggacauuaucucucgcaaagaucagagagggagcggacaagucggcacguacgggcugaacacauucaccaauauggaggcucagcuuauucggcagauggaaggagagggcgugcuguccaaggccgaccucgaaaacccucaucugcccgagaaaaagaucacccaguggcuggagacaaaagggguggaacgccucaagagaauggcgaucagcggcgaugacugcguugugaagcccauugaugaccgguuugccaacgcucugcuugcccugaaugauaugggaaaaguccgcaaggacaucccucaauggcagccgucuaaaggcuggcaugauuggcaacaggugcccuucuguucccaccauuuccacgagcucauuaugaaggacgggagaaaacugguugugccuugccggccccaagacgaacuuaucggacgcgcuagaauuagccagggcgccggguggucucugcgggagaccgcuugucucggaaaggccuaugcgcagauguggucccugauguacuuucaccgcagagaucugcggcucgccagcaacgcuaucugcucugccgucccugugcauuggguccccacaucccgcacgaccuggagcauucacgcccaucaccaauggaugacaaccgaagacaugcugacaguguggaauagaguuuggaucgaggauaacccuuggauggaggacaagacccccgugacgaccugggaaaaugucccguaccuuggcaaacgggaggaucaguggugugggucccugaucggccucacaagcagagcuaccugggcccagaacauuccuacagcgauccagcaagugcgcucucugauuggaaaugaagaguuccuugacuauaugcccagcaugaagcgguuuagaaaagaggaagaguccgaaggcgcuaucugguga

SEQ ID NO: 20749 - RNA, 9873 nt, Artificial Sequence
  derived and/or modified CDS sequence (opt5) from DENV-3__FJ373303__SS-prME
accagccugugccucaugaugauccugcccgccgcucuugccuuccaccugacgucccgggacggagaaccucggaugauuguggggaagaacgaacgcggaaagucucuccuguuuaagacggcgagcggcaucaauauguguacccuuauugcuauggaucugggggagaugugcgacgauacagucaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacgucaagcucaccgugguugugggggacauuaucggaguccuggagcagggcaaacggacgcuuaccccucagcccauggagcugaaguacucuuggaaaacaugggggaaggccaagauugugaccgccgaaacacaaaacuccagcuucaucauugauggaccuaauacccccgagugcccgucugcuuccagagcguggaacgugugggaagucgaggacuauggcuuuggcguuuucacaaccaauaucuggcucaaacugcgcgaaguguacacgcagcugugugaccaccggcuuaugagcgccgcugugaaggaugagagagccguccacgccgacaugggguacuggaucgagucccagaaaaacggaucuuggaagcucgaaaaagcuagccugauugaggugaagacaugcaccuggccuaagucccauacccuguggucuaauggcguucucgaaagcgauaugaucauucccaaaucccuggccgggccuaucagccagcacaacuaucgccccggauaccauacacaaaccgcgggcccuuggcaccuugggaagcuggagcucgacuuuaauuauugcgagggaacgacaguggucauuaccgaaaacuguggcacacggggccccucucugagaaccacaaccguguccgggaaacugauccacgaguggugcugucgcagcugcacgcuuccgccucuccgguacaugggagaagauggcuguugguaugggauggagaucagacccauuucugaaaaggaggagaauaugguuaaaucccuggugagcgcuggaucuggcgaagucgacaacuucaccaugggggugcugugccucgccauccuguuugaggaaguuaugcggggaaaguucggcaagaaacauaugauugccggcguguucuuuacauucguccuucugcucagcgggcagaucaccuggcgcgauauggcucacacacugauuaugaucggauccaaugccagcgacagaaugggcaugggggugaccuaccuggcgcuuauugcuacguuuaagauccagcccuuccuggcccucggauuuuuccugcggaaacucacaucuagagagaaccugcuucugggcguggggcucgccauggcuaccacacugcaacugccugaagauaucgagcagauggccaauggaauugcucuuggccugauggcccucaagcugaucacccaguuugagaccuaucagcucuggacagcgcugauuucccuuacguguagcaacaccaucuucacacugaccgucgccuggcgcacagcuacccucauucuggccggcguuucccugcuuccggugugccaaucuagcuccaugcggaaaacggacuggcugcccaugacaguggcugccaugggggucccuccccucccucuguuuaucuucucucucaaggauacccugaagagacgcagcuggccccuuaaugaaggagugauggccguuggccugguguccauccuggcuucuagccuccugagaaacgacgucccuauggcggggccccuuguggccggaggccugcucauugcuuguuacguuaucaccgggacauccgccgaucugaccguggagaaagccgcugacgucacaugggaagaggaagccgagcagacgggagugagccauaaccucaugauuaccgucgacgaugacggcacaaugcggaucaaggaugacgagaccgaaaauauucugacagugcuucugaaaaccgcgcugcucaucguuucuggcaucuuuccguacuccauuccugcuacgcugcuuguguggcacaccuggcagaagcagacacaacgcagcgggguccugugggaugugcccucuccucccgagacccagaaagccgaacucgaggagggaguuuauagaaucaagcagcagggcauuuucgggaaaacacaagugggagucggcgugcagaaggaagggguguuucauaccauguggcacguuacacggggagccguccugacguacaacggcaagcgccucgagccgaauugggcuuccgugaaaaaggaccugaucagcuauggcgggggauggagacuuucugcccaguggcaaaaaggcgaagaggugcaggucauugcgguggaaccugggaagaaccccaaaaauuuccagaccaugccuggaacauuccagaccaccacaggcgagaucggggcuauugcccuggauuuuaagcccggaacguccggcagccccaucaucaaccgggagggcaagguuguggggcuguacggaaauggcgucgugaccaaaaacgggggauauguuuccggcauugcccaaacaaaugcugaaccugacgggccgacccccgagcucgaagaggaaauguucaagaaacgcaaccugacaaucauggaucuucacccuggcagcggaaagaccagaaaauaccugcccgccauugugcgggaggcuaucaagcgcagacuccggacgcugauucucgccccuacaagagucguggcggccgagauggaagaggcucugaagggccuucccauccgcuaucagaccaccgccacaaaaucugaacauaccgggcgggagaucguugaccugaugugccacgcuacauuuaccaugagacugcucagcccugugcgcgucccgaauuacaaccugauuaucauggaugaagcccauuucacggaccccgccuccauugcugcgcggggauacaucucuacaagagugggcaugggggaggccgcugccauuuuuaugaccgccacaccucccggaaccgcugaugccuucccucagagcaaugcgcccauccaggacgaggaacgcgacaucccggagcgguccuggaacucuggcaaugaauggauuacggauuuugcugggaagaccgugugguucgucccuagcaucaaagccggcaacgacauugccaacugucuuagaaagaauggcaaaaagguuauccaacugucccgcaagacauuugauaccgaguaucagaaaacaaagcucaacgacugggauuucguggugaccacagacauuucugagaugggagcuaauuuuaaagccgaucgggucaucgaccccagacggugccugaagcccgugauucugaccgaugggccugaacgcguuauccucgcgggacccaugccugugacggccgcuagcgccgcucagagacggggccgcgucgggagaaacccgcagaaagagaaugaccaauacaucuucacaggacagccccuuaacaaugaugaagaccacgcccauuggaccgaggcuaagaugcugcuggacaacauuaauaccccugaaggcaucauucccgcccucuucgagccugagcgggaaaaguccgcggccaucgauggggaguauagacugaaaggcgaaagccgcaagacauuuguggagcuuaugcggagaggagaccugcccguuuggcucgcucacaaaguggccucugaaggcauuaaguacaccgaucgcaaauggugcuucgacgggcagcggaacaaucagauccuggaggagaacauggaugucgaaaucuggacaaaggagggagagaagaagaagcugagaccgcgcuggcucgacgcucggacguauuccgauccucuugcccugaaagaguuuaaggacuucgccgcuggcagaaaaagcauugcgcuggaucucgugaccgaaaucgggcgcguccccucucaccuggcccauagaacacggaaugcucuugacaaccuggugaugcuccacaccuccgagcauggaggcaaggccuaccgccacgccguugaggaacugccugagacaauggaaacccugcuccuucugggccugaugauucuccugacagggggagcuaugcuuuuucugaucagcggcaaagggauuggaaagaccuccaucggccucaucugugugauugccucuagcgggaugcuguggauggcggagaucccccugcaauggauugccuccgcuaucgugcucgaguucuuuaugaugguccuucugauuccugaacccgagaagcagagaacaccgcaggauaaucaacuggccuauguugugaucggcauucucacccuggcugccaucaucgcggccaacgaaaugggccuucuggagacaaccaaacgggaccucggcaugagcaaggaaccugggguggucucucccacguccuaccuggauguggaccugcaccccgcuagcgccuggacacucuacgcuguugccaccacagugauuaccccuaugcuucgccauaccaucgaaaauucuacagcuaacgucagccuggccgcgauugccaaccaggcugugguccugaugggacucgacaaaggcuggccgaucuccaagauggaucugggggugccccuucuggcccucggaugcuauucucagguuaauccucugacgcugaccgcugccgugcuccuucugauuacacacuacgccaucaucggccccgggcugcaggcgaaagcuaccagagaggcccaaaagcggacagcugccggaauuaugaagaacccuaccgucgacggcaucaugacgauugaucucgaccccgugaucuaugauagcaaauucgagaagcagcugggccagguuaugcuucuggugcucugugccguccagcugcugcucaugagaacauccugggcucuuugcgaggcccugacccuggcgaccgggccuauuacaacccucugggaaggaucuccgggcaaauuuuggaauacaacgaucgccgugagcauggcuaacaucuuccgcggguccuaccuggccggagcuggccuugccuuuagcauuaugaagucuguggggaccggaaaacggggcacaggcucccaaggggagacccugggagaaaaguggaagaaaaagcucaaucagcugagcagaaaagaguucgaccuguauaagaaauccggcaucacagagguugaucgcaccgaagcgaaggaggggcucaaacggggagaaauuacgcaucacgccgucucuagaggcagcgcuaaacuucagugguuuguggagcggaacauggugauccccgaagggcgcgucauugaccugggauguggcagaggcgggugguccuacuauugcgccggacugaagaaaguuaccgaggugcggggcuacacaaaagggggaccuggccaugaggaacccgugccuaugucuaccuacggguggaaugucgugaaacucaugagcggaaaggauguuuucuaucugcccccggagaaaugugacacacuucugugcgauaucggcgaauccagcccuucucccaccguggaggagucccgcacaauuagaguccucaagaugguggaacccuggcugaagaacaaucaguucuguaucaaaguucugaacccuuacaugcccaccgugaucgagcaccucgaacggcuucaacgcaagcacggcgggaugcuggucagaaauccucugagccggaacucuacgcaugagauguauuggauuuccaauggaacaggcaacaucguggcuagcgugaauauggucucucgccuccugcuuaacagauuuaccaugacccaccggagaccgacaauugaaaaagacguugaucugggggccggaacgcgccaugugaacgcugagcccgagaccccuaauauggacgugaucggcgaacggauuaagagaaucaaagaggaacacaacagcacauggcacuacgacgaugagaaucccuauaagaccugggccuaccauggguccuaugaagucaaggcgacaggaucugccagcuccaugaucaacggcgugguuaaacuccugaccaagccuugggacgugguccccauggugacacagauggcuaugaccgauacgaccccguucggccagcaacgcguuuuuaaagagaagguggacacacggaccccuagaagcaugcccgggacacgccgggucaugggaauuaccgccgaguggcuguggagaacgcucggccgcaauaaaaagccucggcugugcacaagagaagaguucaccaagaaagugcgcacaaacgcugccaugggggccguuuuuaccgaagagaaucagugggauuccgcgaaggcugccguggaagacgaggauuucuggaaacuugucgaccgggagagagaacugcacaagcucggaaaauguggcucuugcguguacaacaugauggggaagcgcgagaaaaagcugggcgaauuuggaaaggccaaaggcagcagagcuaucugguacauguggcuuggggcccgguaucuggaguucgaggcucucggauuucugaaugaagaucauugguucucccgcgagaacucuuacagcggcgucgaaggggagggacugcacaagcucggcuauauucugagagacaucuccaaaauucccgggggcgccauguacgcggaugacacggccggaugggacacccggaucacagaagaugaccuucauaaugaggagaagaucacccagcagauggauccugaacacagacaacuggcuaacgccauuuuuaaacucacauaucagaauaaggugguuaaggugcagcggcccaccccgacaggcaccgucauggacaucauuucucgcaaagaucagagagggagcggacaagugggcacguacgggcugaacacauucaccaauauggaggcucagcuuauccggcagauggaaggagagggcgugcuguccaaggccgaccucgaaaacccucaucugcccgagaaaaagauuacccaguggcuggagacaaaagggguugaacgccucaagagaauggcgaucagcggcgaugacugcguggucaagcccaucgaugaccgguuugccaacgcucugcuugcccugaaugauaugggaaaagugcgcaaggacauuccucaauggcagccgucuaaaggcuggcaugauuggcagcagguucccuucuguucccaccauuuccacgagcucaucaugaaggacgggagaaaacugguggucccuugccggccccaagacgaacuuauuggacgcgcuagaaucagccagggcgccggguggucucugcgggagaccgcuugucucggaaaggccuaugcgcagauguggucccugauguacuuucaccgcagagaucugcggcucgccagcaacgcuauuugcucugccgugccuguccauugggugcccacaucccgcacgaccuggagcauccacgcccaucaccaauggaugacaaccgaagacaugcugacaguuuggaauagaguguggauugaggauaacccuuggauggaggacaagacccccgucacgaccugggaaaaugugccguaccuuggcaaacgggaggaucaguggugugggucccugaucggccucacaagcagagcuaccugggcccagaacaucccuacagcgauucagcaaguucgcucucugaucggaaaugaagaguuccuugacuauaugcccagcaugaagcgguuuagaaaagaggaagaguccgaaggcgcuauuugguga

SEQ ID NO: 20750 - RNA, 9873 nt, Artificial Sequence
  derived and/or modified CDS sequence (opt5) from DENV-3__KF955451__SS-prME
accagccugugccucaugaugauccugcccgccgcucuugccuuccaccugacaucccgggacggcgagccucggaugauuguggggaagaaugaacgcggaaagucucuccuguuuaagacggcgagcggcaucaauauguguacccuuauugcuauggaucugggggaaaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggguuggcgauaacgcccugaaaaucaauugguauaagaagggaucuagcaucggcaaaauguuugaagccacggcuagaggggccagacgcauggcuauucuuggagacacagccugggauuucggcuccgucgggggagugcucaacagccugggcaagauggugcaccagaucuuugggucugcguacaccgcccuguucuccggcgucagcugggugaugaaaauuggaaucggcguucuccugaccuggauugggcuuaauucuaagaacacaagcauguccuuuucuugcaucgcuauuggaaucaucacccuguaucucggcguggucgugcaggccgacaugggguguguuauuaauuggaaaggaaaggagcugaagugcggcagcgggaucuucgugacaaacgagguccauacguggaccgaacaguacaaauuucaagcugauucccccaagcggcuggccacagcgauugccggcgcuugggagaauggaguguguggcaucagaagcaccacacgcauggaaaaccuucucuggaaacagauugccaaugagcugaacuauauccugugggaaaauaacaucaagcucaccguuguggucggggacauuaucggagugcuggagcagggcaaacggacgcuuaccccucagcccauggagcugaaguacucuuggaaaacaugggggaaggcuaagauugugaccgccgaaacacaaaacuccagcuucaucauugauggaccuaauacccccgagugcccgucugccuccagagcuuggaacgucugggaaguugaggacuauggcuuuggcguguucacaaccaauaucuggcucaaacugcgcgaaguguacacgcagcugugugaccaccggcuuaugagcgcggccgucaaggaugagagagcugugcacgccgacaugggguacuggaucgagucccagaaaaacggaucuuggaagcucgaaaaagccagccugauugagguuaagacaugcaccuggccuaagucccauacccuguggucuaauggcgugcucgaaagcgauaugaucauucccaaaucccuggcugggccuaucagccagcacaacuaucgccccggauaccauacacaaaccgccggcccuuggcaccuugggaagcuggagcucgacuuuaauuauugcgagggaacgacagucgugauuaccgaaaacuguggcacacggggccccucucugagaaccacaaccguuuccgggaaacugauccacgaguggugcugucgcagcugcacgcuuccgccucuccgguacaugggagaagauggcuguugguaugggauggagaucagacccauuucugaaaaggaggagaauauggugaaaucccuggucagcgcgggaucuggcgaaguggacaacuucaccauggggguucugugccucgcuauccuguuugaggaagugaugcggggaaaguucggcaagaaacauaugauugccggcgucuucuuuacauucgugcuucugcucagcgggcagaucaccuggcgcgauauggcccacacacugauuaugaucggauccaaugcuagcgacagaaugggcaugggggugaccuaccuggcccuuauugcgacguuuaagauccagcccuuccuggcucucggauuuuuccugcggaaacucacaucuagagagaaccugcuucugggcgucgggcucgccauggccaccacacugcaacugccugaagauguugagcagauggcuaauggaaucgcccuuggccugauggcucucaagcugauuacccaguuugagaccuaucagcucuggacagcccugaucucccuuacguguagcaacaccauuuucacacugaccguggcguggcgcacagccacccucauccuggcuggcgugucccugcuuccggucugccaaucuagcuccaugcggaaaacggacuggcugcccaugacaguggccgcuauggggguuccuccccucccucuguuuauuuucucucucaaggauacccugaagagacgcagcuggccccuuaaugaaggagugauggccgucggccugguguccauccuggccucuagccuccugagaaacgacguuccuauggcugggccccuuguggcgggaggccugcucaucgccuguuacgucauuaccgggacauccgcugaucugaccguggagaaagccgccgacgucacaugggaagaggaagcugagcagacgggagugagccauaaccucaugaucaccguugacgaugacggcacaaugcggauuaaggaugacgagaccgaaaauauccugacagugcuucugaaaaccgcccugcucauugucucuggcaucuuuccguacuccaucccugcgacgcugcuuguguggcacaccuggcagaagcagacacaacgcagcgggguucugugggaugugcccucuccucccgagacccagaaagcugaacucgaggagggagucuauagaauuaagcagcagggcaucuucgggaaaacacaagugggagugggcguucagaaggaaggggucuuucauaccauguggcacgugacacggggagccgugcugacguacaacggcaagcgccucgagccgaauugggccuccgucaaaaaggaccugauuagcuauggcgggggauggagacuuaacgcucaguggcaaaaaggcgaagaggugcagguuaucgccguggaaccugggaagaaucccaaaaacuuccagaccaugccuggaacauuccagaccaccacaggcgagauuggggcgaucgcucuggauuuuaagcccggaacgucuggcucccccauuaucaaucgggagggcaaggucguggggcuguacggaaacggcguugugaccaaaaaugggggauaugucagcggcaucgcccaaacaaacgccgaaccugacgggccgacccccgagcucgaagaggaaauguucaagaaacgcaaucugacaauuauggaucuucacccuggcuccggaaagaccagaaaauaccugcccgcuaucgugcgggaggccauuaagcgcagacuccggacgcugauccucgcuccuacaagaguuguggccgcggagauggaagaggcccugaagggccuucccauucgcuaucagaccaccgcuacaaaaagcgaacauaccgggcgggagaucgucgaccugaugugccacgccacauuuaccaugagacugcucucuccugugcgcgugccgaacuacaaucugaucauuauggaugaagcucauuucacggaccccgccagcaucgccgcucggggauacauuuccacaagagucggcaugggggaggcggccgcuaucuuuaugaccgccacaccucccggaaccgccgaugcuuucccucagucuaacgcccccauucaggacgaggaacgcgacaucccggagcggagcuggaacuccggcaacgaauggaucacggauuuugcggggaagaccguuugguucgugccuucuauuaaagcuggcaacgacaucgccaauugucuuagaaagaacggcaaaaaggugauucaacugagccgcaagacauuugauaccgaguaucagaaaacaaagcucaaugacugggauuucgucgugaccacagacaucuccgagaugggagccaacuuuaaagcugaucggguuauugaccccagacggugccugaagcccgugauccugaccgaugggccugaacgcgucauucucgccggacccaugccugugacggcggccucugcugcccagagacggggccgcguugggagaaauccgcagaaagagaacgaccaauacaucuucacaggacagccccuuaauaacgaugaagaccacgcucauuggaccgaggccaagaugcugcuggacaauaucaacaccccugaaggcauuauccccgcucucuucgagccugagcgggaaaagagcgccgcgauugauggggaguauagacugaaaggcgaaucccgcaagacauuuguggagcuuaugcggagaggagaccugcccgucuggcucgcccacaaaguggcuagcgaaggcaucaaguacaccgaucgcaaauggugcuucgacgggcagcggaauaaccagauucuggaggagaauauggaugucgaaaucuggacaaaggagggagagaagaaaaagcugagaccgcgcuggcucgacgcccggacguauucugauccucuugcucugaaagaguuuaaggacuucgccgccggcagaaaauccaucgcucuggaucucgugaccgaaauugggcgcguucccacacaccuggcgcauagaacccggagcgcccuugacaaccuggugaugcuccacacaucugagcauggaggcaaggcuuaccgccacgccguggaggaacugccugagaccauggaaacgcugcuccuucugggccugaugauccuccugaccgggggagccaugcuuuuucugauuuccggcaaagggaucggaaagacaagcauuggccucaucugugucaucgcuuccucugggaugcuguggauggccgagauuccccugcaauggaucgcgagcgccauuguucucgaguucuuuaugauggugcuucugaucccugaacccgagaagcagagaaccccgcaggauaaucaacuggcuuauguggucauuggaauccucacacuggccgcuauuaucgccgcgaacgaaaugggccuucuggagaccacgaaacgggaccucggcauguccaaggaaccuggggugguuagccccacaucuuaccuggauguggaccugcaccccgccuccgcuuggacccucuacgccgucgcuacaaccgugaucaccccuaugcuucgccauacaauugagaauagcacggccaacgucucucuggcugccaucgcgaaccaggccgugguucugaugggacucgacaaaggcuggccgauuagcaagauggaucugggggugccccuucuggcucucggaugcuauucccaggucaauccucugacccugacagccgcugugcuccuucugaucacccacuacgccauuaucggccccgggcugcaggccaaagcgacaagagaggcucaaaagcggaccgccgcuggaaucaugaagaacccuacgguugacggcauuaugacaaucgaucucgaccccgugauuuaugauucuaaauucgaaaagcagcugggccaggucaugcuucuggugcucugugccgugcagcugcugcucaugagaaccagcugggcccuuugcgaggcucugacccuggccacagggccuaucaccacacucugggaaggauccccgggcaaauuuuggaauacgaccauugcgguuucuauggccaacaucuuccgcgggagcuaccuggcuggagccggccuugcuuuuuccaucaugaaaagcgucgggacaggaaaacggggcaccggcucucaaggggagacacugggagaaaaguggaagagaaaacucaaucagcugucccgcaaggaguucgaccuguauaaaaagagcggcauuaccgagguggaucggacggaagccaaagaggggcucaagagaggagaaaucacccaucacgcggugucccggggcucugccaaacuucagugguuugucgagcgcaacaugguuauucccgaagggagagugaucgaccugggauguggccggggcggguggagcuacuauugcgcuggacugaagaaggugacagagguccgcggcuacaccaaagggggaccuggccaugaggaacccgugccuauguccacauacggguggaauauuguuaagcucaugucuggaaaagauguguucuaucugcccccggagaagugugacacccuucugugcgauaucggcgaaagcuccccuagccccacagucgaggagucuagaaccauucgggugcucaaaaugguugaacccuggcugaagaacaaucaguucuguaucaaggugcugaacccuuacaugcccacggucaucgagcaccucgaacgccuucaaagaaaacacggcgggaugcuggugcggaauccucugucccgcaacagcacacaugagauguauuggauuucuaauggaaccggcaacaucguggccuccgucaauaugguuagcagacuccugcuuaaccgguuuaccaugacacacagacgcccgacgauugaaaaggacguggaucugggggcuggaacccggcaugugaacgccgagcccgagacaccuaauauggacgucaucggcgaaagaauuaaacgcaucaaggaggaacacaacucuaccuggcacuacgacgaugagaaucccuauaaaacaugggcuuaccaugggagcuaugaagugaaggccaccggauccgcgucuagcaugaucaacggcguugugaagcuccugacaaaaccuugggacgucgugcccaugguuacccagauggccaugacggauaccacaccguucggccagcaacggguguuuaaggagaaagucgacaccagaacaccucgccccaugccugggacccggagagugaugggaauuacggcugaguggcuguggcgcacacucggccggaauaagaaacccagacugugcacccgcgaagaguucacaaagaagguucggaccaacgccgcuaugggggccguguuuacggaagagaaucagugggauuccgccaaagcggcugucgaagacgaggauuucuggaaacuuguggacagagagcgcgaacugcacaaacucggaaaguguggcagcugcgucuacaacaugauggggaaaagagagaagaaacugggcgaauuuggaaaggccaagggcucccgggccaucugguacauguggcuuggggcucgcuaucuggaguucgaggcccucggauuucugaaugaagaucauugguucucuagagagaacagcuacuccggcguggaaggggagggacugcacaaacucggcuauauucugcgggacaucucuaagauuccugggggcgcuauguacgccgaugacaccgcgggaugggacacaagaaucaccgaagaugaccuucauaaugaggagaaaaucacacagcagauggaucccgaacaccggcaacuggccaacgcuauuuuuaagcucaccuaucagaauaaaguugugaagguccagcgcccgacaccuaccggcacggugauggacaucauuagcagaaaggaucagcggggguccggacaagugggcacauacgggcugaacaccuucaccaauauggaggcccagcuuauccgccagauggaaggagagggcguucugucuaaagcugaccucgaaaacccccaccugagcgagaagaaaauuacacaguggcuggagaccaaggggguggaaagacucaaacggauggccaucuccggcgaugacugcgucgugaagcccaucgaugaccgcuuugcgaacgcccugcuugcucugaaugauaugggaaagguuagaaaagacauuccucaauggcagccgagcaagggcuggcaugauuggcaacaggugcccuucuguucucaccauuuccacgagcucaucaugaaagacgggcggaagcuggucgugccuugccgcccccaagacgaacuuauuggacgggcccggaucucccagggcgcuggguggagccugcgcgagacagccugucucggaaaggcuuaugcccagauguggucucugauguacuuucacagacgggaucugcgccucgcguccaacgccauuugcagcgcugucccugugcauuggguucccacgucuagaaccacaugguccauccacgcccaucaccaauggaugaccacagaagacaugcugaccguguggaaucgggucuggauugaggauaacccuuggauggaggacaagacgcccgugaccacaugggaaaauguuccguaccuuggcaagagagaggaucaguggugugggagccugaucggccucaccucccgcgccacaugggcucagaacaucccuaccgccauucagcaagugcggagccugaucggaaaugaagaguuccuugacuauaugcccucuaugaaaagauuucgcaaggaggaagagagcgaaggcgcgauuugguga

SEQ ID NO: 20751 - RNA, 9873 nt, Artificial Sequence
  derived and/or modified CDS sequence (opt5) from DENV-3__KF955453__SS-prME
acaagccucugccucaugaugauccugcccgccacacuugcuuuccaccugacgucccgggacggcgaaccucggaugauuguggggaagaaugaacgcggaaaaucucuccuguuuaagaccgccagcggcaucaauauguguacacuuauugcgauggaucugggggagaugugcgacgauaccgugacauacaaauguccgcauaucaccgaaguugagcccgaagacauugauugcugguguaaccucacauccaccugggugacguauggaaccugcaaucaggcuggcgagcaccggcgggacaagcgcucuguggcccuggccccucaugucgggaugggacuggauacaagaacccagacauggaugagcgcugagggcgccuggagacagguggaaaaaguugagaccugggcucuccgccaccccggcuucacgauccuggcccuuuuucuggcgcauuacaucgggacaucccucacccagaagguggucauuuucauccugcuuaugcuggugacaccuucuaugaccaugagauguguuggagugggcaaccgggacuuugucgaagggcucagcggagccaccuggguggaugugguccuggagcacggcgggugcguuacaacgauggcuaagaauaaacccacccuggacauugagcuccagaagacagaagccacccagcuggcuacacuucgcaaacuguguaucgagggaaagauuaccaacaucacgacagauuccagaugcccuacccagggcgaagccgugcucccggaggaacaggaccagaauuauguguguaaacacaccuacgucgaucggggcugggggaacggaugcggccuguucgggaagggaagccuugugacaugcgcgaaguuucaaugucuggagcccauugagggcaaaguugugcaguaugaaaaucucaaguacaccgucaucaucacagugcauacgggggaccagcaccagguuggaaacgagacccaaggcgugacagccgaaauuaccccucaggcuucuacaaccgaggccacgcugcccgaauauggcacccuggggcucgagugcuccccucgcacaggacuggacuucaaugagaugauccuucugaccaugaaaaacaaggcuuggaugguccauagacagugguuuuucgaucucccccugccguggacaagcggcgccaccacggaaacaccuaccuggaaucggaaagagcuucuggugacauuuaagaacgcccacgcuaaaaagcaagaagucgugguucucgggucucaggagggagcgaugcacaccgcccugaccggcgcuacagaaauucaaaauuccgggggcacgagcaucuucgccggacaucugaagugucgccucaaaauggacaagcuggagcuuaaaggcaugucuuacgccaugugcaccaacacauuugugcugaagaaagaggucuccgaaacccagcacgggacaauucucaucaagguggaguacaagggagaagauguucccuguaaaaucccuuucagcaccgaggacggccaagggaaggcucauaacggaagacugauuacggccaaucccguggucaccaagaaggaggaacccgugaacaucgaggcggaaccuccguucggcgaguccaauauugugaucgggauuggcgauaacgcucugaaaaucaauugguauaagaagggaucuagcaucggcaaaauguuugaagccaccgccagaggggcuagacgcauggccauucuuggagacaccgcuugggauuucggcuccguugggggaguccucaacagccugggcaagauggugcaccagaucuuugggucugccuacacagcgcuguucuccggcgugagcugggucaugaaaauuggaaucggcgugcuccugaccuggauugggcuuaauucuaagaacacaagcauguccuuuucuugcaucgccauuggaaucaucacgcuguaucucggcgcuguugugcaggccgacauggggugugucauuaauuggaaaggaaaggagcugaagugcggcagcgggaucuucgugaccaacgagguucauacauggaccgaacaguacaaauuucaagcugauucccccaagcggcuggccacagcgauugccggcgcuugggagaauggaguguguggcaucagaagcaccacgcgcauggaaaaccuucucuggaaacagauugccaaugagcugaacuauauccugugggaaaauaacaucaagcucaccgucgugguuggggacauuaucggagugcuggagcagggcaaacggacacuuaccccucagcccauggagcugaaguacucuuggaaaacaugggggaaggcuaagauugucaccgccgaaacacaaaacuccagcuucaucauugauggaccuaauacccccgagugcccgucugccuccagagcuuggaacgugugggaaguggaggacuauggcuuuggcgucuucacgacaaauaucuggcucaaacugcgcgaaguuuacacccagcugugugaccaccggcuuaugagcgcggccgugaaggaugagagagcugugcacgccgacaugggguacuggaucgagucccagaaaaacggaucuuggaagcucgaaaaagccagccugauugaggucaagaccugcacauggccuaagucccauacccuguggucuaauggcgugcucgaaagcgauaugaucauucccaaaucccuggcugggccuaucagccagcacaacuaucgccccggauaccauacgcaaacagccggcccuuggcaccuugggaagcuggagcucgacuuuaauuauugcgagggaaccacaguugugauuaccgaaaacuguggcacacggggccccucucugagaaccacgaccgucuccgggaaacugauccacgaguggugcugucgcagcugcacacuuccgccucuccgguacaugggagaagauggcuguugguaugggauggagaucagacccauuucugaaaaggaggagaauauggugaaaucccugguuagcgcgggaucuggcgaaguggacaacuucaccauggggguccugugccucgcuauccuguuugaggaagugaugcggggaaaguucggcaagaaacauaugauugccggcguuuucuuuacauucgugcuucugcucagcgggcagaucaccuggcgcgauauggcccacacgcugauuaugaucggauccaaugcuagcgacagaaugggcaugggggucacauaccuggcccuuauugcgaccuuuaagauccagcccuuccuggcucucggauuuuuccugcggaaacucacaucuagagagaaccugcuucugggcguggggcucgccauggccaccacccugcaacugccugaagauaucgagcagauggcuaauggaauugcccuuggccugauggcucucaagcugaucacacaguuugagacguaucagcucuggaccgcccugauuucccuuacauguagcaacaccaucuucacacugaccguggcguggcgcacggccacacucauucuggcuggcgucucccugcuuccgguuugccaaucuagcuccaugcggaaaaccgacuggcugcccaugaccguggccgcuaugggggugccuccccucccucuguuuaucuucaaucucaaggauacacugaagagacgcucuuggccccuuaacgaaggagucauggccgugggccugguuagcauccuggccuccucucuccugagaaacgacgugccuauggcugggccccuugucgcgggaggccugcucauugccuguuacgugaucaccgggacaagcgcugaucugacgguugagaaagccgccgacgugaccugggaagaggaagcugagcagacaggagucucccauaaucucaugauuaccguggacgaugacggcacaaugcggaucaaggaugacgagaccgaaaacauucugacgguccuucugaaaaccgcccugcucaucgugagcggcaucuuuccguacucuauuccugcgacacugcuuguuuggcacaccuggcagaagcagacacaacgcuccggggugcugugggauguccccagcccucccgagacccagaaagcugaacucgaggagggaguguauagaaucaagcagcagggcauuuucgggaaaacacaaguuggagugggcguccagaaggaagggguguuucauacgauguggcacgugacccggggagccguucugacauacaauggcaagcgccucgagccgaacugggccucugucaaaaaggaccugaucuccuauggcgggggauggagacuuagcgcucaguggcaaaaaggcgaagagguccaggugauugccgucgaaccugggaagaaucccaaaaacuuccagaccaugccuggaaccuuccagacaacgaccggcgagaucggggcgauugcucuggauuuuaagcccggaacaucuggcucccccaucaucaaucgggagggcaagauuguggggcuguacggaaacggcguugugaccaaaaaugggggauaugucagcggcaucgcccaaacaaacgccgaaccugacgggccgacccccgagcucgaagaggaaauguucaagaaacgcaaucugacgauuauggaucuucacccuggcuccggaaagacaagaaaauaccugcccgcuaucgugcgggaggccauuaagcgcagacuccggacccugauccucgcuccuaccagaguuguggccgcggagauggaagaggcccugaagggccuucccauccgcuaucagacaaccgcuacaaaaagcgaacauaccgggcgggagauugucgaccugaugugccacgccacguuuacaaugagacugcucucuccugugcgcguuccgaacuacaaucugaucauuauggaugaagcucauuucaccgaccccgccagcaucgccgcucggggauacauuuccacaagagugggcaugggggaggcggccgcuaucuuuaugaccgccacgccucccggaaccgccgaugcuuucccucagucuaacgcccccauccaggacgaggaacgcgacauuccggagcggagcuggaacuccggcaacgaauggaucacagauuuugcggggaagaccgucugguucgugccuucuauuaaagcuggcaacgacaucgccaauugucuuagaaagaacggcaaaaaggugauucaacugagccgcaagacauuugauaccgaguaucagaaaacaaagcucaaugacugggauuucgucguuaccacggacaucuccgagaugggagccaacuuuaaagcugaucgggugauugaccccagacggugccugaagcccgugauccugacagaugggccugaacgcgucauccucgccggacccaugccugugaccgcggccucugcugcccagagacggggccgcguugggagaaauccgcagaaagagaacgaccaauacauuuucaccggacagccccuuaauaacgaugaagaccacgcucauuggacagaggccaagaugcugcuggacaauaucaacaccccugaaggcauuauccccgcucucuucgagccugagcgggaaaagagcgccgcgauugauggggaguauagacugaaaggcgaaucccgcaagacauuuguggagcuuaugcggagaggagaccugcccgucuggcucgcccacaaaguggcuagcgaaggcaucaaguacacggaucgcaaauggugcuucgacgggcagcggaauaaccagauccuggaggagaauauggauguugaaauuuggaccaaggagggagagaagaagaagcugagaccgcgcuggcucgacgcccggacauauucugauccucuugcucugaaagaguuuaaggacuucgccgccggcagaaaauccaucgcucuggaucucgugaccgaaauugggcgcguccccacacaccuggcgcauagaacccggaacgcccuugacaaucuggugaugcuccacacgagcgagcauggaggcaaggcuuaccgccacgccgucgaggaacugccugagaccauggaaacacugcuccuucugggccugaugaucucucucaccgggggagccaugcuguuucuuauuuccggcaaagggaucggaaagacaagcaucggccugauuugugugaucgcuuccucugggaugcucuggauggccgagauuccccugcaauggaucgcgagcgccauuguucuggaguucuuuaugauggugcuccuuaucccugaacccgagaagcagagaaccccgcaggauaaccaacuggcuuauguggucauuggaauccugacgcucgccgcuaucauugccgcgaaugaaaugggccugcuugagacaaccaaacgggaccugggcauguccaaggaaccugggguugugagccccacaucuuaccucgauguggaccugcaccccgccuccgcuuggacccuguacgccgucgcuaccacagugaucacgccuaugcuccgccauaccauugagaacagcacagccaacguuucucuugcugccaucgcgaaucaggccgugguccugaugggacuggacaaaggcuggccgauuagcaagauggaucucggggugccccugcuugcucugggaugcuauucccaggucaacccucucacccugacagccgcugugcugcuccuuaucacccacuacgccaucauuggccccgggcugcaggccaaagcgacgagagaggcucaaaagcggacagccgcuggaaucaugaagaauccuaccguugacggcauuaugaccaucgaucuggaccccgugauuuaugauucuaaauucgaaaagcagcucggccaggucaugcugcuugugcugugugccguucagcuccugcugaugagaacaagcugggcccucugcgaggcucuuacccuggccacagggccuaucacgacccugugggaaggauccccgggcaaauuuuggaacacaaccaucgcggugucuauggccaauauuuuccgcgggagcuaccucgcuggagccggccuggcuuuuuccaucaugaaaagcgucgggacaggaaaacggggcaccggcucucaaggggagacgcuuggagaaaaguggaagaaaaagcugaaccagcucuccagaaaagaguucgaccuguauaagaaaagcggcauuaccgagguggaucgcacagaagccaaggaggggcugaaacggggagaaaucacccaucacgcgguguccagaggcucugccaagcuccagugguuuguugagcggaauauggucauucccgaagggcgcgugaucgaccuuggauguggcagaggcggguggagcuacuauugcgcuggacugaagaaagugacagagguccggggcuacaccaaagggggaccuggccaugaggaacccguuccuauguccacauacggguggaacauugugaaacugaugucuggaaaggauguguucuaucugcccccggagaaaugugacacccugcuuugcgauaucggcgaaagcuccccuagccccacggucgaggagucucgcacaaucagagugcugaagaugguugaacccuggcucaagaauaaccaguucuguauuaaagugcugaauccuuacaugcccaccgucaucgagcaccuggaacggcuccaacgcaagcacggcgggaugcuugugagaaacccucugucccggaauagcacccaugagauguauuggauuucuaacggaacaggcaauaucguugccuccgugaacauggucagccgccugcuccugaacagauuuacgaugacccaccggagaccgacaauugaaaaagacguggaucuuggggcuggaacccgccaugugaaugccgagcccgagacaccuaacauggacgucaucggcgaacggaucaagagaauuaaagaggaacacaauucuaccuggcacuacgacgaugagaaccccuauaagacaugggcuuaccaugggagcuaugaaguuaaggccaccggauccgcgucuagcaugaucaauggcguggugaaacugcucacgaagccuugggacgucgugcccaugguuacccagauggccaugacagauaccacaccguucggccagcaacgcguguuuaaagagaaggucgacacccggacgccuagauccaugcccgggacacgccgggugaugggaauuaccgcugaguggcuguggagaacacugggccgcaacaaaaagccucggcucugcaccagagaagaguucacgaagaaaguucgcaccaaugccgcuaugggggccguguuuacagaagagaaccagugggauagcgccaaggcggcugucgaagacgaggauuucuggaaacugguggaccgggagagagaacuucacaagcugggaaaauguggcuccugcguuuacaauaugauggggaagcgcgagaaaaagcucggcgaauuuggaaaggccaaaggcucuagagccaucugguacauguggcugggggcucgguaucuugaguucgaggcccugggauuucucaacgaagaucauugguucagccgcgaaaauuccuacucuggcguggagggggagggacugcacaagcugggcuauauucucagagacaucagcaaaauccccgggggcgcuauguacgccgaugacaccgcgggaugggacacacggauuaccgaagaugaccugcauaacgaggagaagaucacacagcagauggauccugaacacagacaacuugccaaugcuauuuuuaaacugaccuaucagaacaaggucgugaagguccagcggcccacgccgacaggcaccgugauggacaucauuucccgcaaagaucagagagggucuggacaaguuggcaccuacgggcucaauacauucaccaacauggaggcccagcugauccggcagauggaaggagagggcgugcuuagcaaggcugaccuggaaaacccucaccuccccgagaaaaagaucacacaguggcuggagacgaaaggggucgaacgccugaagagaauggccauuuccggcgaugacugcguggugaagcccaucgaugaccgguuugcgaaugcccuccuggcucuuaacgauaugggaaaaguucgcaaggacauuccucaauggcagccgagcaaaggcuggcaugauuggcaacaggugcccuucuguucucaccauuuccacgagcugaucaugaaggacgggagaaaacucgucgugccuugccggccccaagacgaacugauuggacgcgccagaaucucccagggcgcuggguggagccuucgggagaccgccugucugggaaaggcuuaugcccagauguggucucucauguacuuucaccgcagagaucugcggcuggcguccaaugccauuugcagcgcuguuccugugcauuggguccccacaucucgcaccacaugguccauccacgcccaucaccaauggaugaccacggaagacaugcucaccguguggaacagagucuggaucgaggauaauccuuggauggaggacaagacacccgugaccacaugggaaaacguuccguaccugggcaaacgggaggaucaguggugugggagccuuauuggccugaccuccagagccacgugggcucagaauaucccuacagccauucagcaagugcgcagccucaucggaaacgaagaguuccuggacuauaugcccucuaugaagcgguuuagaaaagaggaagagagcgaaggcgcgauuugguga

SEQ ID NO: 20752 - RNA, 9873 nt, Artificial Sequence
  derived and/or modified CDS sequence (opt5) from DENV-3__FJ373304__SS-prME
acaagccugugccucaugaugauccugcccgccgcucuugccuuccaccugacaucccgggacggcgagccucggaugauuguggggaagaacgaacgcggaaagucucuccuguuuaagacggcgagcggcaucaauauguguacccuuauugcuauggaucugggggaaaugugcgacgauacagucaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagguggugcaccagauuuuugggucugcguacaccgcccuguucuccggcgucagcugggugaugaaaaucggaauuggcguucuccugaccuggaucgggcuuaauucuaagaacacaagcauguccuuuucuugcauugcuaucggaaucauuacccuguaucucggcgccgugguccaggcugacauggggugugugaucaauuggaaaggaaaggagcugaagugcggcagcgggauuuucguuacaaacgaggugcauacguggaccgaacaguacaaauuucaagccgauucccccaagcggcuggcgacagccaucgcuggcgccugggagaauggagucuguggcauuagaagcaccacacgcauggaaaaccuucucuggaaacagaucgcuaaugagcugaacuauauccugugggaaaauaacauuaagcucaccgugguugugggggacacgaucggaguccuggagcagggcaaacggacccuuacaccucagcccauggagcugaaguacucuuggaaaaccugggggaaggccaagauugugacagccgaaacccaaaacuccagcuucaucauugauggaccuaauacacccgagugcccgucugcuuccagagcguggaacgugugggaagucgaggacuauggcuuuggcguuuucaccacgaauaucuggcucaaacugcgcgaaguguacacacagcugugugaccaccggcuuaugagcgccgcugugaaggaugagagagccguccacgccgacaugggguacuggaucgagucccagaaaaacggaucuuggaagcucgaaaaagcuagccugauugaggugaagaccugcaccuggccuaagucccauacacuguggucuaauggcguucucgaaagcgauaugaucauucccaaaucccuggccgggccuaucagccagcacaacuaucgccccggauaccauacccaaacggcgggcccuuggcaccuugggaagcuggagcucgacuuuaauuauugcgagggaacaaccguggucauuacagaaaacuguggcacccggggccccucucugagaacaaccacgguguccgggaaacugauccacgaguggugcugucgcagcugcacccuuccgccucuccgguacaugggagaagauggcuguugguaugggauggagaucagacccauuucugaaaaggaggagaauaugguuaaaucccuggugagcgcuggaucuggcgaagucgacaacuucacaaugggggugcugugccucgccauccuguuugaggaaguuaugcggggaaaguucggcaagaaacauaugauugccggcguguucuuuaccuucguccuucugcucagcgggcagaucacauggcgcgauauggcucacacccugauuaugaucggauccaaugccagcgacagaaugggcaugggggugacguaccuggcgcuuauugcuacauuuaagauccagcccuuccuggcccucggauuuuuccugcggaaacucaccucuagagagaaccugcuucugggcguggggcucgccauggcuacaacccugcaacugccugaagauaucgagcagauggccaauggaauugcucuuggccugauggcccucaagcugaucacccaguuugagacauaucagcucuggacggcgcugauuucccuuaccuguagcaacacaaucuucacccugacagucgccuggcgcaccgcuacgcucauucuggccggcguuucccugcuuccggugugccaaucuagcuccaugcggaaaacagacuggcugcccaugaccguggcugccaugggggucccuccccucccucuguuuaucuucucucucaaggauacccugaagagacgcagcuggccccuuaaugaaggagugauggccguuggccugguguccauccuggcuucuagccuccugagaaacgacgucccuauggcggggccccuuguggccggaggccugcucauugcuuguuacguuaucacagggaccuccgccgaucugacaguggagaaagccgcugacgucacgugggaagaggaagccgagcagaccggagugagccauaaccucaugauuacagucgacgaugacggcaccaugcggaucaaggaugacgagacagaaaauauucugaccgugcuucugaaaacggcgcugcucaucguuucuggcaucuuuccguacuccauuccugcuacccugcuuguguggcacacauggcagaagcagacccaacgcagcgggguccugugggaugugcccucuccucccgagacacagaaagccgaacucgaggagggaguuuauagaaucaagcagcagggcauuuucgggaaaacccaagugggagucggcgugcagaaggaagggguguuucauacaauguggcacguuacgcggggagccguccugaccuacaacggcaagcgccucgagccgaauugggcuuccgugaaaaaggaccugaucagcuauggcgggggauggagacuuucugcccaguggcaaaaaggcgaagaggugcaggucauugcgguggaaccugggaagaaccccaaaaauuuccagacaaugccuggaaccuuccagaccacaacgggcgagaucggggcuauugcccuggauuuuaagcccggaaccuccggcagccccaucaucaaccgggagggcaagguuguggggcuguacggaaauggcgucgugaccaagaacgggggauauguuuccggcauugcccaaaccaaugcugaaccugacgggccgacacccgagcucgaagaggaaauguucaagaaacgcaaccugaccaucauggaucuucacccuggcagcggaaagacgagaaaauaccugcccgccauugugcgggaggcuaucaagcgcagacuccggacacugauucucgccccuaccagagucguggcggccgagauggaagaggcucugaagggccuucccauccgcuaucagaccacagccaccaaaucugaacauacagggcgggagaucguugaccugaugugccacgcuaccuuuacgaugagacugcucagcccugugcgcgucccgaauuacaaccugauuaucauggaugaagcccauuucacagaccccgccuccauugcugcgcggggauacaucucuaccagagugggcaugggggaggccgcugccauuuuuaugacagccaccccucccggaacggcugaugccuucccucagagcaaugcgcccauccaggacgaggaacgcgacaucccggagcgguccuggaacucuggcaaugaauggauuaccgauuuugcugggaagacagugugguucgucccuagcaucaaagccggcaacgacauugccaacugucuuagaaagaauggcaaaaagguuauccaacugucccgcaagaccuuugauacagaguaucagaaaaccaagcucaacgacugggauuucguggugacaaccgacauuucugagaugggagcuaauuuuaaagccgaucgggucaucgaccccagacggugccugaagcccgugauucugacggaugggccugaacgcguuauccucgcgggacccaugccugugacagccgcuagcgccgcucagagacggggccgcgucgggagaaacccgcagaaagagaaugaccaauacaucuucaccggacagccccuuaacaaugaugaagaccacgcccauuggaccgaggcuaagaugcugcuggacaacauuaauacaccugaaggcaucauucccgcccucuucgagccugagcgggaaaaguccgcggccaucgauggggaguauagacugaaaggcgaaagccgcaagaccuuuguggagcuuaugcggagaggagaccugcccguuuggcucgcucacaaaguggccucugaaggcauuaaguacacagaucgcaaauggugcuucgacgggcagcggaacaaucagauccuggaggagaacauggaugucgaaaucuggacgaaggagggagagaagaagaagcugagaccgcgcuggcucgacgcucggaccuauuccgauccucuugcccugaaagaguuuaaggacuucgccgcuggcagaaaaagcauugcgcuggaucucgugacagaaaucgggcgcguccccacccaccuggcccauagaacacggaaugcucuugacaaccuggugaugcuccacaccucugagcauggaggcaaggccuaccgccacgccguugaggaacugccugagacgauggaaacccugcuccuucugggccugaugauucuccugacagggggagcuaugcuuuuucugaucuccggcaaagggauuggaaagaccagcaucggccucaucugugugauugccuccucugggaugcuguggauggcggagaucccccugcaauggauugccagcgcuaucauucucgaguucuuuaugauggugcuucugaucccugaacccgagaagcagagaacaccgcaggauaaucaacuggccuaugucguuauuggaauccucacccuggcugccaucauugcggccaacgaaaugggccuucuggagacgacaaaacgggaccucggcauguccaaggaaccugggguggugagccccaccucuuaccuggaugucgaccugcaccccgcuuccgccuggacacucuacgcuguggccaccaccguuaucacaccuaugcuucgccauacgauugagaauagcaccgcuaacgugucucuggccgcgaucgccaaccaggcugucgugcugaugggacucgacaaaggcuggccgauuagcaagauggaucugggggucccccuucuggcccucggaugcuauucccaggugaauccucugacacugaccgcugccguucuccuucugaucacacacuacgccaucauuggccccgggcugcaggcgaaagcuaccagagaggcccaaaagcggacggcugccggaaucaugaagaacccuacaguggacggcauuaugaccaucgaucucgaccccgucauuuaugauucuaaauucgaaaagcagcugggccaggugaugcuucugguucucugugccgugcagcugcugcucaugagaaccagcugggcucuuugcgaggcccugacacuggcgaccgggccuaucacaacgcucugggaaggauccccgggcaaauuuuggaauaccacaaucgccgucucuauggcuaacauuuuccgcgggagcuaccuggccggagcuggccuugccuuuuccaucaugaaaagcguggggaccggaaaacggggcacaggcucucaaggggagacccugggagaaaaguggaagaaaaagcucaaucagcuguccagaaaagaguucgaccuguauaagaaaagcggcauuacggagguggaucgcaccgaagcgaaggaggggcucaaacggggagaaaucacacaucacgccguuuccagaggcucugcuaaacuucagugguuugucgagcggaacauggugauucccgaagggcgcgugaucgaccugggauguggcagaggcggguggagcuacuauugcgccggacugaagaaagucaccgagguucggggcuacacaaaagggggaccuggccaugaggaacccgugccuauguccaccuacggguggaauauugugaaacucaugucuggaaaggaugucuucuaucugcccccggagaaaugugacacacuucugugcgauaucggcgaaagcuccccuagccccaccguggaggagucucgcacgaucagaguucucaagaugguggaacccuggcugaagaacaaucaguucuguauuaaaguccugaacccuuacaugcccacagugaucgagcaccucgaacggcuucaacgcaagcacggcgggaugcugguuagaaauccucugucccggaacagcacccaugagauguauuggauuucuaauggaaccggcaacaucguggcuuccgucaauauggugagccgccuccugcuuaacagauuuacaaugacgcaccggagaccgaccauugaaaaagacguggaucugggggccggaacacgccaugucaacgcugagcccgagaccccuaauauggacguuaucggcgaacggaucaagagaauuaaagaggaacacaacucuacauggcacuacgacgaugagaaucccuauaagaccugggccuaccaugggagcuaugaagugaaggcgacaggauccgccucuagcaugaucaacggcguggucaaacuccugaccaagccuugggacgugguucccauggugacgcagauggcuaugaccgauacaaccccguucggccagcaacgcgucuuuaaagagaagguggacacacggaccccuagauccaugcccgggacgcgccggguuaugggaauuacagccgaguggcuguggagaacccucggccgcaauaaaaagccucggcugugcacaagagaagaguucaccaagaaagugcgcacgaacgcugccaugggggccgucuuuaccgaagagaaucagugggauagcgcgaaggcugccguggaagacgaggauuucuggaaacuuguugaccgggagagagaacugcacaagcucggaaaauguggcuccugcguguacaacaugauggggaagcgcgagaaaaagcugggcgaauuuggaaaggccaaaggcucuagagcuaucugguacauguggcuuggggcccgguaucuggaguucgaggcucucggauuucugaaugaagaucauugguucagccgcgagaacuccuacucuggcgucgaaggggagggacugcacaagcucggcuauauucugagagacaucagcaaaauccccgggggcgccauguacgcggaugacacagccggaugggacacccggauuacagaagaugaccuucauaaugaggagaagaucacccagcagauggauccugaacacagacaacuggcuaacgccauuuuuaaacucacauaucagaauaagguggucaaggugcagcggcccaccccgacgggcacaguuauggacaucauuucccgcaaagaucagagagggucuggacaagugggcaccuacgggcugaacaccuucacaaauauggaggcucagcuuauccggcagauggaaggagagggcguccugagcaaggccgaccucgaaaacccucaucugcccgagaaaaagaucacccaguggcuggagacaaaagggguggaacgccucaagagaauggcgauuuccggcgaugacugcgugguuaagcccaucgaugaccgguuugccaacgcucugcuugcccugaaugauaugggaaaagugcgcaaggacauuccucaauggcagccgagcaaaggcuggcaugauuggcagcagguccccuucuguucucaccauuuccacgagcucaucaugaaggacgggagaaaacuggugguuccuugccggccccaagacgaacuuauuggacgcgcuagaaucucccagggcgccggguggagccugcgggagacggcuugucucggaaaggccuaugcgcagauguggucucugauguacuuucaccgcagagaucugcggcucgccuccaacgcuauuugcagcgccgugccuguccauugggugcccaccucucgcacaaccugguccauccacgcccaucaccaauggaugacaaccgaagacaugcugacggucuggaauagaguguggaucgaggauaacccuuggauggaggacaagacccccguuacaaccugggaaaaugugccguaccuuggcaaacgggaggaucaguggugugggagccugauuggccucacauccagagcuaccugggcccagaacaucccuacggcgauucagcaaguccgcagccugaucggaaaugaagaguuccuugacuauaugcccucuaugaagcgguuuagaaaagaggaagagagcgaaggcgcuauuugguga

SEQ ID NO: 20753 - RNA, 9873 nt, Artificial Sequence
  derived and/or modified CDS sequence (opt5) from DENV-3__EU854291__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggagaugugcgacgauacaaucaccuacaaauguccgcacauuacagaaguggagcccgaagacaucgauugcugguguaaccucaccuccacauggguuaccuauggaacgugcaaucaggccggcgagcacagacgggacaagcgcucuguggcccuggcuccucauguggggaugggacuggauaccagaacacagaccuggaugagcgccgagggcgcuuggcggcaggucgaaaaaguggagacaugggcccuccgccaccccggcuucaccauccuggcgcuuuuucuggcccauuacauugggacgucccucacacagaagguugugaucuucauucugcuuaugcuggucaccccuucuaugacaaugagaugugugggaguuggcaaccgggacuuuguggaagggcucagcggagcuaccugggucgauguggugcuggagcacggcgggugcgucaccacaauggccaagaauaaacccacgcuggacaucgagcuccagaagaccgaagcuacacaacuggccacccuucgcaaacuguguauugagggaaagaucacaaacauuaccacggauuccagaugcccuacacagggcgaagcgguucucccggaggaacaggaccagaauuauguguguaaacacaccuacguggaucggggcugggggaacggaugcggccuguucgggaagggaagccuugugacaugcgccaaguuucaaugucuggagcccaucgagggcaaagugguucaguaugaaaaucucaaguacacagugaucauuaccguccauacaggggaccagcaccaggugggaaacgagacgcaaggcguuaccgcugaaaucacaccucaggccucuaccacagaggcuauucugcccgaauauggcacccuggggcucgagugcuccccucgcacgggacuggacuucaaugagaugauccuucugaccaugaaaaacaaggccuggauggugcauagacagugguuuuucgaucucccccugccguggacaagcggcgccaccacagaaaccccuacguggaaucggaaagagcuucuggucacauuuaagaacgcucacgcgaaaaagcaagaaguggucgugcucgggucucaggagggagccaugcacaccgcucugacaggcgccaccgaaauucaaaauuccgggggcaccagcaucuucgccggacaucugaagugucgccucaaaauggacaagcuggagcuuaaaggcaugucuuacgcuaugugcacaaacacguuuguucugaagaaagagguguccgaaacccagcacgggacaauccucauuaaggucgaguacaagggagaagaugugcccuguaaaaucccuuucagcaccgaggacggccaagggaaggcccauaacggaagacugauuacagcgaaucccguugugaccaaaaaggaggaacccgucaacaucgaggcugaaccuccguucggcgaguccaauauugugaucgggaucggcgauaacgcccugaaaauuaauugguauaagaagggaucuagcaucggcaaaauguuugaagccacggcuagaggggccagacgcauggcuauucuuggagacacagccugggauuucggcuccgucgggggaguucucaacagccugggcaagaugguccaccagaucuuugggucugcguacaccgcccuguucuccggcgugagcugggugaugaaaauuggaaucggcguccuccugaccuggauugggcuuaauucuaagaacacaagcauguccuuuucuugcaucgcuaucggaauuaucacccuguaucucggcgccgugguucaggcugacauggggugugugauuaauuggaaaggaaaggagcugaagugcggcagcgggaucuucgucacaaacgaggugcauacguggaccgaacaguacaaauuucaagccgauucccccaagcggcuggcgacagccauugcuggcgccugggagaauggaguuuguggcaucagaagcaccacacgcauggaaaaccuucucuggaaacagaucgcuaaugagcugaacuauauucugugggaaaauaacaucaagcucaccguggucgugggggacacgauuggaguucuggagcagggcaaacggacccuuacaccucagcccauggagcugaaguacucuuggaaaaccugggggaaggccaagaucgugacagccgaaacccaaaacuccagcuucauuaucgauggaccuaauacacccgagugcccgucugcuuccagagcguggaacgucugggaaguggaggacuauggcuuuggcguguucaccacgaauaucuggcucaaacugcgcgaagucuacacacagcugugugaccaccggcuuaugagcgccgcuguuaaggaugagagagccgugcacgccgacaugggguacuggauugagucccagaaaaacggaucuuggaagcucgaaaaagcuagccugaucgaggugaagaccugcaccuggccuaagucccauacacuguggucuaauggcguccucgaaagcgauaugauuauccccaaaucccuggccgggccuauuagccagcacaacuaucgccccggauaccauacccaaacggcgggcccuuggcaccuugggaagcuggagcucgacuuuaauuauugcgagggaacaaccgugguuaucacagaaaacuguggcacccggggccccucucugagaacaaccacgguguccgggaaacugauccacgaguggugcugucgcagcugcacccuuccgccucuccgguacaugggagaagauggcuguugguaugggauggagauuagacccgucucugaaaaggaggagaauauggugaaaucccugguuagcgcuggaucuggcgaaguggacaacuucacaauggggguccugugccucgccauccuguuugaggaagugaugcggggaaaguucggcaagaaacauaugauugccggcguuuucuuuaccuucgugcuucugcucagcgggcagaucacauggcgcgauauggcucacacccugauuaugaucggauccaaugccagcgacagaaugggcaugggggucacguaccuggcgcuuauugcuacauuuaagauccagcccuuccuggcccucggauuuuuccugcggaaacucaccucuagagagaaccugcuucugggcguggggcucgccauggcuacaacccugcaacugccugaagauaucgagcagauggccaauggaauugcucuuggccugauggcccucaagcugaucacccaguuugagacauaucagcucuggacggcgcugauuucccuuaccuguagcaacacaaucuucacccugacaguggccuggcgcaccgcuacgcucauucuggccggcgucucccugcuuccgguuugccaaucuagcuccaugcggaaaacagacuggcugcccaugaccguggcugccaugggggugccuccccucccucuguuuaucuucucucucaaggauacccugaagagacgcagcuggccccuuaaugaaggagucauggccgugggccugguuuccauccuggcuucuagccuccugagaaacgacgugccuauggcggggccccuugucgccggaggccugcucauugcuuguuacgugaucacagggaccuccgccgaucugacaguugagaaagccgcugacgugacgugggaagaggaagccgagcagaccggagucagccauaaccucaugauuacaguggacgaugacggcaccaugcggaucaaggaugacgagacagaaaauauucugaccguccuucugaaaacggcgcugcucaucgugucuggcaucuuuccguacuccauuccugcuacccugcuuguuuggcacacauggcagaagcagacccaacgcagcggggugcugugggauguccccucuccucccgagacacagaaagccgaacucgaggagggaguguauagaaucaagcagcagggcauuuucgggaaaacccaaguuggagugggcguccagaaggaagggguguuucauacaauguggcacgugacgcggggagccguucugaccuacaacggcaagcgccucgagccgaauugggcuuccgucaaaaaggaccugaucagcuauggcgggggauggagacuuucugcccaguggcaaaaaggcgaagagguccaggugauugcggucgaaccugggaagaaccccaaaaauuuccagacaaugccuggaaccuuccagaccacaacgggcgagaucggggcuauugcccuggauuuuaagcccggaaccuccggcagccccaucaucaaccgggagggcaaggugguugggcuguacggaaauggcguggucaccaagaacgggggauauguguccggcauugcccaaaccaaugcugaaccugacgggccgacacccgagcucgaagaggaaauguucaagaaacgcaaccugaccaucauggaucuucacccuggcagcggaaagacgagaaaauaccugcccgccauuguucgggaggcuaucaagcgcagacuccggacacugauucucgccccuaccagaguggucgcggccgagauggaagaggcucugaagggccuucccauccgcuaucagaccacagccaccaaaucugaacauacagggcgggagaucguggaccugaugugccacgcuaccuuuacgaugagacugcucagcccuguucgcgugccgaauuacaaccugauuaucauggaugaagcccauuucacagaccccgccuccauugcugcgcggggauacaucucuaccagagucggcaugggggaggccgcugccauuuuuaugacagccaccccucccggaacggcugaugccuucccucagagcaaugcgcccauccaggacgaggaacgcgacaucccggagcgguccuggaacucuggcaaugaauggauuaccgauuuugcugggaagacagugugguucgugccuagcaucaaagccggcaacgacauugccaacugucuuagaaagaauggcaaaaaggucauccaacugucccgcaagaccuuugauacagaguaucagaaaaccaagcucaacgacugggauuucguugugacaaccgacauuucugagaugggagcuaauuuuaaagccgaucgggugaucgaccccagacggugccugaagcccgucauucugacggaugggagcgaacgcgugauccucgcgggaccuaugcccguuacagccgcuuccgccgcucagagacggggccgcguggggagaaacccucagaaagagaaugaccaauacaucuucaccggacagccgcuuaacaaugaugaagaccacgcccauuggaccgaggcuaagaugcugcuggacaacauuaauacacccgaaggcaucauuccugcccucuucgagcccgagcgggaaaagagcgcggccaucgauggggaguauagacugaaaggcgaaucucgcaagaccuuugucgagcuuaugcggagaggagaccugccuguguggcucgcucacaaaguugccuccgaaggcauuaaguacacagaucgcaaauggugcuucgacgggcagcggaacaaucagauccuggaggagaacauggauguggaaaucuggacgaaggagggagagaagaagaagcugagaccccgcuggcucgacgcucggaccuauagcgauccgcuugcccugaaagaguuuaaggacuucgccgcuggcagaaaaucuauugcgcuggaucucgucacagaaaucgggcgcgugccuacccaccuggcccauagaacacggaaugcucuugacaaccuggucaugcuccacaccuccgagcauggaggcaaggccuaccgccacgccguggaggaacugcccgagacgauggaaacccugcuccuucugggccugaugauucuccugacagggggagcuaugcuuuuucugaucagcggcaaagggauuggaaagaccuccaucggccucaucuguguuauugccucuagcgggaugcuguggauggcggagaucccucugcaauggauugccuccgcuaucgugcucgaguucuuuaugauggugcuucugauucccgaaccugagaagcagagaacaccccaggauaaucaacuggccuaugucguuaucggcauucucacccuggcugccacgaucgcggccaacgaaaugggccuucuggagacaaccaaacgggaccucggcaugagcaaggaaccggggguggugucuccuacauccuaccuggaugucgaccugcaccccgcuagcgccuggacccucuacgcuguggccaccacaguuaucacgcccaugcuucgccauaccauugaaaauucuacagcuaacgugagccuggccgcgaucgccaaccaggcugucgugcugaugggacucgacaaaggcuggccuauuuccaagauggaucugggggucccgcuucuggcccucggaugcuauucucaggugaauccccugacccugacagcugccguucuccuucugaucacccacuacgccauuaucggcccugggcugcaggcgaaagcuacgagagaggcccaaaagcggacagcugccggaaucaugaagaaccccaccguggacggcauuaugaccaucgaucucgacccugucauuuaugauagcaaauucgagaagcagcugggccaggugaugcuucugguucucugugccgugcagcugcugcucaugagaacauccugggcucuuugcgaggcccugacccuggcgacagggcccaucacgacccucugggaaggaucuccuggcaaauuuuggaauacaaccauugccgucagcauggcuaacaucuuccgcggguccuaccuggccggagcuggccuugccuuuagcaucaugaagucuguggggacaggaaaacggggcaccggcucccaaggggagacgcugggagaaaaguggaagaaaaagcucaaucagcugagcagaaaagaguucgaccuguauaagaaauccggcauuaccgagguggaucgcacagaagcgaaggaggggcucaaacggggagaaaucacccaucacgccguuucuagaggcagcgcuaaacuucagugguuugucgagcggaacauggugauuccggaagggcgcgugaucgaccugggauguggcagaggcgggugguccuacuauugcgccggacugaagaaagucacagagguucggggcuacaccaaagggggacccggccaugaggaaccugugcccaugucuacauacggguggaauauugugaaacucaugagcggaaaggaugucuucuaucugccucccgagaaaugugacacccuucugugcgauaucggcgaauccagcccgucuccuacgguggaggagucccgcacaauuagaguucucaagaugguggaacccuggcugaagaacaaucaguucuguaucaaaguccugaaccccuacaugccuaccgugaucgagcaccucgaacggcuucaacgcaagcacggcgggaugcugguuagaaauccccugagccggaacucuacccaugagauguauuggauuuccaauggaacaggcaacaucguggcuagcgucaauauggugucucgccuccugcuuaacagauuuacgaugacccaccggagaccuacaauugaaaaagacguggaucugggggccggaacccgccaugucaacgcugagccggagacacccaauauggacguuaucggcgaacggauuaagagaaucaaagaggaacacaacagcaccuggcacuacgacgaugagaauccuuauaagacaugggccuaccauggguccuaugaagugaaggcgaccggaucugccagcuccaugaucaacggcguggucaaacuccugacgaagcccugggacgugguuccuauggugacccagauggcuaugacagauaccacacccuucggccagcaacgcgucuuuaaagagaagguggacacccggacgccgagaccuaugcccgggacacgccggguuaugggaauuaccgccgaguggcuguggagaacacucggccgcaauaaaaagccucggcugugcaccagagaagaguucacgaagaaagugcgcaccaacgcugccaugggggccgucuuuacagaagagaaucagugggauagcgcgaaggcugccguggaagacgaggauuucuggaaacuuguugaccgggagagagaacugcacaagcucggaaaauguggcuccugcguguacaacaugauggggaagcgcgagaaaaagcugggcgaauuuggaaaggccaaaggcucuagagcuaucugguacauguggcuuggggcccgguaucuggaguucgaggcucucggauuucugaaugaagaucauugguucagccgcgagaacuccuacucuggcgucgaaggggagggacugcacaagcucggcuauauucugagagacaucagcaaaauucccgggggcgccauguacgcggaugacaccgccggaugggacacacggaucaccgaagaugaccuucauaaugaggagaagaucacacagcagauggauccugaacacagacaacuggcuaacgccauuuuuaaacucaccuaucagaauaagguggucaaggugcagcggcccacgccgacaggcaccguuauggacaucauuucccgcaaagaucagagagggucuggacaagugggcaccuacgggcugaacacauucaccaauauggaggcucagcuuauccggcagauggaaggagagggcguccugagcaaggccgaccucgaaaacccucaucugcccgagaaaaagauuacacaguggcuggagacgaaagggguggaacgccucaagagaauggcgaucuccggcgaugacugcgugguuaagcccaucgaugaccgguuugccaacgcucugcuugcccugaaugauaugggaaaagugcgcaaggacauuccucaauggcagccgagcaaaggcuggcaugauuggcagcagguccccuucuguucucaccauuuccacgagcucaucaugaaggacgggagaaaacuggugguuccuugccggccccaagacgaacuuauuggacgcgcuagaaucucccagggcgccggguggagccugcgggagaccgcuugucucggaaaggccuaugcgcagauguggucucugauguacuuucaccgcagagaucugcggcucgccuccaacgcuauuugcagcgccgugccuguccauugggugcccacaucucgcaccacaugguccauccacgcccaucaccaauggaugaccacggaagacaugcugaccgucuggaauagaguguggauugaggauaacccuuggauggaggacaagacacccguuaccacaugggaaaaugugccguaccuuggcaaacgggaggaucaguggugugggagccugaucggccucaccuccagagcuacgugggcccagaacaucccuacagcgauucagcaaguccgcagccugaucggaaaugaagaguuccuugacuauaugcccucuaugaagcgguuuagaaaagaggaagagagcgaaggcgcuauuugguga

SEQ ID NO: 20754 - RNA, 9873 nt, Artificial Sequence
  derived and/or modified CDS sequence (opt5) from DENV-3__KF955454__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggagaugugcgacgauacagugaccuacaaauguccccacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaggggauaugauuauccccaaaagccuggccggaccuauuucccagcacaacuaucgccccggcuaccauacacaaaccgcggggccuuggcaccuuggaaagcuggagcucgacuuuaauuauugcgagggcacgacaguugugaucaccgaaaacuguggcacacgggggcccagccugagaaccacaaccgucucuggaaaacugauccacgaguggugcugucgcuccugcacgcuuccgccucuccgguacaugggcgaagauggguguugguauggaauggagauuagacccaucagcgaaaaggaggagaauauggugaaaucucugguuuccgcuggcagcggggaaguggacaacuucaccaugggaguccugugccucgccauucuguuugaggaagugaugcggggcaaguucggcaagaaacauaugaucgccgggguuuucuuuacauucgugcuucugcucucuggacagauuaccuggcgcgauauggcucacacacugaucaugauuggcagcaaugccuccgacagaauggggaugggagucaccuaccuggcgcuuaucgcuacguuuaagauccagcccuuccuggcccucggcuuuuuccugcggaaacucacaagcagagagaaccugcuucugggggugggacucgccauggcuaccacacugcaacugccugaagauauugagcagauggccaauggcaucgcucuuggccugauggcccucaagcugauuacccaguuugagaccuaucagcucuggacagcgcugaucucucuuacguguuccaacaccauuuucacacugaccguggccuggcgcacagcuacccucauccuggccggggucagccugcuuccgguuugccaauccucuagcaugcggaaaacggacuggcugcccaugacaguggcugccaugggagugccuccccucccucuguuuaucuucucccucaaggauacccugaagagacgcucuuggccccuuaaugaaggcgucauggccguggggcugguuagcauucuggcuuccucucuccugagaaacgacgugccuauggcgggaccccuugucgccggcgggcugcucaucgcuuguuacgugauuaccggaacaagcgccgaucugaccguugagaaagccgcugacgugacaugggaagaggaagccgagcagacgggcgucucccauaaccucaugaucaccguggacgaugacggcacaaugcggauuaaggaugacgagaccgaaaauauccugacaguccuucugaaaaccgcgcugcucaucgugagcgggauuuuuccguacucuaucccugcuacgcugcuuguuuggcacaccuggcagaagcagacacaacgcuccggagugcugugggauguccccagcccucccgagacccagaaagccgaacucgaggagggcguguauagaauuaagcagcaggggaucuucggaaaaacacaaguuggcguggggguccagaaggaaggaguguuucauaccauguggcacgugacacggggcgccguucugacguacaacggcaagcgccucgagccgaauugggcuucugucaaaaaggaccugauuuccuaugggggaggcuggagacuuagcgcccaguggcaaaaaggggaagagguccaggugaucgcggucgaaccuggaaagaaccccaaaaauuuccagaccaugccuggcacauuccagaccaccacaggggagauuggagcuaucgcccuggauuuuaagcccggcacgucuggcucccccaucauuaaccgggaggggaaggugguuggacuguacggcaaugggguggucaccaaaaacggaggcuaugugagcgggaucgcccaaacaaaugcugaaccugacggcccgacccccgagcucgaagaggaaauguucaagaaacgcaaccugacaauuauggaucuucacccuggauccggcaagaccagaaaauaccugcccgccaucguucgggaggcuauuaagcgcagacuccggacgcugauccucgccccuacaagaguggucgcggccgagauggaagaggcucugaaggggcuucccauccgcuaucagaccaccgccacaaaaagcgaacauaccggacgggagauuguggaccugaugugccacgcuacauuuaccaugagacugcucucuccuguucgcgugccgaauuacaaccugaucauuauggaugaagcccauuucacggaccccgccagcaucgcugcgcggggcuacauuuccacaagagucgggaugggagaggccgcugccaucuuuaugaccgccacaccucccggcaccgcugaugccuucccucagucuaaugcgcccauccaggacgaggaacgcgacauuccggagcggagcuggaacuccgggaaugaauggaucacggauuuugcuggcaagaccgugugguucgugccuucuauuaaagccggaaacgacaucgccaacugucuuagaaagaauggcaaaaaggucauucaacugagccgcaagacauuugauaccgaguaucagaaaacaaagcucaacgacugggauuucguugugaccacagacaucuccgagaugggggcuaauuuuaaagccgaucgggugauugaccccagacggugccugaagcccgucauccugaccgauggaccugaacgcgugauccucgcgggccccaugccuguuacggccgcuucugccgcucagagacgggggcgcgugggaagaaacccgcagaaagagaaugaccaauacauuuucacaggccagccccuuaacaaugaugaagaccacgcccauuggaccgaggcuaagaugcugcuggacaacaucaauaccccugaagggauuauccccgcccucuucgagccugagcgggaaaagagcgcggccauugauggcgaguauagacugaaaggagaaucccgcaagacauuucuugagcugaugcggagaggcgaccuccccgucuggcuggcuuacaaaguggccagcgaagggaucaaguauaccgaucgcaaauggugcuucgacggacagcggaacaaucagauccuggaggagaacauggauguugaaauuuggacaaaggagggcgagaagaagaagcucagaccgcgcuggcuugacgcucggacguacucugauccucuggcccugaaagaguuuaaggacuucgccgcugggagaaaauccaucgcgcucgaucuggugaccgaaauuggacgcguccccacacaccuugcccacagaacccggaaugcucuggacaaccucgugaugcugcauacaagcgagcacggcggcaaggccuaucgccaugccgucgaggaacugccugagaccauggaaacgcuccuucugcuggggcucaugauccugcuuaccggaggcgcuaugcuguuucucauuucugggaaaggaaucggcaagacauccaucgggcugauuugugugaucgccagcuccggaaugcuguggauggcggagauuccccuccaauggaucgccucugcuauuguucuugaguucuuuaugauggugcugcugaucccugaacccgagaagcagagaaccccgcaggauaaucaacucgccuacguggucauuggcauccugacacuugcugccaucauugcggccaacgaaaugggccugcucgagaccacgaaacgggaccuggggaugagcaaggaaccuggaguugugucccccacaagcuaccuggauguggaccuccaccccgcuucugccuggacccuuuaugcugucgccacaaccgugaucaccccuaugcugcgccacacaauugaaaauuccacggcuaacguuagccuggccgcgaucgccaaccaggcugugguccucaugggccuggacaaaggguggccgauuucuaagauggaucuuggagugccccugcucgcccugggcugcuacagccaggucaauccucugacccucacagcugccgugcuucugcugaucacccauuaugccaucauugggcccggacuccaggcgaaagcuacaagagaggcccaaaagcggaccgcugccggcaucaugaagaacccuacgguugacggcauuaugacaaucgaucuggaccccgugauuuacgauuccaaauucgagaagcagcuugggcaggucaugcugcucgugcugugugccguucagcugcuccuuaugagaaccucuugggcucugugcgaggcccugacccucgcgacaggaccuaucaccacacugugggaaggcagcccggggaaauuuuggaauacgaccaucgccguguccauggcuaacauuuuccgcggaucuuaucuugccggcgcugggcuggccuuuagcaucaugaaguccgucggaacaggcaaacggggcaccgggagccaaggagagacacucggcgaaaaguggaagaaaaagcugaaucagcugucuagaaaagaguucgaccucuacaagaaauccgggauuaccgagguggaucgcgcggaagccaaggagggacuuaaacggggcgaaaucacgcaccaugcugugagcagaggguccgccaagcugcagugguuuguugagcggaacauggucauucccgaaggacgcgugaucgaccugggcuguggcagagggggauggucuuauuacugcgcuggccucaagaaagugaccgagguccggggguacacaaagggaggcccugggcacgaggaacccguuccuaugagcaccuauggauggaauauugugaaacugauguccggcaaggauguguucuaccuucccccggagaaaugugacacacugcucugcgauaucggcgaaucuagcccuucccccaccgucgaggagagccgcacaaucagagugcugaagaugguugaacccuggcugaagaacaaucaguucuguauuaaagugcucaacccuuauaugcccaccgucaucgagcaucuugaacggcugcaacgcaagcacgggggaaugcuggugagaaauccucucucucggaacuccacgcacgagauguacuggauuagcaauggcacagggaacaucguugccucugugaauauggucucccgccugcuucugaacagauuuaccaugacccaucggagaccgacaauugaaaaagacguggaucucggagcuggcacgcgccacgugaacgccgagcccgagaccccuaauauggacgucaucggggaacggaucaagagaauuaaagaggaacauaacagcacauggcacuaugacgaugagaaucccuacaagaccugggcguaucacggaucuuacgaaguuaaggccacaggcagcgcuuccucuaugaucaacggcguggugaaacugcugaccaagccuugggacgucgugcccaugguuacacagauggccaugaccgauacgaccccguucgggcagcaacgcguguuuaaagagaaggucgacacacggaccccuagaagcaugcccggaacacgccgggugaugggcauuaccgcugaguggcucuggagaacgcuggggcgcaauaaaaagccucggcuuugcacaagagaagaguucaccaagaaaguucgcacaaacgccgccaugggagcgguguuuaccgaagagaaucagugggauuccgcuaaggccgccgucgaagacgaggauuucuggaaacugguggaccgggagagagaacuccauaagcugggcaaaugugggagcugcguuuacaacaugaugggcaagcgcgagaagaaacuuggagaauuuggcaaagcuaaaggguccagagccaucugguauauguggcugggagcucgguaccucgaguucgaggcccugggcuuucugaaugaagaucacugguucucucgcgagaacagcuauuccgggguggaaggagagggccuccauaagcugggguacauucuuagagacaucucuaaaauccccggcggagcgauguaugccgaugacacggcuggcugggacacccggauuacagaagaugaccugcacaaugaggagaagaucacccagcagauggauccugaacauagacaacucgccaacgcuauuuuuaaacugacauaccagaauaaggucgugaagguccagcggcccaccccgacagggaccgugauggacaucauuagccgcaaagaucagagaggauccggccaaguugggacguauggacuuaacacauucaccaauauggaggcccagcugauccggcagauggaaggcgagggggugcucucuaaggcggaccuggaaaacccucauccgcccgagaaaaagaucacccaguggcuggagacaaaaggcgucgaacgccucaagagaauggccauuagcggagaugacugcguggugaagccuaucgaugaccgguuugcuaacgcccugcuugcucugaaugauaugggcaaaguucgcaaggacauuccgcaauggcagcccuccaaaggguggcacgauuggcaacaggugccuuucuguagccaucacuuccaugagcucaucaugaaggacggaagaaaacuggucgugcccugccggccucaagacgaacuuauuggccgcgccagaaucucucagggggcuggauggucccugcgggagaccgccugucucggcaaggcguacgcccagauguggagccugauguacuuucaccgcagagaucugcggcucgcuucuaacgccauuugcuccgccguucccgugcacugggucccuacaagccgcacgaccuggucuauccaugcucaccaucaauggaugacaaccgaagacaugcugacaguguggaauagagucuggaucgaggauaaccccuggauggaggacaagaccccggugacgaccugggaaaauguuccuuaucuugggaaacgggaggaucagugguguggcucccugauuggacucacaagcagagccaccugggcgcagaacauccccacagcuauucagcaagugcgcucccugaucggcaaugaagaguuccuugacuacaugccuagcaugaagcgguuuagaaaagaggaagagucugaaggggccauuugguga

SEQ ID NO: 20755 - RNA, 9873 nt, Artificial Sequence
  derived and/or modified CDS sequence (opt5) from DENV-3__EU854292__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggaauuggcaaccgggacuuuguggaagggcucagcggagcuaccugggucgauguggugcuggagcacggcgggugcgucaccacaauggccaagaauaaacccacgcuggacaucgagcuccagaagaccgaagcuacacagcuggccacccuucgcaaacuguguauugagggaaagaucacaaacauuaccacggauuccagaugcccuacacagggcgaagcggcccucccggaggaacaggaccagaauuauguuuguaaacacaccuacguggaucggggcugggggaacggaugcggccuguucgggaagggaagccuugugaccugcgcuaaguuucaaugucuggagcccaucgagggcaaagucgugcagcaugaaaaucucaaguauacaguuaucauuaccgugcacacaggggaccagcaucaggucggaaacgagacgcaaggcgugaccgccgaaaucacaccucaggcuucuaccacagaggccauucugcccgaauacggcacccuggggcucgagugcuccccucgcacgggacuggacuucaaugagaugauccuucugaccaugaaaaacaaggccuggaugguucacagacagugguuuuucgaucucccccugccguggacaagcggcgcuaccacagaaaccccuacguggaaucggaaagagcuucuggugacauuuaagaacgcgcacgccaaaaagcaagaagucgugguccucgggucucaggagggagcuaugcauaccgcccugacaggcgccaccgaaauucaaaauuccgggggcaccagcaucuucgcuggacaccugaagugucgccucaaaauggacaagcuggagcuuaaaggcaugucuuaugccaugugcacaaacacguuugugcugaagaaagagguuuccgaaacccagcaugggacaauccucauuaagguggaguacaagggagaagaugcgcccuguaaaaucccuuucagcaccgaggacggccaagggaaggcucacaacggaagacugauuacagccaaucccgucgugaccaaaaaggaggaacccguuaacaucgaggccgaaccuccguucggcgaguccaauauugugaucgggaucggcgauaacgcucugaaaauuaauugguacaagaagggaucuagcaucggcaaaauguuugaagccacggcuagaggggccagacgcauggcgauucuuggagacacagccugggauuucggcuccgucgggggagugcucaacagccugggcaagauggugcaucagaucuuugggucugcuuauaccgcccuguucuccggcguuagcugggucaugaaaauuggaaucggcgugcuccugaccuggauugggcuuaauucuaagaacacaagcauguccuuuucuugcaucgcuaucggaauuaucacccuguaccucggcgccgugguccaggcggacauggggugugugauuaauuggaaaggaaaggagcugaagugcggcagcgggaucuucguuacaaacgaggugcacacguggaccgaacaguauaaauuucaagccgauucccccaagcggcuggcuacagccauugcuggcgccugggagaauggagucuguggcaucagaagcaccacacgcauggaaaaccuucucuggaaacagaucgccaaugagcugaacuacauucugugggaaaauaacaucaagcucaccgugguugugggggacauuaucggaguccuggagcagggcaaacggacgcuuaccccucagcccauggagcugaaguauucuuggaaaacaugggggaaggcuaagauugugaccgcggaaacacaaaacuccagcuucaucaucgauggaccuaauacccccgagugcccgucugccgcuagagccuggaacguuugggaaguggaggacuacggcuuuggcgucuucacaaccaauauuuggcucaaacugcgcgaaguguauacgcagcugugugaccaccggcuuauguccgccgcugugaaggaugagagagccguccaugcggacaugggguacuggaucgagagccagaaaaacggauccuggaagcucgaaaaggcuucucugauugagguuaagacaugcaccuggccuaagagccacacccugugguccaauggcgugcucgaaucugauaugaucauucccaaaagccuggccgggccuaucucccagcauaaccaccgccccggauaccacacacaaaccgccggcccuuggcaucuugggaagcuggagcucgacuuuaauuauugcgagggaacgacaguggucaucaccgaaaacuguggcacacggggccccagccugagaaccacaaccgugucugggaaacugauucacgaguggugcugucgcuccugcacgcuuccgccucuccgguacaugggagaagauggcuguugguaugggauggagaucagacccauuagcgaaaaggaggagaauaugguuaaaucucugguguccgcuggaagcggcaaggucgacaacuucaccaugggggugcugugccucgccauccuguuugaagagguuaugcggggaaaguucggcaaaaagcauaugauugcgggcguguucuuuacauucguccuucugcucucugggcagaucaccuggcgcgauauggcucacacacugauuaugaucggaagcaaugccuccgacagaaugggcaugggggugaccuaccuggcccuuaucgcuacguuuaaaauucagcccuuccuggcccucggauuuuuccugcggaagcucacaagcagagaaaaccugcuucugggcguugggcucgcuauggccaccacacugcaacugccugaggauaucgaacagauggcgaauggaauugcccuuggccugauggcucucaaacugaucacccaguuugagaccuaucagcucuggacagcccugauuucucuuacguguuccaacaccaucuucacacugaccguggcuuggcgcacagccacccucauccuggccggcgucagccugcuuccggugugccaauccucuagcaugcggaagacggacuggcugcccauggcuguggcggccaugggggucccuccccucccucuguuuauuuucugucucaaggauacacugaaaagacgcuccuggccccuuaaugagggaguuauggcugugggccuggugucuauccuggccagcucccuccugagaaacgacgucccuauggccgggccccuuguggcuggaggccugcucauugccugcuacguuaucaccgggaccucugcggaucugacaguggaaaaggcugccgacauuaccugggaggaagaggccgaacagacaggagucagccauaaccucaugaucacgguggacgaugacggcaccaugcggaucaaagaugacgagacagagaauauucugaccguucuucugaagacagcucugcucaucguguccggcauuuuuccguauagcaucccugccacccugcuugucuggcacacguggcagaaacagacccaacgcucuggggugcugugggauguccccuccccucccgaaacacagaaggcggagcucgaagagggaguguacagaauuaaacagcagggcaucuucgggaagacccaaguuggagugggcguccagaaggaggggguguuucacacaauguggcauguuacccggggagcugugcugacauacaacggcaaacgccucgaaccgaauugggccagcgucaagaaagaccugauuucuuauggcgggggauggagacuuuccgcccaguggcaaaagggcgaggaaguccaggugaucgcuguugagccugggaaaaaccccaagaauuuccagacgaugccuggaaccuuccagacaaccaccggcgaaaucggggccauugcucuggauuuuaagcccggaacaagcggcucucccaucauuaaccgggagggcaaagucguggggcuguacggaaauggcguggucacgaagaacgggggauauguguccggcaucgcccaaaccaaugcggagccugacgggccgacacccgaacucgaggaagagauguucaaaaagcgcaaccugaccauuauggaucuucacccuggcagcggaaaaacaagaaaguaccugcccgccaucguucgggaagcuaucaagcgcagacuccggacccugauucucgccccuacgagaguggucgcugccgagauggaggaagcccugaaaggccuucccauccgcuaucagacaaccgcuaccaaguccgagcauacagggcgggaaauuguggaccugaugugucacgcgaccuuuacaaugagacugcucagcccuguucgcgugccgaauuacaaccugaucauuauggaugaggcccauuucaccgaccccgcuucuaucgccgcccggggauauaucagcacgagagucggcaugggggaagcugccgcgauuuuuaugacagcuaccccucccggaacagccgaugccuucccucaguccaaugcucccauccaggacgaggagcgcgacauuccggaacggucuuggaacagcggcaaugaguggaucaccgauuuugccgggaaaacggugugguucguuccuuccauuaaggcgggcaacgacaucgccaacugccuucgcaaaaauggaaagaaggugauucaacugucuagaaaaaccuuugauacagaauaccagaagaccaaacucaacgacugggauuucgucgugacaaccgacaucagcgagaugggcgcuaauuuuaaggccgaucgggugaucgaccccagacggugccugaaacccgucauucugacagaugggccugagcgcguuauccucgcuggacccaugccugugaccgccgcuuccgccgcgcagagacggggccgcguggggagaaacccgcacaaggaaaaugaccaguacauuuucacgggacaaccccuuaacaaugaugaggaccacgcccauuggacagaagcuaagaugcugcuggacaacaucaauaccccugagggcauuauccccgcccucuucgaaccugagcgggagaaaucugcugccaucgauggggaauauagacugaagggcgagagccgcaaaaccuuugucgaacuuaugcggagaggagaccugcccguguggcucgcccacaagguugcuuccgagggcauuaaauacacagaucgcaagugguguuucgacgggcagcggaacaaucagauccuggaagagaacauggauguggagauuuggaccaaagaaggagagaagaagaaacugagaccgcgcuggcucgacgcgcggacauauagcgauccucuugcccugaaggaauuuaaagacuucgcugccggcagaaagucuaucgcccuggaucucgucacggagauugggcgcgugcccucccaucuggcucacagaacccggaaugcccuugacaaccugguuaugcuccacacaagcgaacauggaggccgcgcguacagacacgccguggaggagcugccugaaaccauggagacacugcuccuucugggccugaugauccuccugaccgggggagcuaugcuuuuucugaucucuggcaaagggauuggaaagacguccaucggccucauuugcgucaucgccagcuccgggaugcuguggauggcugaaauuccccugcaguggaucgccucugcgauugugcucgaguucuuuaugaugguccuucugaucccugagcccgaaaagcaacggaccccgcaggauaaucagcuggccuaugugguuaucggcauucucacacuggcugccaucauugcugccaacgagaugggccuucuggaaaccacaaaacgcgaccucggcaugagcaaggagccugggguggugucccccaccagcuaccuggaugucgaccugcaucccgcuucugccuggacgcucuaugcgguugccacaaccgugaucacaccuaugcuuagacacaccauugaaaauuccaccgcuaacgugagccuggccgcuaucgccaaccaagccgucgugcugaugggacucgacaaaggcuggccgaucucuaagauggaucuggggguuccccuucuggcgcucggauguuacagccaggugaauccucugacacugacggcugccguccuccuucugauuacccauuacgcuaucauuggccccgggcugcaggccaaagccacacgggaggcucagaagagaaccgccgcgggaaucaugaagaacccuacaguggacggcauuaugaccaucgaucucgaccccgucaucuaugauuccaaauucgagaagcaacugggccaggugaugcuucugguucucugcgccgugcagcugcugcucaugcgcacgucuugggcucuuugugaagcccugacacuggcuaccgggccuauuaccacacucugggagggaagcccgggcaaauuuuggaauaccacaaucgccgucuccauggcgaacauuuuccgggggucuuaccuggccggagcuggccuugccuuuagcaucaugaaguccguggggacgggaaaaagaggcaccggcagccagggggaaacacugggagagaaguggaagaaaaagcucaaucaacugucucgcaaagaguucgaccuguauaagaaauccggcauuaccgagguugaucggacagaggcuaaggaagggcucaaaagaggagagaucacccaccacgccgugagccggggcuccgcuaaacuucagugguuugucgaacgcaacauggugauucccgaggggagagugaucgaccugggaugcggccggggcggguggucuuacuauugugccggacugaagaaaguuacggaaguccgcggcuacaccaaagggggaccuggccaugaggagcccgugccuaugagcacauauggguggaauaucgugaaacucauguccggaaaggaugucuucuaccugcccccggaaaaaugcgacacccuucugugugauauuggcgagucuagcccuucccccacaguugaagagagcagaaccauccgggugcucaagaugguggagcccuggcugaagaacaaucaguucugcauuaaaguccugaacccuuacaugcccacagugaucgaacaccucgagcgccuucagagaaagcauggcgggaugcugguucggaauccucugucucgcaacuccacccacgaaauguauuggauuagcaauggaacgggcaacaucguggcgucugucaauaugguguccagacuccugcuuaaccgguuuacaaugacccacagacgcccgaccaucgagaaagacguugaucugggggccggaacacggcaugugaacgcugaacccgagacgccuaauauggacgucauuggcgagagaaucaagcgcauuaaagaagaacacaacagcaccuggcauuacgacgaugaaaaucccuauaagacaugggccuaccacgggucuuaugaggugaaggcuaccggaagcgccuccucuaugaucaacggcguggucaaacuccugacaaagccuugggacguugugcccauggugacccaaauggccaugacagauaccacgccguucggccagcagcgggucuuuaaagaaaagguggacaccagaacaccucgcagcaugcccgggacccggagaguuaugggaauuacagcggaguggcuguggcgcacccucggccggaauaaaaagccuagacuguguacgcgcgaggaguucacaaagaaagugcggaccaacgcugccaugggggccgucuuuacagaggaaaaucaaugggauuccgcuaaggccgcuguggaggacgaagauuucuggaaacuuguugacagagagcgcgagcugcauaagcucggaaaaugcggcagcugcguguacaacaugauggggaagagagagaagaagcugggcgaguuuggaaaggccaaaggcucccgggcgaucugguauauguggcuuggggcccgcuaccuggaguucgaggcucucggauuucugaaugaggaucacugguucucuagagaaaacagcuacuccggcgucgagggggaaggacugcacaagcucggcuauauccugcgggacauuucuaaaauccccgggggcgccauguacgcugaugacaccgccggaugggacacgagaauuaccgaggaugaccuucauaaugaagagaagaucacacagcagauggauccugagcaccggcagcuggcgaacgccauuuuuaaacucaccuaucaaaauaaggugguuaaggugcagcgccccacaccgaccggcacagucauggacaucaucagcagaaaagaucagcggggguccggacaggugggcaccuacgggcugaacacguucacaaauauggaagcucaacuuauucgccagauggagggagaaggcguccugucuaaggccgaccucgagaacccucaucugcccgagaaaaagaucacccaguggcuggagaccaaagggguggagagacucaagcggauggcuauuagcggcgaugacuguguugugaagcccaucgaugaccgcuuugccaacgcucugcuugcccugaaugauaugggaaaagucagaaaggacauuccucaguggcaaccguccaaaggcuggcacgauuggcaacaggugcccuucugcagccaccauuuccacgaacucaucaugaaggacgggcggaaacuggugguuccuugucgcccccaggacgagcuuauuggacgggcgcggaucucucaaggcgccggguggucccugaaggaaacagcuugccucggaaaggccuaugcccagauguggagccugauguacuuucaucgcagagaucugcggcucgcuucuaacgccaucuguuccgcggugccuguccacugggugcccaccagccgcacaacguggucuauucaugcucaccaccaguggaugaccacagaggacaugcugaccguuuggaauagaguguggaucgaagauaacccuuggauggaggacaaaacacccgucaccacgugggagaaugugccguaucuuggcaagcgggaagaucaauggugcgggucccugauuggccucaccagcagagccacaugggcccagaacaucccuaccgcuauucagcagguccgcucccugaucggaaaugaggaguuccuugacuacaugcccagcaugaaacgguuuagaaaggaggaggaaucugagggcgccaucugguga

SEQ ID NO: 20756 - RNA, 9873 nt, Artificial Sequence
  derived and/or modified CDS sequence (opt5) from DENV-3__FJ639746__SS-prME
accagccugugccucaugaugauccugcccgccgcucuugccuuccaccugacgucccgggacggcgaaccucggaugauuguggggaagaacgaacgcggaaagucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaacggcaagcgccucgagccgaauugggcuuccgucaaaaaggaccugauuagcuauggcgggggauggagacuuucugcccaguggcaaaaaggcgaagagguccaggugaucgcggucgaaccugggaagaaccccaaaaauuuccagaccaugccuggaacauuccagaccaccacaggcgagauuggggcuaucgcccuggauuuuaagcccggaacguccggcagccccaucauuaaccgggagggcaaggugguugggcuguacggaaauggcguggucaccaaaaacgggggauauguguccggcaucgcccaaacaaaugcugaaccugacgggccgacccccgagcucgaagaggaaauguucaagaaacgcaaccugacaauuauggaucuucacccuggcagcggaaagaccagaaaauaccugcccgccaucguucgggaggcuauuaagcgcagacuccggacgcugauccucgccccuacaagaguggucgcggccgagauggaagaggcucugaagggccuucccauccgcuaucagaccaccgccacaaaaucugaacauaccgggcgggagauuguggaccugaugugccacgcuacauuuaccaugagacugcucagcccuguucgcgugccgaauuacaaccugaucauuauggaugaagcccauuucacggaccccgccuccaucgcugcgcggggauacauuucuacaagagucggcaugggggaggccgcugccaucuuuaugaccgccacaccucccggaaccgcugaugccuucccucagagcaaugcgcccauccaggacgaggaacgcgacauuccggagcgguccuggaacucuggcaaugaauggaucacggauuuugcugggaagaccgugugguucgugccuagcauuaaagccggcaacgacaucgccaacugucuuagaaagaauggcaaaaaggucauucaacugucccgcaagacauuugauaccgaguaucagaaaacaaagcucaacgacugggauuucguugugaccacagacaucucugagaugggagcuaauuuuaaagccgaucgggugauugaccccagacggugccugaagcccgucauccugaccgaugggccugaacgcgugauccucgcgggacccaugccuguuacggccgcuagcgccgcucagagacggggccgcguggggagaaacccgcagaaagagaaugaccaauacauuuucacaggacagccccuuaacaaugaugaagaccacgcccauuggaccgaggcuaagaugcugcuggacaacaucaauaccccugaaggcauuauccccgcccucuucgagccugagcgggaaaaguccgcggccauugauggggaguauagacugaaaggcgaaagccgcaagacauuugucgagcuuaugcggagaggagaccugcccguguggcucgcucacaaaguugccucugaaggcaucaaguacaccgaucgcaaauggugcuucgacgggcagcggaacaaucagauccuggaggagaacauggauguggaaauuuggacaaaggagggagagaagaagaagcugagaccgcgcuggcucgacgcucggacguauuccgauccucuugcccugaaagaguuuaaggacuucgccgcuggcagaaaaagcaucgcgcuggaucucgucaccgaaauugggcgcgugcccucucaccuggcccauagaacacggaaugcucuugacaaccuggucaugcuccacaccuccgagcauggaggcaaggccuaccgccacgccguggaggaacugccugagacaauggaaacccugcuccuucugggccugaugauccuccugacagggggagcuaugcuuuuucugauuagcggcaaagggaucggaaagaccuccaucggccucauuuguguuaucgccucuagcgggaugcuguggauggcggagauuccccugcaauggaucgccuccgcuauugugcucgaguucuuuaugauggugcuucugaucccugaacccgagaagcagagaacaccgcaggauaaucaacuggccuaugucguuauuggaauccucacccuggcugccaucauugcggccaacgaaaugggccuucuggagacaaccaaacgggaccucggcaugagcaaggaaccugggguggugucucccacguccuaccuggaugucgaccugcaccccgcuagcgccuggacacucuacgcuguggccaccacaguuaucaccccuaugcuucgccauaccauugaaaauucuacagcuaacgugagccuggccgcgaucgccaaccaggcugucgugcugaugggacucgacaaaggcuggccgauuuccaagauggaucugggggucccccuucuggcccucggaugcuauucucaggugaauccucugacgcugaccgcugccguucuccuucugaucacacacuacgccaucauuggccccgggcugcaggcgaaagcuaccagagaggcccaaaagcggacagcugccggaaucaugaagaacccuaccguggacggcauuaugacgaucgaucucgaccccgucauuuaugauagcaaauucgagaagcagcugggccaggugaugcuucugguucucugugccgugcagcugcugcucaugagaacauccugggcucuuugcgaggcccugacccuggcgaccgggccuaucacaacccucugggaaggaucuccgggcaaauuuuggaauacaacgaucgccgucagcauggcuaacauuuuccgcggguccuaccuggccggagcuggccuugccuuuagcaucaugaagucuguggggaccggaaaacggggcacaggcucccaaggggagacccugggagaaaaguggaagaaaaagcucaaucagcugagcagaaaagaguucgaccuguauaagaaauccggcauuacagagguggaucgcaccgaagcgaaggaggggcucaaacggggagaaaucacgcaucacgccguuucuagaggcagcgcuaaacuucagugguuugucgagcggaacauggugauucccgaagggcgcgugaucgaccugggauguggcagaggcgggugguccuacuauugcgccggacugaagaaagucaccgagguucggggcuacacaaaagggggaccuggccaugaggaacccgugccuaugucuaccuacggguggaauauugugaaacucaugagcggaaaggaugucuucuaucugcccccggagaaaugugacacacuucugugcgauaucggcgaauccagcccuucucccaccguggaggagucccgcacaaucagaguucucaagaugguggaacccuggcugaagaacaaucaguucuguauuaaaguccugaacccuuacaugcccaccgugguugagcaccucgaacggcuucaacgcaagcacggcgggaugcuggugagaaauccucugagccggaacucuacgcaugagauguauuggaucuccaauggaacaggcaacauugucgcuagcgugaauauggugucucgccuccugcuuaacagauuuaccaugacccaccggagaccgacaaucgaaaaagacgucgaucugggggccggaacgcgccauguuaacgcugagcccgagaccccuaauauggacgugauuggcgaacggaucaagagaaucaaagaggaacacaacagcacauggcacuacgacgaugagaaucccuauaagaccugggccuaccauggguccuaugaagugaaggcgacaggaucugccagcuccaugauuaacggcgucgugaaacuccugaccaagccuugggacguugugcccauggucacacagauggcuaugaccgauacgaccccguucggccagcaacgcguguuuaaagagaagguugacacacggaccccuagaagcaugcccgggacacgccgggugaugggaaucaccgccgaguggcuguggagaacgcucggccgcaauaaaaagccucggcugugcacaagagaagaguucaccaagaaaguccgcacaaacgcugccaugggggccguguuuaccgaagagaaucagugggauuccgcgaaggcugccguugaagacgaggauuucuggaaacuuguggaccgggagagagaacugcacaagcucggaaaauguggcucuugcgucuacaacaugauggggaagcgcgagaaaaagcugggcgaauuuggaaaggccaaaggcagcagagcuauuugguacauguggcuuggggcccgguaucuggaguucgaggcucucggauuucugaaugaagaucauugguucucccgcgagaacucuuacagcggcguggaaggggagggacugcacaagcucggcuauauccugagagacauuuccaaaauccccgggggcgccauguacgcggaugacacggccggaugggacacccggaucacagaagaugaccuucauaaugaggagaagauuacccagcagauggauccugaacacagacaacuggcuaacgccaucuuuaaacucacauaucagaauaaggucgugaagguucagcggcccaccccgacaggcaccgugauggacauuaucucucgcaaagaucagagagggagcggacaagucggcacguacgggcugaacacauucaccaauauggaggcucagcuuauucggcagauggaaggagagggcgugcuguccaaggccgaccucgaaaacccucgccugcccgagaaaaagaucacccaguggcuggagacaaaagggguggaaagacucaagcggauggcgaucagcggcgaugacugcguugugaagcccauugaugaccgcuuugccaacgcucugcuugcccugaaugauaugggaaaagucagaaaggacaucccucaauggcagccgucuaaaggcuggcacgauuggcaacaggugcccuucuguucccaucacuuccaugagcucauuaugaaggacgggcggaaacugguugugccuugccgcccccaagacgaacuuaucggacgggcucggauuagccagggcgccggguggucucugcgcgagaccgcuugucucggaaaggccuaugcgcagauguggucccugauguacuuucacagacgggaucugcgccucgccagcaacgcuaucugcucugccgucccugugcacuggguccccacauccagaacgaccuggagcauucaugcccaccaucaauggaugacaaccgaagacaugcugacaguguggaaucggguuuggaucgaggauaacccuuggauggaggacaagacccccaucacgaccugggaaaaugugccguaccuuggcaaaagagaggaucaguggugugggucccugauuggccucacaagccgcgcuaccugggcccagaacaucccuacagcgauucagcaaguccggucucugaucggaaaugaagaguuccuugacuauaugcccagcaugaagagauuucgcaaagaggaagaguccgaaggcgcuauuugguga

SEQ ID NO: 20757 - RNA, 9873 nt, Artificial Sequence
  derived and/or modified CDS sequence (opt5) from DENV-3__FJ639750__SS-prME
accagccugugccucaugaugauccugcccgccgcucuugccuuccaccugacgucccgggacggcgaaccucggaugauuguggggaagaacgaacgcggaaagucucuccuguuuaagacggcgagcggcaucaauauguguacccuuauugcuauggaucugggggagaugugcgacgauacagugaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaacggcaagcgccucgagccgaauugggcuuccgucaaaaaggaccugauuagcuauggcgggggauggagacuuucugcccaguggcaaaaaggcgaagagguccaggugaucgcggucgaaccugggaagaaccccaaaaauuuccagaccaugccuggaacauuccagaccaccacaggcgagauuggggcuaucgcccuggauuuuaagcccggaacguccggcagccccaucauuaaccgggagggcaaggugguugggcuguacggaaauggcguggucaccaaaaacgggggauauguguccggcaucgcccaaacaaaugcugaaccugacgggccgacccccgagcucgaagaggaaauguucaagaaacgcaaccugacaauuauggaucuucacccuggcagcggaaagaccagaaaauaccugcccgccaucguucgggaggcuauuaagcgcagacuccggacgcugauccucgccccuacaagaguggucgcggccgagauggaagaggcucugaagggccuucccauccgcuaucagaccaccgccacaaaaucugaacauaccgggcgggagauuguggaccugaugugccacgcuacauuuaccaugagacugcucagcccuguucgcgugccgaauuacaaccugaucauuauggaugaagcccauuucacggaccccgccuccaucgcugcgcggggauacauuucuacaagagucggcaugggggaggccgcugccaucuuuaugaccgccacaccucccggaaccgcugaugccuucccucagagcaaugcgcccauccaggacgaggaacgcgacauuccggagcgguccuggaacucuggcaaugaauggaucacggauuuugcugggaagaccgugugguucgugccuagcauuaaagccggcaacgacaucgccaacugucuuagaaagaauggcaaaaaggucauucaacugucccgcaagacauuugauaccgaguaucagaaaacaaagcucaacgacugggauuucguugugaccacagacaucucugagaugggagcuaauuuuaaagccgaucgggugauugaccccagacggugccugaagcccgucauccugaccgaugggccugaacgcgugauccucgcgggacccaugccuguuacggccgcuagcgccgcucagagacggggccgcguggggagaaacccgcagaaagagaaugaccaauacauuuucacaggacagccccuuaacaaugaugaagaccacgcccauuggaccgaggcuaagaugcugcuggacaacaucaauaccccugaaggcauuauccccgcccucuucgagccugagcgggaaaaguccgcggccauugauggggaguauagacugaaaggcgaaagccgcaagacauuugucgagcuuaugcggagaggagaccugcccguguggcucgcucacaaaguugccucugaaggcaucaaguacaccgaucgcaaauggugcuucgacgggcagcggaacaaucagauccuggaggagaacauggauguggaaauuuggacaaaggagggagagaagaagaagcugagaccgcgcuggcucgacgcucggacguauuccgauccucuugcccugaaagaguuuaaggacuucgccgcuggcagaaaaagcaucgcgcuggaucucgucaccgaaauugggcgcgugcccucucaccuggcccauagaacacggaaugcucuugacaaccuggucaugcuccacaccuccgagcauggaggcaaggccuaccgccacgccguggaggaacugccugagacaauggaaacccugcuccuucugggccugaugauccuccugacagggggagcuaugcuuuuucugauuagcggcaaagggaucggaaagaccuccaucggccucauuuguguuaucgccucuagcgggaugcuguggauggcggagauuccccugcaauggaucgccuccgcuauugugcucgaguucuuuaugauggugcuucugaucccugaacccgagaagcagagaacaccgcaggauaaucaacuggccuaugucguuauuggaauccucacccuggcugccaucauugcggccaacgaaaugggccuucuggagacaaccaaacgggaccucggcaugagcaaggaaccugggguggugucucccacguccuaccuggaugucgaccugcaccccgcuagcgccuggacacucuacgcuguggccaccacaguuaucaccccuaugcuucgccauaccauugaaaauucuacagcuaacgugagccuggccgcgaucgccaaccaggcugucgugcugaugggacucgacaaaggcuggccgauuuccaagauggaucugggggucccccuucuggcccucggaugcuauucucaggugaauccucugacgcugaccgcugccguucuccuucugaucacacacuacgccaucauuggccccgggcugcaggcgaaagcuaccagagaggcccaaaagcggacagcugccggaaucaugaagaacccuaccguggacggcauuaugacgaucgaucucgaccccgucauuuaugauagcaaauucgagaagcagcugggccaggugaugcuucugguucucugugccgugcagcugcugcucaugagaacauccugggcucuuugcgaggcccugacccuggcgaccgggccuaucacaacccucugggaaggaucuccgggcaaauuuuggaauacaacgaucgccgucagcauggcuaacauuuuccgcggguccuaccuggccggagcuggccuugccuuuagcaucaugaagucuguggggaccggaaaacggggcacaggcucccaaggggagacccugggagaaaaguggaagaaaaagcucaaucagcugagcagaaaagaguucgaccuguauaagaaauccggcauuacagagguggaucgcaccgaagcgaaggaggggcucaaacggggagaaaucacgcaucacgccguuucuagaggcagcgcuaaacuucagugguuugucgagcggaacauggugauucccgaagggcgcgugaucgaccugggauguggcagaggcgggugguccuacuauugcgccggacugaagaaagucaccgagguucggggcuacacaaaagggggaccuggccaugaggaacccgugccuaugucuaccuacggguggaauauugugaaacucaugagcggaaaggaugucuucuaucugcccccggagaaaugugacacacuucugugcgauaucggcgaauccagcccuucucccaccguggaggagucccgcacaaucagaguucucaagaugguggaacccuggcugaagaacaaucaguucuguauuaaaguccugaacccuuacaugcccaccgugaucgagcaccucgaacggcuucaacgcaagcacggcgggaugcugguuagaaauccucugagccggaacucuacgcaugagauguauuggauuuccaauggaacaggcaacaucguggcuagcgucaauauggugucucgccuccugcuuaacagauuuaccaugacccaccggagaccgacaauugaaaaagacguggaucugggggccggaacgcgccaugucaacgcugagcccgagaccccuaauauggacguuaucggcgaacggaucaagagaauuaaagaggaacacaacagcacauggcacuacgacgaugagaaucccuauaagaccugggccuaccauggguccuaugaagugaaggcgacaggaucugccagcuccaugaucaacggcguggucaaacuccugaccaagccuugggacgugguucccauggugacacagauggcuaugaccgauacgaccccguucggccagcaacgcgucuuuaaagagaagguggacacacggaccccuagaagcaugcccgggacacgccggguuaugggaauuaccgccgaguggcuguggagaacgcucggccgcaauaaaaagccucggcugugcacaagagaagaguucaccaagaaagugcgcacaaacgcugccaugggggccgucuuuaccgaagagaaucagugggauuccgcgaaggcugccguggaagacgaggauuucuggaaacuuguugaccgggagagagaacugcacaagcucggaaaauguggcucuugcguguacaacaugauggggaagcgcgagaaaaagcugggcgaauuuggaaaggccaaaggcagcagagcuaucugguacauguggcuuggggcccgguaucuggaguucgaggcucucggauuucugaaugaagaucauugguucucccgcgagaacucuuacagcggcgucgaaggggagggacugcacaagcucggcuauauucugagagacaucuccaaaauccccgggggcgccauguacgcggaugacacggccggaugggacacccggauuacagaagaugaccuucauaaugaggagaagaucacccagcagauggauccugaacacagacaacuggcuaacgccauuuuuaaacucacauaucagaauaagguggucaaggugcagcggcccaccccgacaggcaccguuauggacaucauuucucgcaaagaucagagagggagcggacaagugggcacguacgggcugaacacauucaccaauauggaggcucagcuuauccggcagauggaaggagagggcguccuguccaaggccgaccucgaaaacccucaucugcccgagaaaaagaucacccaguggcuggagacaaaagggguggaacgccucaagagaauggcgauuagcggcgaugacugcgugguuaagcccaucgaugaccgguuugccaacgcucugcuugcccugaaugauaugggaaaagugcgcaaggacauuccucaauggcagccgucuaaaggcuggcaugauuggcagcagguccccuucuguucccaccauuuccacgagcucaucaugaaggacgggagaaaacuggugguuccuugccggccccaagacgaacuuauuggacgcgcuagaaucagccagggcgccggguggucucugcgggagaccgcuugucucggaaaggccuaugcgcagauguggucccugauguacuuucaccgcagagaucugcggcucgccagcaacgcuauuugcucugccgugccuguccauugggugcccacaucccgcacgaccuggagcauccacgcccaucaccaauggaugacaaccgaagacaugcugacagucuggaauagaguguggaucgaggauaacccuuggauggaggacaagacccccguuacgaccugggaaaaugugccguaccuuggcaaacgggaggaucaguggugugggucccugauuggccucacaagcagagcuaccugggcccagaacaucccuacagcgauucagcaaguccgcucucugaucggaaaugaagaguuccuugacuauaugcccagcaugaagcgguuuagaaaagaggaagaguccgaaggcgcuauuugguga

SEQ ID NO: 20758 - RNA, 9873 nt, Artificial Sequence
  derived and/or modified CDS sequence (opt5) from DENV-3__FJ639754__SS-prME
accagccugugccucaugaugauccugcccgccgcucuugccuuccaccugacgucccgggacggcgagccucggaugauuguggggaagaacgaacgcggaaagucucuccuguuuaagacggcgagcggcaucaauauguguacccuuauugcuauggaucugggggagaugugcgacgauacagugaccuacaaguguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaacggcaagcgccucgagccgaauugggcuuccgucaaaaaggaccugauuagcuauggcgggggauggagacuuucugcccaguggcaaaaaggcgaagagguccaggugaucgcggucgaaccugggaagaaccccaaaaauuuccagaccaugccuggaacauuccagaccaccacaggcgagauuggggcuaucgcccuggauuuuaagcccggaacguccggcagccccaucauuaaccgggagggcaaggugguugggcuguacggaaauggcguggucaccaaaaacgggggauauguguccggcaucgcccaaacaaaugcugaaccugacgggccgacccccgagcucgaagaggaaauguucaagaaacgcaaccugacaauuauggaucuucacccuggcagcggaaagaccagaaaauaccugcccgccaucguucgggaggcuauuaagcgcagacuccggacgcugauccucgccccuacaagaguggucgcggccgagauggaagaggcucugaagggccuucccauccgcuaucagaccaccgccacaaaaucugaacauaccgggcgggagauuguggaccugaugugccacgcuacauuuaccaugagacugcucagcccuguucgcgugccgaauuacaaccugaucauuauggaugaagcccauuucacggaccccgccuccaucgcugcgcggggauacauuucuacaagagucggcaugggggaggccgcugccaucuuuaugaccgccacaccucccggaaccgcugaugccuucccucagagcaaugcgcccauccaggacgaggaacgcgacauuccggagcgguccuggaacucuggcaaugaauggaucacggauuuugcugggaagaccgugugguucgugccuagcauuaaagccggcaacgacaucgccaacugucuuagaaagaauggcaaaaaggucauucaacugucccgcaagacauuugauaccgaguaucagaaaacaaagcucaacgacugggauuucguugugaccacagacaucucugagaugggagcuaauuuuaaagccgaucgggugauugaccccagacggugccugaagcccgucauccugaccgaugggccugaacgcgugauccucgcgggacccaugccuguuacggccgcuagcgccgcucagagacggggccgcguggggagaaacccgcagaaagagaaugaccaauacauuuucacaggacagccccuuaacaaugaugaagaccacgcccauuggaccgaggcuaagaugcugcuggacaacaucaauaccccugaaggcauuauccccgcccucuucgagccugagcgggaaaaguccgcggccauugauggggaguauagacugaaaggcgaaagccgcaagacauuugucgagcuuaugcggagaggagaccugcccguguggcucgcucacaaaguugccucugaaggcaucaaguacaccgaucgcaaauggugcuucgacgggcagcggaacaaucagauccuggaggagaacauggauguggaaauuuggacaaaggagggagagaagaagaagcugagaccgcgcuggcucgacgcucggacguauuccgauccucuugcccugaaagaguuuaaggacuucgccgcuggcagaaaaagcaucgcgcuggaucucgucaccgaaauugggcgcgugcccucucaccuggcccauagaacacggaaugcucuugacaaccuggucaugcuccacaccuccgagcauggaggcaaggccuaccgccacgccguggaggaacugccugagacaauggaaacccugcuccuucugggccugaugauccuccugacagggggagcuaugcuuuuucugauuagcggcaaagggaucggaaagaccuccaucggccucauuuguguuaucgccucuagcgggaugcuguggauggcggagauuccccugcaauggaucgccuccgcuauugugcucgaguucuuuaugauggugcuucugaucccugaacccgagaagcagagaacaccgcaggauaaucaacuggccuaugucguuauuggaauccucacccuggcugccaucauugcggccaacgaaaugggccuucuggagacaaccaaacgggaccucggcaugagcaaggaaccugggguggugucucccacguccuaccuggaugucgaccugcaccccgcuagcgccuggacacucuacgcuguggccaccacaguuaucaccccuaugcuucgccauaccauugaaaauucuacagcuaacgugagccuggccgcgaucgccaaccaggcugucgugcugaugggacucgacaaaggcuggccgauuuccaagauggaucugggggucccccuucuggcccucggaugcuauucucaggugaauccucugacgcugaccgcugccguucuccuucugaucacacacuacgccaucauuggccccgggcugcaggcgaaagcuaccagagaggcccaaaagcggacagcugccggaaucaugaagaacccuaccguggacggcauuaugacgaucgaucucgaccccgucauuuaugauagcaaauucgagaagcagcugggccaggugaugcuucugguucucugugccgugcagcugcugcucaugagaacauccugggcucuuugcgaggcccugacccuggcgaccgggccuaucacaacccucugggaaggaucuccgggcaaauuuuggaauacaacgaucgccgucagcauggcuaacauuuuccgcgggaauuaccuggccggagcuggccuugccuuuuccaucaugaaaagcguggggaccggaaaacggggcacaggcucucaaggggagacccugggagaaaaguggaagaaaaagcucaaccagcuguccagaaaagaguucgaccuguauaagaaaagcggcauuacagagguggaucgcaccgaagcgaaggaggggcucaaacggggagaaaucacgcaucacgccguuuccagaggcucugcuaaacuucagugguuugucgagcggaauauggugauucccgaagggcgcgugaucgaccugggauguggcagaggcggguggagcuacuauugcgccggacugaagaaagucaccgagguucggggcuacacaaaagggggaccuggccaugaggaacccgugccuauguccaccuacggguggaacauugugaaacucaugucuggaaaggaugucuucuaucugcccccggagaaaugugacacacuucugugcgauaucggcgaaagcuccccuagccccaccguggaggagucucgcacaaucagaguucucaagaugguggaacccuggcugaagaauaaccaguucuguauuaaaguccugaauccuuacaugcccaccgugaucgagcaccucgaacggcuucaacgcaagcacggcgggaugcugguuagaaacccucugucccggaauagcacgcaugagauguauuggauuucuaacggaacaggcaauaucguggcuuccgucaacauggugagccgccuccugcuuaacagauuuaccaugacccaccggagaccgacaauugaaaaagacguggaucugggggccggaacgcgccaugucaaugcugagcccgagaccccuaacauggacguuaucggcgaacggaucaagagaauuaaagaggaacacaauucuacauggcacuacgacgaugagaaccccuauaagaccugggccuaccaugggagcuaugaagugaaggcgacaggauccgccucuagcaugaucaauggcguggucaaacuccugaccaagccuugggacgugguucccauggugacacagauggcuaugaccgauacgaccccguucggccagcaacgcgucuuuaaagagaagguggacacacggaccccuagauccaugcccgggacacgccggguuaugggaauuaccgccgaguggcuguggagaacgcucggccgcaacaaaaagccucggcugugcacaagagaagaguucaccaagaaagugcgcacaaaugcugccaugggggccgucuuuaccgaagagaaccagugggauagcgcgaaggcugccguggaagacgaggauuucuggaaacuuguugaccgggagagagaacugcacaagcucggaaaauguggcuccugcguguacaauaugauggggaagcgcgagaaaaagcugggcgaauuuggaaaggccaaaggcucuagagcuaucugguacauguggcuuggggcccgguaucuggaguucgaggcucucggauuucugaacgaagaucauugguucagccgcgaaaauuccuacucuggcgucgaaggggagggacugcacaagcucggcuauauucugagagacaucagcaaaauccccgggggcgccauguacgcggaugacacggccggaugggacacccggauuacagaagaugaccuucauaacgaggagaagaucacccagcagauggauccugaacacagacaacuggcuaaugccauuuuuaaacucacauaucagaacaagguggucaaggugcagcggcccaccccgacaggcaccguuauggacaucauuucccgcaaagaucagagagggucuggacaagugggcacguacgggcugaauacauucaccaacauggaggcucagcuuauccggcagauggaaggagagggcguccugagcaaggccgaccucgaaaacccucaucugcccgagaaaaagaucacccaguggcuggagacaaaagggguggaacgccucaagagaauggcgauuuccggcgaugacugcgugguuaagcccaucgaugaccgguuugccaaugcucugcuugcccugaacgauaugggaaaagugcgcaaggacauuccucaauggcagccgagcaaaggcuggcaugauuggcagcagguccccuucuguucucaccauuuccacgagcucaucaugaaggacgggagaaaacuggugguuccuugccggccccaagacgaacuuauuggacgcgcuagaaucucccagggcgccggguggagccugcgggagaccgcuugucucggaaaggccuaugcgcagauguggucucugauguacuuucaccgcagagaucugcggcucgccuccaaugcuauuugcagcgccgugccuguccauugggugcccacaucucgcacgaccugguccauccacgcccaucaccaauggaugacaaccgaagacaugcugacagucuggaacagaguguggaucgaggauaauccuuggauggaggacaagacccccguuacgaccugggaaaacgugccguaccuuggcaaacgggaggaucaguggugugggagccugauuggccucacauccagagcuaccugggcccagaauaucccuacagcgauucagcaaguccgcagccugaucggaaacgaagaguuccuugacuauaugcccucuaugaagcgguuuagaaaagaggaagagagcgaaggcgcuauuugguga

SEQ ID NO: 20759 - RNA, 9873 nt, Artificial Sequence
  derived and/or modified CDS sequence (opt5) from DENV-3__FJ639757__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggagaugugcgacgauacagugaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauucugcccugaaaaucaacugguauaagaagggaagcuccauuggcaaaauguuugaagccacggcuagaggggccagacgcauggcuauccuuggagacacagccugggauuucggcagcguugggggaguccucaauucucugggcaagauggugcaccagauuuuuggguccgcguacaccgcccuguucagcggcgugucuugggucaugaaaaucggaauuggcgugcuccugaccuggaucgggcuuaacagcaagaauacauccaugucuuuuagcugcauugcuaucggaaucauuacccuguaucucggcgccguugugcaggcugacauggggugugucaucaacuggaaaggaaaggagcugaagugcggcuccgggauuuucgugacaaaugagguucauacguggaccgaacaguacaaauuucaagccgauagccccaagcggcuggcgacagccaucgcuggcgccugggagaacggaguguguggcauuagaucuaccacacgcauggaaaaucuucucuggaaacagaucgcuaacgagcugaauuauauccugugggaaaacaauauuaagcucaccgucgugguuggggacaucauuggagugcuggagcagggcaaacggacgcuuaccccucagcccauggagcugaaguacuccuggaaaacaugggggaaggccaagaucgucaccgccgaaacacaaaacagcucuuucauuaucgauggaccuaacacccccgagugcccguccgcuagcagagcguggaaugugugggaaguggaggacuauggcuuuggcgucuucacaaccaacaucuggcucaaacugcgcgaaguuuacacgcagcugugugaccaccggcuuauguccgccgcugugaaggaugagagagccgugcacgccgacaugggguacuggauugagucucagaaaaauggaagcuggaagcucgaaaaggcuucccugaucgaggucaagacaugcaccuggccuaagucucauacccuguggagcaacggcgugcucgaauccgauaugauuauccccaaaagccuggccgggccuauuucucagcacaauuaucgccccggauaccauacacaaaccgcgggcccuuggcaccuugggaagcuggagcucgacuuuaacuauugcgagggaacgacaguugugaucaccgaaaauuguggcacacggggccccucccugagaaccacaaccgucagcgggaaacugauccacgaguggugcugucgcucuugcacgcuuccgccucuccgguacaugggagaagauggcuguugguaugggauggagauuagacccaucuccgaaaaggaggagaacauggugaaaagccugguuucugcuggaagcggcgaaguggacaauuucaccauggggguccugugccucgccauucuguuugaggaagugaugcggggaaaguucggcaagaaacauaugaucgccggcguuuucuuuacauucgugcuucugcucuccgggcagauuaccuggcgcgauauggcucacacacugaucaugauuggaagcaacgccucugacagaaugggcaugggggucaccuaccuggcgcuuaucgcuacguuuaagauccagcccuuccuggcccucggauuuuuccugcggaaacucacauccagagagaaucugcuucugggcguggggcucgccauggcuaccacacugcaacugccugaagauauugagcagauggccaacggaaucgcucuuggccugauggcccucaagcugauuacccaguuugagaccuaucagcucuggacagcgcugaucagccuuacguguuccaauaccauuuucacacugaccguggccuggcgcacagcuacccucauccuggccggcgucucucugcuuccgguuugccaaagcuccucuaugcggaaaacggacuggcugcccaugacaguggcugccaugggggugccuccccucccucuguuuaucuucagccucaaggauacccugaagagacgcuccuggccccuuaacgaaggagucauggccgugggccugguuucuauucuggcuagcucccuccugagaaaugacgugccuauggcggggccccuugucgccggaggccugcucaucgcuuguuacgugauuaccgggacaagcgccgaucugaccguugagaaagccgcugacgugacaugggaagaggaagccgagcagacgggagucucucauaaccucaugaucaccguggacgaugacggcacaaugcggauuaaggaugacgagaccgaaaacauccugacaguccuucugaaaaccgcgcugcucaucguguccggcauuuuuccguacagcaucccugcuacgcugcuuguuuggcacaccuggcagaagcagacacaacgcucuggggugcugugggauguccccuccccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaauggcaagcgccucgagccgaacugggcuagcgucaaaaaggaccugauuucuuauggcgggggauggagacuuuccgcccaguggcaaaaaggcgaagagguccaggugaucgcggucgaaccugggaagaaucccaaaaacuuccagaccaugccuggaacauuccagaccaccacaggcgagauuggggcuaucgcccuggauuuuaagcccggaacgagcggcucccccaucauuaaucgggagggcaaggugguugggcuguacggaaacggcguggucaccaaaaaugggggauaugugagcggcaucgcccaaacaaacgcugaaccugacgggccgacccccgagcucgaagaggaaauguucaagaaacgcaaucugacaauuauggaucuucacccuggcucuggaaagaccagaaaauaccugcccgccaucguucgggaggcuauuaagcgcagacuccggacgcugauccucgccccuacaagaguggucgcggccgagauggaagaggcucugaagggccuucccauccgcuaucagaccaccgccacaaaaagcgaacauaccgggcgggagauuguggaccugaugugccacgcuacauuuaccaugagacugcucuccccuguucgcgugccgaacuacaaucugaucauuauggaugaagcccauuucacggaccccgccucuaucgcugcgcggggauacauuagcacaagagucggcaugggggaggccgcugccaucuuuaugaccgccacaccucccggaaccgcugaugccuucccucaguccaacgcgcccauccaggacgaggaacgcgacauuccggagcggucuuggaauagcggcaacgaauggaucacggauuuugcugggaagaccgugugguucgugccuuccauuaaagccggcaaugacaucgccaacugucuuagaaagaacggcaaaaaggucauucaacugucucgcaagacauuugauaccgaguaucagaaaacaaagcucaaugacugggauuucguugugaccacagacaucagcgagaugggagcuaacuuuaaagccgaucgggugauugaccccagacggugccugaagcccgucauccugaccgaugggccugaacgcgugauccucgcgggacccaugccuguuacggccgcuuccgccgcucagagacggggccgcguggggagaaauccgcagaaagagaacgaccaauacauuuucacaggacagccccuuaauaacgaugaagaccacgcccauuggaccgaggcuaagaugcugcuggacaauaucaacaccccugaaggcauuauccccgcccucuucgagccugagcgggaaaagagcgcggccauugauggggaguauagacugaaaggcgaaucucgcaagacauuugucgagcuuaugcggagaggagaccugcccguguggcucgcucacaaaguugccuccgaaggcaucaaguacaccgaucgcaaauggugcuucgacgggcagcggaauaaccagauccuggaggagaauauggauguggaaauuuggacaaaggagggagagaagaagaagcugagaccgcgcuggcucgacgcucggacguauagcgauccucuugcccugaaagaguuuaaggacuucgccgcuggcagaaaaucuaucgcgcuggaucucgucaccgaaauugggcgcgugcccacacaccuggcccauagaacccggaacgcucuugacaaucuggucaugcuccacacauccgagcauggaggcaaggccuaccgccacgccguggaggaacugccugagaccauggaaacgcugcuccuucugggccugaugauccuccugaccgggggagcuaugcuuuuucugauuagcggcaaagggaucggaaagacauccaucggccucauuuguguuaucgccucuagcgggaugcuguggauggcggagauuccccugcaauggaucgccuccgcuauugugcucgaguucuuuaugauggugcuucugaucccugaacccgagaagcagagaaccccgcaggauaaccaacuggccuaugucguuauuggaauccucacacuggcugccaucauugcggccaaugaaaugggccuucuggagaccacgaaacgggaccucggcaugagcaaggaaccugggguggugucucccacauccuaccuggaugucgaccugcaccccgcuagcgccuggacccucuacgcuguggccacaaccguuaucaccccuaugcuucgccauacaauugagaacucuacggcuaaugugagccuggccgcgaucgccaaccaggcugucgugcugaugggacucgacaaaggcuggccgauuuccaagauggaucugggggucccccuucuggcccucggaugcuauucucaggugaacccucugacccugacagcugccguucuccuucugaucacccacuacgccaucauuggccccgggcugcaggcgaaagcuacaagagaggcccaaaagcggaccgcugccggaaucaugaagaauccuacgguggacggcauuaugacaaucgaucucgaccccgucauuuaugauagcaaauucgaaaagcagcugggccaggugaugcuucugguucucugugccgugcagcugcugcucaugagaaccuccugggcucuuugcgaggcccugacccuggcgacagggccuaucaccacacucugggaaggaucuccgggcaaauuuuggaacacgaccaucgccgucagcauggcuaauauuuuccgcggguccuaccuggccggagcuggccuugccuuuagcaucaugaagucuguggggacaggaaaacggggcaccggcucccaaggggagacacugggagaaaaguggaagaaaaagcucaaccagcugagcagaaaagaguucgaccuguauaagaaauccggcauuaccgagguggaucgcacggaagcgaaggaggggcucaaacggggagaaaucacccaucacgccguuucuagaggcagcgcuaaacuucagugguuugucgagcggaauauggugauucccgaagggcgcgugaucgaccugggauguggcagaggcgggugguccuacuauugcgccggacugaagaaagucacagagguucggggcuacaccaaagggggaccuggccaugaggaacccgugccuaugucuacauacggguggaacauugugaaacucaugagcggaaaggaugucuucuaucugcccccggagaaaugugacacccuucugugcgauaucggcgaauccagcccuucucccacaguggaggagucccgcaccaucagaguucucaagaugguggaacccuggcugaagaauaaccaguucuguauuaaaguccugaauccuuacaugcccacggugaucgagcaccucgaacggcuucaacgcaagcacggcgggaugcugguuagaaacccucugagcagaaauucuacacaugagauguauuggauuuccaacggaaccggcaauaucguggcuagcgucaacauggugucucgccuccugcuuaauagauuuaccaugacacaccggagaccgacgauugaaaaagacguggaucugggggccggaacccgccaugucaacgcugagcccgagacaccuaacauggacguuaucggcgaacggaucaagagaauuaaagaggaacacaauagcaccuggcacuacgacgaugagaaccccuauaagacaugggccuaccauggguccuaugaagugaaggcgaccggaucugccagcuccaugaucaauggcguggucaaacuccugacaaagccuugggacgugguucccauggugacccagauggcuaugacggauaccacaccguucggccagcaacgcgucuuuaaagagaagguggacacccggacaccuagaagcaugcccgggacccgccggguuaugggaauuacggccgaguggcuguggagaacacucggccgcaacaaaaagccucggcugugcaccagagaagaguucacaaagaaagugcgcaccaaugcugccaugggggccgucuuuacggaagagaaccagugggauuccgcgaaggcugccguggaagacgaggauuucuggaaacuuguugaccgggagagagaacugcacaagcucggaaaauguggcucuugcguguacaauaugauggggaagcgcgagaaaaagcugggcgaauuuggaaaggccaaaggcagcagagcuaucugguacauguggcuuggggcccgguaucuggaguucgaggcucucggauuucugaacgaagaucauugguucucccgcgaaaauucuuacagcggcgucgagggggagggacugcacaagcucggcuauauucugagagacaucuccaaaauccccgggggcgccauguacgcggaugacaccgccggaugggacacacggauuaccgaagaugaccuucauaacgaggagaagaucacacagcagauggauccugaacacagacaacuggcuaaugccauuuuuaaacucaccuaucagaacaagguggucaaggugcagcggcccacaccgaccggcacgguuauggacaucauuucucgcaaagaucagagagggagcggacaagugggcacauacgggcugaauaccuucaccaacauggaggcucagcuuauccggcagauggaaggagagggcguccuguccaaggccgaccucgaaaauccucaucugcccgagaaaaagaucacacaguggcuggagaccaaagggguggaacgccucaagagaauggcgauuagcggcgaugacugcgugguuaagcccaucgaugaccgguuugccaacgcucugcuugcccugaacgauaugggaaaagugcgcaaggacauuccucaauggcagccgucuaaaggcuggcaugauuggcagcagguccccuucuguucccaccauuuccacgagcucaucaugaaggacgggagaaaacuggugguuccuugccggccccaagacgaacuuauuggacgcgcuagaaucagccagggcgccggguggucucugcgggagacagcuugucucggaaaggccuaugcgcagauguggucccugauguacuuucaccgcagagaucugcggcucgccagcaaugcuauuugcucugccgugccuguccauugggugcccacgucccgcaccacauggagcauccacgcccaucaccaauggaugaccacagaagacaugcugaccgucuggaacagaguguggaucgaggauaauccuuggauggaggacaagacgcccguuaccacaugggaaaacgugccguaccuuggcaaacgggaggaucaguggugugggucccugauuggccucaccagcagagcuacaugggcccagaauaucccuaccgcgauucagcaaguccgcucucugaucggaaacgaagaguuccuugacuauaugcccagcaugaagcgguuuagaaaagaggaagaguccgaaggcgcuauuugguga

SEQ ID NO: 20760 - RNA, 9873 nt, Artificial Sequence
  derived and/or modified CDS sequence (opt5) from DENV-3__FJ639758__SS-prME
accagccugugccucaugaugauccugcccgccgcucuugccuuccaccugacgucccgggacggagaaccucggaugauuguggggaagaacgaacgcggaaagucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacgugaucggaguccuggagcagggcaaacggacgcuuaccccucagcccauggagcugaaguacucuuggaaaacaugggggaaggccaagauugugaccgccgaaacacaaaacuccagcuucaucauugauggaccuaauacccccgagugcccgucugcuuccagagcguggaacgugugggaagucgaggacuauggcuuuggcguuuucacaaccaauaucuggcucaaacugcgcgaaguguacacgcagcugugugaccaccggcuuaugagcgccgcugugaaggaugagagagccguccacgccgacaugggguacuggaucgagucccagaaaaacggaucuuggaagcucgaaaaagcuagccugauugaggugaagacaugcaccuggccuaagucccauacccuguggucuaauggcguucucgaaagcgauaugaucauucccaaaucccuggccgggccuaucagccagcacaacuaucgccccggauaccauacacaaaccgcgggcccuuggcaccuugggaagcuggagcucgacuuuaauuauugcgagggaacgacaguggucauuaccgaaaacuguggcacacggggccccucucugagaaccacaaccguguccgggaaacugauccacgaguggugcugucgcagcugcacgcuuccgccucuccgguacaugggagaagauggcuguugguaugggauggagaucagacccauuucugaaaaggaggagaauaugguuaaaucccuggugagcgcuggaucuggcgaagucgacaacuucaccaugggggugcugugccucgccauccuguuugaggaaguuaugcggggaaaguucggcaagaaacauaugauugccggcguguucuuuacauucguccuucugcucagcgggcagaucaccuggcgcgauauggcucacacacugauuaugaucggauccaaugccagcgacagaaugggcaugggggugaccuaccuggcgcuuauugcuacguuuaagauccagcccuuccuggcccucggauuuuuccugcggaaacucacaucuagagagaaccugcuucugggcguggggcucgccauggcuaccacacugcaacugccugaagauaucgagcagauggccaauggaauugcucuuggccugauggcccucaagcugaucacccaguuugagaccuaucagcucuggacagcgcugauuucccuuacguguagcaacaccaucuucacacugaccgucgccuggcgcacagcuacccucauucuggccggcguuucccugcuuccggugugccaaucuagcuccaugcggaaaacggacuggcugcccaugacaguggcugccaugggggucccuccccucccucuguuuaucuucucucucaaggauacccugaagagacgcagcuggccccuuaaugaaggagugauggccguuggccugguguccauccuggcuucuagccuccugagaaacgacgucccuauggcggggccccuuguggccggaggccugcucauugcuuguuacguuaucaccgggacauccgccgaucugaccguggagaaagccgcugacgucacaugggaagaggaagccgagcagacgggagugagccauaaccucaugauuaccgucgacgaugacggcacaaugcggaucaaggaugacgagaccgaaaauauucugacagugcuucugaaaaccgcgcugcucaucguuucuggcaucuuuccguacuccauuccugcuacgcugcuuguguggcacaccuggcagaagcagacacaacgcagcgggguccugugggaugugcccucuccucccgagacccagaaagccgaacucgaggagggaguuuauagaaucaagcagcagggcauuuucgggaaaacacaagugggagucggcgugcagaaggaagggguguuucauaccauguggcacguuacacggggagccguccugacguacaacggcaagcgccucgagccgaauugggcuuccgugaaaaaggaccugaucagcuauggcgggggauggagacuuucugcccaguggcaaaaaggcgaagaggugcaggucauugcgguggaaccugggaagaaccccaaaaauuuccagaccaugccuggaacauuccagaccaccacaggcgagaucggggcuauugcccuggauuuuaagcccggaacguccggcagccccaucaucaaccgggagggcaagguuguggggcuguacggaaauggcgucgugaccaaaaacgggggauauguuuccggcauugcccaaacaaaugcugaaccugacgggccgacccccgagcucgaagaggaaauguucaagaaacgcaaccugacaaucauggaucuucacccuggcagcggaaagaccagaaaauaccugcccgccauugugcgggaggcuaucaagcgcagacuccggacgcugauucucgccccuacaagagucguggcggccgagauggaagaggcucugaagggccuucccauccgcuaucagaccaccgccacaaaaucugaacauaccgggcgggagaucguugaccugaugugccacgcuacauuuaccaugagacugcucagcccugugcgcgucccgaauuacaaccugauuaucauggaugaagcccauuucacggaccccgccuccauugcugcgcggggauacaucucuacaagagugggcaugggggaggccgcugccauuuuuaugaccgccacaccucccggaaccgcugaugccuucccucagagcaaugcgcccauccaggacgaggaacgcgacaucccggagcgguccuggaacucuggcaaugaauggauuacggauuuugcugggaagaccgugugguucgucccuagcaucaaagccggcaacgacauugccaacugucuuagaaagaauggcaaaaagguuauccaacugucccgcaagacauuugauaccgaguaucagaaaacaaagcucaacgacugggauuucguggugaccacagacauuucugagaugggagcuaauuuuaaagccgaucgggucaucgaccccagacggugccugaagcccgugauucugaccgaugggccugaacgcguuauccucgcgggacccaugccugugacggccgcuagcgccgcucagagacggggccgcgucgggagaaacccgcagaaagagaaugaccaauacaucuucacaggacagccccuuaacaaugaugaagaccacgcccauuggaccgaggcuaagaugcugcuggacaacauuaauaccccugaaggcaucauucccgcccucuucgagccugagcgggaaaaguccgcggccaucgauggggaguauagacugaaaggcgaaagccgcaagacauuuguggagcuuaugcggagaggagaccugcccguuuggcucgcucacaaaguggccucugaaggcauuaaguacaccgaucgcaaauggugcuucgacgggcagcggaacaaucagauccuggaggagaacauggaugucgaaaucuggacaaaggagggagagaagaagaagcugagaccgcgcuggcucgacgcucggacguauuccgauccucuugcccugaaagaguuuaaggacuucgccgcuggcagaaaaagcauugcgcuggaucucgugaccgaaaucgggcgcguccccucucaccuggcccauagaacacggaaugcucuugacaaccuggugaugcuccacaccuccgagcauggaggcaaggccuaccgccacgccguugaggaacugccugagacaauggaaacccugcuccuucugggccugaugauucuccugacagggggagcuaugcuuuuucugaucagcggcaaagggauuggaaagaccuccaucggccucaucugugugauugccucuagcgggaugcuguggauggcggagaucccccugcaauggauugccuccgcuaucgugcucgaguucuuuaugaugguccuucugauuccugaacccgagaagcagagaacaccgcaggauaaucaacuggccuauguugugaucggcauucucacccuggcugccaucaucgcggccaacgaaaugggccuucuggagacaaccaaacgggaccucggcaugagcaaggaaccugggguggucucucccacguccuaccuggauguggaccugcaccccgcuagcgccuggacacucuacgcuguugccaccacagugauuaccccuaugcuucgccauaccaucgaaaauucuacagcuaacgucagccuggccgcgauugccaaccaggcugugguccugaugggacucgacaaaggcuggccgaucuccaagauggaucugggggugccccuucuggcccucggaugcuauucucagguuaauccucugacgcugaccgcugccgugcuccuucugauuacacacuacgccaucaucggccccgggcugcaggcgaaagcuaccagagaggcccaaaagcggacagcugccggaauuaugaagaacccuaccgucgacggcaucaugacgauugaucucgaccccgugaucuaugauagcaaauucgagaagcagcugggccagguuaugcuucuggugcucugugccguccagcugcugcucaugagaacauccugggcucuuugcgaggcccugacccuggcgaccgggccuauuacaacccucugggaaggaucuccgggcaaauuuuggaauacaacgaucgccgugagcauggcuaacaucuuccgcggguccuaccuggccggagcuggccuugccuuuagcauuaugaagucuguggggaccggaaaacggggcacaggcucccaaggggagacccugggagaaaaguggaagaaaaagcucaaucagcugagcagaaaagaguucgaccuguauaagaaauccggcaucacagagguugaucgcaccgaagcgaaggaggggcucaaacggggagaaauuacgcaucacgccgucucuagaggcagcgcuaaacuucagugguuuguggagcggaacauggugauccccgaagggcgcgucauugaccugggauguggcagaggcgggugguccuacuauugcgccggacugaagaaaguuaccgaggugcggggcuacacaaaagggggaccuggccaugaggaacccgugccuaugucuaccuacggguggaauaucgucaaacucaugagcggaaaggauguguucuaucugcccccggagaaaugugacacacuucugugcgauauuggcgaauccagcccuucucccaccguugaggagucccgcacaaucagagugcucaagauggucgaacccuggcugaagaacaaucaguucuguaucaaagugcugaacccuuacaugcccaccguuguggagcaccucgaacggcuucaacgcaagcacggcgggaugcuggucagaaauccucugagccggaacucuacgcaugagauguauuggauuuccaauggaacaggcaacaucguggcuagcgugaauauggucucucgccuccugcuuaacagauuuaccaugacccaccggagaccgacaauugaaaaagacguugaucugggggccggaacgcgccaugugaacgcugagcccgagaccccuaauauggacgugaucggcgaacggauuaagagaaucaaagaggaacacaacagcacauggcacuacgacgaugagaaucccuauaagaccugggccuaccauggguccuaugaagucaaggcgacaggaucugccagcuccaugaucaacggcgugguuaaacuccugaccaagccuugggacgugguccccauggugacacagauggcuaugaccgauacgaccccguucggccagcaacgcguuuuuaaagagaagguggacacacggaccccuagaagcaugcccgggacacgccgggucaugggaauuaccgccgaguggcuguggagaacgcucggccgcaauaaaaagccucggcugugcacaagagaagaguucaccaagaaagugcgcacaaacgcugccaugggggccguuuuuaccgaagagaaucagugggauuccgcgaaggcugccguggaagacgaggauuucuggaaacuugucgaccgggagagagaacugcacaagcucggacgcuguggcucuugcguguacaacaugauggggaaaagagagaagaaacugggcgaauuuggaaaggccaagggcagccgggcuaucugguacauguggcuuggggcccgcuaucuggaguucgaggcucucggauuucugaaugaagaucauugguucuccagagagaacucuuacagcggcgucgaaggggagggacugcacaaacucggcuauauucugcgggacaucuccaagauucccgggggcgccauguacgcggaugacacggccggaugggacaccagaaucacagaagaugaccuucauaaugaggagaaaaucacccagcagauggauccugaacaccggcaacuggcuaacgccauuuuuaagcucacauaucagaauaaagugguuaaggugcagcgccccaccccgacaggcaccgucauggacaucauuucuagaaaggaucagcgggggagcggacaagugggcacguacgggcugaacacauucaccaauauggaggcucagcuuauccgccagauggaaggagagggcgugcuguccaaagccgaccucgaaaacccuagacugcccgagaagaaaauuacccaguggcuggagacaaaggggguugaacggcucaaacgcauggcgaucagcggcgaugacugcguggucaagcccaucgaugacagauuugccaacgcucugcuugcccugaaugauaugggaaaggugcggaaagacauuccucaauggcagccgucuaagggcuggcacgauuggcagcagguucccuucuguucccaucacuuccaugagcucaucaugaaagacgggcgcaagcugguggucccuugcagaccccaagacgaacuuauuggacgggcucgcaucagccagggcgccggguggucucugagagagaccgcuugucucggaaaagccuaugcgcagauguggucccugauguacuuucaccggcgcgaucugagacucgccagcaacgcuauuugcucugccgugccuguccacugggugcccacaucccggacgaccuggagcauccaugcccaccaucaauggaugacaaccgaagacaugcugacaguuuggaauagaguguggauugaggauaacccuuggauggaggacaagacccccgucacgaccugggaaaaugugccguaccuuggcaagcgcgaggaucaguggugugggucccugaucggccucacaagccgggcuaccugggcccagaacaucccuacagcgauucagcaaguuagaucucugaucggaaaugaagaguuccuugacuauaugcccagcaugaaacgcuuucggaaggaggaagaguccgaaggcgcuauuugguga

SEQ ID NO: 20761 - RNA, 9873 nt, Artificial Sequence
  derived and/or modified CDS sequence (opt5) from DENV-3__FJ639759__SS-prME
acaagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggagaugugcgacgauacagugaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacacgaucggagugcuggagcagggcaaacggacccuuacaccucagcccauggagcugaaguacucuuggaaaaccugggggaaggccaagauugucacagccgaaacccaaaacuccagcuucaucauugauggaccuaauacacccgagugcccgucugcuuccagagcguggaacgugugggaaguggaggacuauggcuuuggcgucuucaccacgaauaucuggcucaaacugcgcgaaguuuacacacagcugugugaccaccggcuuaugagcgccgcugugaaggaugagagagccgugcacgccgacaugggguacuggaucgagucccagaaaaacggaucuuggaagcucgaaaaagcuagccugauugaggucaagaccugcaccuggccuaagucccauacacuguggucuaauggcgugcucgaaagcgauaugaucauucccaaaucccuggccgggccuaucagccagcacaacuaucgccccggauaccauacccaaacggcgggcccuuggcaccuugggaagcuggagcucgacuuuaauuauugcgagggaacaaccguugugauuacagaaaacuguggcacccggggccccucucugagaacaaccacggucuccgggaaacugauccacgaguggugcugucgcagcugcacccuuccgccucuccgguacaugggagaagauggcuguugguaugggauggagaucagacccauuucugaaaaggaggagaauauggugaaaucccugguuagcgcuggaucuggcgaaguggacaacuucacaauggggguccugugccucgccauccuguuugaggaagugaugcggggaaaguucggcaagaaacauaugauugccggcguucuuuucaccuuugugcugcuccugagcgggcagaucacauggcgcgauauggcucacacccugauuaugaucggauccaaugccagcgacagaaugggcaugggggucacguaccuugcgcugauugcuacauucaagauccagcccuuucucgcccugggauucuuucuccggaaacugaccucuagagagaaccuucugcucggcguggggcuggccauggcuacaacccugcaacuuccugaagauaucgagcagauggccaauggaauugcucugggccucauggcccugaagcucaucacccaguucgagacauaucagcuguggacggcgcuuauuucccugaccuguagcaacacaaucuuuacccucacaguggccuggcgcaccgcuacgcugauucuggccggcgucucccuucugccgguuugccaaucuagcuccaugcggaaaacagacuggauccccaugaccguggcugccaugggggugccuccccucccucuguucaucuuuucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuacagggaccuccgccgaucugacaguugagaaagccgcugacgugacgugggaagaggaagccgagcagaccggagucagccauaaccucaugaucacaguggacgaugacggcaccaugcggauuaaggaugacgagacagaaaauauccugaccguccuucugaaaacggcgcugcucaucgugucuggcauuuucccguacuccaucccugcuacccugcuuguuuggcacacauggcagaagcagacccaacgcagcggggugcugugggauguccccucuccucccgagacacagaaagccgaacucgaggagggaguguauagaauuaagcagcagggcaucuuugggaaaacccaaguuggagugggcguccagaaggaagggguguuccauacaauguggcacgugacgcggggagccguucugaccuacaacggcaagcgccucgagccgaauugggcuuccgucaaaaaggaccugauuagcuauggcgggggauggagacuuucugcccaguggcaaaaaggcgaagagguccaggugaucgcggucgaaccugggaagaaccccaaaaauuuucagacaaugccuggaaccuuccagaccacaacgggcgagauuggggcuaucgcccuggauuucaagcccggaaccuccggcagccccaucauuaaccgggagggcaagaucguggggcuguacggaaauggcguugugaccaagaacgggggauaugucuccggcauugcccaaaccaaugcugaaccugacgggccgacacccgagcucgaagaggaaauguuuaagaaacgcaaccugaccaucauggaucuucacccuggcagcggaaagacgagaaaauaccugcccgccauugugcgggaggcuaucaagcgcagacuccggacacugauccucgccccuaccagaguuguggcggccgagauggaagaggcucugaagggccuucccauucgcuaucagaccucugccacaaaaagcgaacauaccgggcgggagaucgucgaccugaugugccacgcuacauucaccaugagacugcucuccccugugcgcguuccgaauuacaaccugauuaucauggaugaagcccauuuuacggaccccgccucuauugcugcgcggggauacaucagcacaagagugggcaugggggaggccgcugccaucuucaugaccgccacaccucccggaaccgcugaugccuuuccucaguccaaugcgcccauucaggacgaggaacgcgacaucccggagcggucuuggaacagcggcaaugaauggauuacggauuucgcugggaagaccgucugguuugugccuuccaucaaagccggcaacgacauugccaacugucuuagaaagaauggcaaaaaggugauccaacugucucgcaagacauucgauaccgaguaucagaaaacaaagcucaacgacugggauuuugucguuaccacagacauuagcgagaugggagcuaauuucaaagccgaucgggugaucgaccccagacggugccugaagcccgugauccugaccgaugggccugaacgcgucauucucgcgggacccaugccugugacggccgcuuccgccgcucagagacggggccgcguugggagaaacccgcagaaagagaaugaccaauacaucuuuacaggacagccccuuaacaaugaugaagaccacgcccauuggaccgaggcuaagaugcugcuggacaacauuaauaccccugaaggcaucauucccgcccucuucgagccugagcgggaaaagagcgcggccaucgauggggaguauagacugaaaggcgaaucucgcaagacauucguggagcuuaugcggagaggagaccugcccgucuggcucgcucacaaaguggccuccgaaggcaucaaguacaccgaucgcaaauggugcuuugacgggcagcggaacaaucagauucuggaggagaacauggauguugaaaucuggacaaaggagggagagaagaagaagcugagaccgcgcuggcucgacgcucggacguauagcgauccucuugcccugaaagaguucaaggacuuugccgcuggcagaaaaucuauugcgcuggaucucgugaccgaaaucgggcgcguccccacacaccuggcccauagaacccggaaugcucuugacaaccuggugaugcuccacacauccgagcauggaggcaaggccuaccgccacgccgucgaggaacugccugagaccauggaaacgcugcuccuucugggccugaugauucuccugaccgggggagcuaugcuuuuccugaucagcggcaaagggaucggaaagacauccauuggccucaucugugugauugccucuagcgggaugcuguggauggcggagaucccccugcaauggauugccuccgcuaucguucucgaguuuuucaugauggugcuucugauuccugaacccgagaagcagagaaccccgcaggauaaucaacuggccuauguggucaucggaauccucacacuggcugccauuaucgcggccaacgaaaugggccuucuggagaccacgaaacgggaccucggcaugagcaaggaaccugggguugugucucccacauccuaccuggauguggaccugcaccccgcuagcgccuggacccucuacgcugucgccacaaccgugauuaccccuaugcuucgccauacaaucgaaaauucuacggcuaacguuagccuggccgcgauugccaaccaggcugugguccugaugggacucgacaaaggcuggccgaucuccaagauggaucugggggugccccuucuggcccucggaugcuauucucaggucaauccucugacccugacagcugccgugcuccuucugaucacccacuacgccauuaucggccccgggcugcaggcgaaagcuacaagagaggcccaaaagcggaccgcugccggaauuaugaagaacccuacgguugacggcaucaugacaauugaucucgaccccgugaucuaugauagcaaauuugaaaagcagcugggccaggucaugcuucuggugcucugugccguucagcugcugcucaugagaaccuccugggcucuuugcgaggcccugacccuggcgacagggccuaucaccacacucugggaaggaucuccgggcaaauucuggaauacgaccauugccgugagcauggcuaacaucuuucgcggguccuaccuggccggagcuggccuugccuucagcauuaugaagucugucgggacaggaaaacggggcaccggcucccaaggggagacacugggagaaaaguggaagaaaaagcucaaucagcugagcagaaaagaguuugaccuguauaagaaauccggcaucaccgagguggaucgcacggaagcgaaggaggggcucaaacggggagaaauuacccaucacgccgugucuagaggcagcgcuaaacuucagugguucguugagcggaacauggucauccccgaagggcgcgugauugaccugggauguggcagaggcgggugguccuacuauugcgccggacugaagaaagugacagagguccggggcuacaccaaagggggaccuggccaugaggaacccguuccuaugucuacauacggguggaauaucgugaaacucaugagcggaaaggauguguuuuaucugcccccggagaaaugugacacccuucugugcgauaucggcgaauccagcccuucucccacagucgaggagucccgcaccauuagagugcucaagaugguugaacccuggcugaagaacaaucaguucuguaucaaagugcugaacccuuacaugcccacggucauugagcaccucgaacggcuucaacgcaagcacggcgggaugcuggugagaaauccucugagccggaacucuacacaugagauguauuggaucuccaauggaaccggcaacauuguugcuagcgugaauauggucucucgccuccugcuuaacagauucaccaugacacaccggagaccgacgaucgaaaaagacguggaucugggggccggaacccgccaugugaacgcugagcccgagacaccuaauauggacgucaucggcgaacggauuaagagaaucaaagaggaacacaacagcaccuggcacuacgacgaugagaaucccuauaagacaugggccuaccauggguccuaugaaguuaaggcgaccggaucugccagcuccaugauuaacggcguggugaaacuccugacaaagccuugggacgucgugcccaugguuacccagauggcuaugacggauaccacaccguuuggccagcaacgcguguucaaagagaaggucgacacccggacaccuagaagcaugcccgggacccgccgggugaugggaaucacggccgaguggcuguggagaacacucggccgcaauaaaaagccucggcugugcaccagagaagaguuuacaaagaaaguucgcaccaacgcugccaugggggccguguucacggaagagaaucagugggauuccgcgaaggcugccgucgaagacgaggauuuuuggaaacuuguggaccgggagagagaacugcacaagcucggaaaauguggcucuugcguuuacaacaugauggggaagcgcgagaaaaagcugggcgaguucggaaaggccaaaggcagcagagcuauuugguacauguggcuuggggcccgguaucuggaguuugaggcucucggauuccugaaugaagaucauugguuuucccgcgagaacucuuacagcggcguggaaggggagggacugcacaagcucggcuauauccugagagacaucuccaaaauucccgggggcgccauguacgcggaugacaccgccggaugggacacacggaucaccgaagaugaccuucauaaugaggagaagauuacacagcagauggauccugaacacagacaacuggcuaacgccaucuucaaacucaccuaucagaauaaggucgugaagguccagcggcccacaccgaccggcacggugauggacauuaucucucgcaaagaucagagagggagcggacaaguuggcacauacgggcugaacaccuuuaccaauauggaggcucagcuuauccggcagauggaaggagagggcgugcuguccaaggccgaccucgaaaacccucaucugcccgagaaaaagauuacacaguggcuggagaccaaaggggucgaacgccucaagagaauggcgaucagcggcgaugacugcguggugaagcccauugaugaccgguucgccaacgcucugcuugcccugaaugauaugggaaaaguucgcaaggacaucccucaauggcagccgucuaaaggcuggcaugauuggcaacaggugcccuuuuguucccaccauuuccacgagcucauuaugaaggacgggagaaaacuggucgugccuugccggccccaagacgaacuuaucggacgcgcuagaauuagccagggcgccggguggucucugcgggagacagcuugucucggaaaggccuaugcgcagauguggucccugauguacuuccaccgcagagaucugcggcucgccagcaacgcuaucugcucugccguuccugugcauuggguccccacgucccgcaccacauggagcauccacgcccaucaccaauggaugaccacagaagacaugcugaccguguggaauagagucuggauugaggauaacccuuggauggaggacaagacgcccgugaccacaugggaaaauguuccguaccuuggcaaacgggaggaucaguggugugggucccugaucggccucaccagcagagcuacaugggcccagaacauuccuaccgcgauccagcaagugcgcucucugauuggaaaugaagaguuucuugacuauaugcccagcaugaagcgguucagaaaagaggaagaguccgaaggcgcuaucugguga

SEQ ID NO: 20762 - RNA, 9873 nt, Artificial Sequence
  derived and/or modified CDS sequence (opt5) from DENV-3__FJ639761__SS-prME
accagccugugccucaugaugauccugcccgccgcucuugccuuccaccugacaucccgggacggcgaaccucggaugauuguggggaagaacgaacgcggaaagucucuccuguuuaagacggcgagcggcaucaauauguguacccuuauugcuauggaucugggggaaaugugcgacgauacagugaccuacaaauguccgcacaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucugcagcccauugagggcaaaguugugcaguaugagaaucucaaguacacagucaucaucaccgugcauacaggggaccagcaccaaguuggaaacgaaacgcagggcgugaccgcugagauuacaccucaggccucuaccacagaagcuauccugcccgaguauggcacccuggggcucgaaugcuccccucgcacgggacuggacuucaaugagaugauucuucugaccaugaaaaacaaggccuggaugguccauagacaaugguuuuucgaucucccccugccguggacaagcggcgccaccacagagaccccuacguggaaucggaaagaacuucuggugacauuuaagaacgcucacgcgaaaaagcaggaggucgugguucucgggucucaggaaggagccaugcacaccgcucugacaggcgccaccgagauccaaaauuccgggggcaccagcauuuucgccggacaucugaagugucgccucaaaauggacaagcuggaacuuaaaggcaugucuuacgcuaugugcacaaacacguuugugcugaagaaagaggucuccgagacccaacacgggacaauccucaucaagguggaauacaagggagaggauguucccuguaaaauuccuuucagcaccgaagacggccaggggaaggcccauaacggaagacugaucacagcgaaucccguggucaccaaaaaggaggagcccgugaacauugaagcugagccuccguucggcgaauccaauaucgugauugggaucggcgauaacgcccugaaaaucaauugguauaagaagggaucuagcauuggcaaaauguuugaggccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggaacugaagugcggcagcgggauuuucgugacaaacgagguucauacguggaccgagcaauacaaauuucaggccgauucccccaagcggcuggcgacagccaucgcuggcgccugggaaaauggaguguguggcauuagaagcaccacacgcauggagaaccuucucuggaaacagaucgcuaaugaacugaacuauauccugugggagaauaacauuaagcucaccgucgugguuggggacaucauuggagugcuggaacagggcaaacggacgcuuaccccucaacccauggagcugaaguacucuuggaaaacaugggggaaggccaagaucgucaccgccgagacacagaacuccagcuucauuaucgauggaccuaauacccccgaaugcccgucugcuuccagagcguggaacgugugggagguggaagacuauggcuuuggcgucuucacaaccaauaucuggcucaaacugcgcgagguuuacacgcagcugugugaccaccggcuuaugagcgccgcugugaaggaugaaagagccgugcacgccgacaugggguacuggauugagucccagaaaaacggaucuuggaagcucgagaaagcuagccugaucgaagucaagacaugcaccuggccuaagucccauacccuguggucuaauggcgugcucgagagcgauaugauuauccccaaaucccuggccgggccuauuagccaacacaacuaucgccccggauaccauacacagaccgcgggcccuuggcaccuugggaagcuggaacucgacuuuaauuauugcgagggaacgacaguugugaucaccgagaacuguggcacacggggccccucucugagaaccacaaccgucuccgggaaacugauccacgaauggugcugucgcagcugcacgcuuccgccucuccgguacaugggagaggauggcuguugguaugggauggaaauuagacccaucucugagaaggaagagaauauggugaaaucccugguuagcgcuggaucuggcgagguggacaacuucaccauggggguccugugccucgccauucuguuugaagaggugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccaacccuuccuggcccucggauuuuuccugcggaaacucacaucuagagaaaaccugcuucugggcguggggcucgccauggcuaccacacugcagcugccugaggauauugaacagauggccaauggaaucgcucuuggccugauggcccucaagcugauuacccaguuugagaccuaucaacucuggacagcgcugaucucccuuacguguagcaacaccauuuucacacugaccguggccuggcgcacagcuacccucauccuggccggcgucucccugcuuccgguuugccagucuagcuccaugcggaaaacggacuggcugcccaugacaguggcugccaugggggugccuccccucccucuguuuaucuucucucucaaggauacccugaagagacgcagcuggccccuuaaugagggagucauggccgugggccugguuuccauucuggcuucuagccuccugagaaacgacgugccuauggcggggccccuugucgccggaggccugcucaucgcuuguuacgugauuaccgggacauccgccgaucugaccguugaaaaagccgcugacgugacaugggaggaagaggccgaacagacgggagucagccauaaccucaugaucaccguggacgaugacggcacaaugcggauuaaggaugacgagaccgagaauauccugacaguccuucugaaaaccgcgcugcucaucgugucuggcauuuuuccguacuccaucccugcuacgcugcuuguuuggcacaccuggcagaagcaaacacagcgcagcggggugcugugggauguccccucuccucccgaaacccagaaagccgagcucgaagagggaguguauagaauuaagcagcaaggcaucuucgggaaaacacagguuggagugggcguccagaaggaggggguguuucauaccauguggcacgugacacggggagccguucugacguacaacggcaagcgccucgaaccgaauugggcuuccgucaaaaaggaccugauuagcuauggcgggggauggagacuuucugcccaauggcagaaaggcgaggaaguccaggugaucgcggucgagccugggaagaaccccaaaaauuuccagaccaugccuggaacauuccaaaccaccacaggcgaaauuggggcuaucgcccuggauuuuaagcccggaacguccggcagccccaucauuaaccgggagggcaaggugguugggcuguacggaaauggcguggucaccaaaaacgggggauauguguccggcaucgcccagacaaaugcugagccugacgggccgacccccgaacucgaggaagagauguucaagaaacgcaaccugacaauuauggaucuucacccuggcagcggaaagaccagaaaauaccugcccgccaucguucgggaagcuauuaagcgcagacuccggacgcugauccucgccccuacaagaguggucgcggccgagauggaggaagcucugaagggccuucccauccgcuaucagaccaccgccacaaaaucugagcauaccgggcgggaaauuguggaccugaugugccacgcuacauuuaccaugagacugcucagcccuguucgcgugccgaauuacaaccugaucauuauggaugaggcccauuucacggaccccgccuccaucgcugcgcggggauacauuucuacaagagucggcaugggggaagccgcugccaucuuuaugaccgccacaccucccggaaccgcugaugccuucccucagagcaaugcgcccauccaagacgaggagcgcgacauuccggaacgguccuggaacucuggcaaugaguggaucacggauuuugcugggaagaccgugugguucgugccuagcauuaaagccggcaacgacaucgccaacugucuuagaaagaauggcaaaaaggucauucagcugucccgcaagacauuugauaccgaauaucagaaaacaaagcucaacgacugggauuucguugugaccacagacaucucugagaugggagcuaauuuuaaagccgaucgggugauugaccccagacggugccugaagcccgucauccugaccgaugggccugagcgcgugauccucgcgggacccaugccuguuacggccgcuagcgccgcucagagacggggccgcguggggagaaacccgcaaaaagaaaaugaccaguacauuuucacaggacagccccuuaacaaugaugaggaccacgcccauuggaccgaagcuaagaugcugcuggacaacaucaauaccccugagggcauuauccccgcccucuucgaaccugagcgggagaaguccgcggccauugauggggaauauagacugaaaggcgagagccgcaagacauuugucgaacuuaugcggagaggagaccugcccguguggcucgcucacaaaguugccucugagggcaucaaguacaccgaucgcaaauggugcuucgacgggcagcggaacaaucaaauccuggaagagaacauggauguggagauuuggacaaaggaaggagagaaaaagaagcugagaccgcgcuggcucgacgcucggacguauuccgauccucuugcccugaaagaauuuaaggacuucgccgcuggcagaaaaagcaucgcgcuggaucucgucaccgagauugggcgcgugcccacacaccuggcccauagaacccggaaugcucuugacaaccuggucaugcuccacacaucugaacauggaggcaaggccuaccgccacgccguggaggagcugccugaaaccauggagacgcugcuccuucugggccugaugauccuccugaccgggggaguuaugcuuuuucugauuuccggcaaagggaucggaaagacaagcaucggccucauuugugugaucgcuuccucugggaugcuguggauggccgaaauuccccugcaguggaucgcgagcgccauugugcucgaguucuuuaugaugguccuucugaucccugagcccgaaaagcagagaaccccgcaagauaaucagcuggcuuauguugugauuggaauccucacacuggccgcuaucauugccgcgaacgagaugggccuucuggaaaccacgaaacgggaccucggcauguccaaggagccugggguggucagccccacaucuuaccuggauguggaccugcaccccgccuccgcuuggacccucuacgccguugcuacaaccgugaucaccccuaugcuucgccauacaauugaaaauagcacggccaacgucucucuggcugccaucgcgaaccaggccgugguccugaugggacucgacaaaggcuggccgauuagcaagauggaucugggggugccccuucuggcucucggaugcuauucccagguuaauccucugacccugacagccgcugugcuccuucugaucacccacuacgccaucauuggccccgggcugcaagccaaagcgacaagagaggcucagaagcggaccgccgcuggaaucaugaagaacccuacggucgacggcauuaugacaaucgaucucgaccccgugauuuaugauucuaaauucgagaagcagcugggccagguuaugcuucuggugcucugugccguccaacugcugcucaugagaaccagcugggcccuuugcgaagcucugacccuggccacagggccuaucaccacacucugggagggauccccgggcaaauuuuggaauacgaccaucgcggugucuauggccaacauuuuccgcgggagcuaccuggcuggagccggccuugcuuuuuccaucaugaaaagcguggggacaggaaaacggggcaccggccugcagggggaaacacucggagagaaguggaagaaaaagcugaaucagcugucuagaaaagaguucgaccucuauaagaaauccggcauuaccgagguugaucgcacggaggccaaggaagggcuuaaacggggagagaucacccaucacgcggucagcagaggcuccgccaagcugcagugguuuguggaacggaacauggugauucccgaggggcgcgucaucgaccugggauguggcagaggcggguggucuuacuauugcgcuggacucaagaaaguuacagaagugcggggcuacaccaaagggggaccuggccaugaggagcccgugccuaugagcacauacggguggaauauugucaaacugauguccggaaaggauguguucuaucuucccccggaaaaaugugacacccugcucugcgauaucggcgagucuagcccuucccccacaguugaagagagccgcaccaucagagugcugaagauggucgagcccuggcugaagaacaaucaauucuguauuaaagugcucaacccuuacaugcccacgguuaucgaacaccuugagcggcugcagcgcaagcacggcgggaugcuggugagaaauccucucucucggaacuccacacaugaaauguauuggauuagcaauggaaccggcaacaucgucgccucugugaauauggugucccgccugcuucugaacagauuuaccaugacacaccggagaccgacgauugagaaagacgucgaucucggggcuggaacccgccauguuaacgccgaacccgagacaccuaauauggacgugaucggcgagcggaucaagagaauuaaagaagaacacaacagcaccuggcacuacgacgaugaaaaucccuauaagacaugggcuuaccaugggucuuaugaggugaaggccaccggaagcgcguccucuaugaucaacggcgucgugaaacugcugacaaagccuugggacguugugcccauggucacccagauggccaugacggauaccacaccguucggccaacagcgcguguuuaaagaaaagguugacacccggacaccuagaagcaugcccgggacccgccgggugaugggaauuacggcugaguggcucuggagaacacugggccgcaauaaaaagccucggcuuugcaccagagaggaguucacaaagaaaguccgcaccaacgccgcuaugggggccguguuuacggaggaaaaucagugggauuccgccaaggcggcuguugaggacgaagauuucuggaaacugguggaccgggagagagagcuccacaagcugggaaaauguggcagcugcgucuacaacaugauggggaagcgcgagaagaaacuuggcgaguuuggaaaggccaaaggcuccagagccaucugguacauguggcugggggcucgguaucucgaguucgaggcccugggauuucugaaugaggaucauugguucucucgcgaaaacagcuacuccggcguggagggggaaggacuccacaagcugggcuauauucuuagagacaucucuaaaauccccgggggcgcuauguacgccgaugacaccgcgggaugggacacacggauuaccgaggaugaccugcauaaugaagagaagaucacacagcaaauggauccugagcacagacagcucgccaacgcuauuuuuaaacugaccuaucagaauaaggucgugaagguucagcggcccacaccgaccggcacggugauggacaucauuagccgcaaagaucaaagaggguccggacaggucggcacauacgggcuuaacaccuucaccaauauggaagcccagcugauccggcagauggagggagaaggcgugcucucuaaggcugaccuggagaacccucaucugcccgagaagaagaucacacaauggcucgagaccaaagggguggagcgccugaagagaauggccauuagcggcgaugacugcguugugaagcccaucgaugaccgguuugcgaacgcccuucuggcucucaaugauaugggaaaaguccgcaaggacauuccucaguggcagccguccaaaggcuggcaugauuggcagcaagugcccuucuguagccaccauuuccacgaacugaucaugaaggacgggagaaaacuuguugugccuugccggccccaggacgagcugauuggacgcgccagaaucucucagggcgcuggguggucccuccgggaaacagccugucugggaaaggcuuaugcccaaauguggagccugauguacuuucaccgcagagaucuccggcuggcgucuaacgccauuugcuccgcugucccugugcauuggguccccacgagccgcaccacauggucuauccacgcccaucaccaguggaugaccacagaggacaugcuuaccguguggaauagaguuuggaucgaagauaacccuuggauggaggacaagacgcccgugaccacaugggagaaugucccguaccugggcaaacgggaagaucaguggugugggucccucauuggccugaccagcagagccacaugggcucagaacaucccuaccgccauucaacaggugcgcucccuuaucggaaaugaggaguuccuggacuauaugcccagcaugaagcgguuuagaaaagaggaggaaucugagggcgcgauuugguga

SEQ ID NO: 20763 - RNA, 9873 nt, Artificial Sequence
  derived and/or modified CDS sequence (opt5) from DENV-3__FJ639762__SS-prME
accagccugugccucaugaugauccugcccgccgcucuugccuuccaccugacaucccgggacggcgagccucggaugauuguggggaagaacgaacgcggaaagucucuccuguuuaagacggcgagcggcaucaauauguguacccuuauugcuauggaucugggggaaaugugcgacgauacagugaccuacaaguguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagauugaguacaagggagaagaugugcccuguaaaaucccuuucagcaccgaggacggccaagggaaggcccauaacggaagacugauuacagcgaaucccguugugaccaaaaaggaggaacccgucaacaucgaggcugaaccuccguucggcgaguccaauauugugaucgggaucggcgauaacgcccugaaaauuaauugguauaagaagggaucuagcaucggcaaaauguuugaagccacggcuagaggggccagacgcauggcuauucuuggagacacagccugggauuucggcuccgucgggggaguucucaacagccugggcaagaugguccaccagaucuuugggucugcguacaccgcccuguucuccggcgugagcugggugaugaaaauuggaaucggcguccuccugaccuggauugggcuuaauucuaagaacacaagcauguccuuuucuugcaucgcuaucggaauuaucacccuguaucucggcgccgugguucaggcugacauggggugugugauuaauuggaaaggaaaggagcugaagugcggcagcgggaucuucgucacaaacgaggugcauacguggaccgaacaguacaaauuucaagccgauucccccaagcggcuggcgacagccauugcuggcgccugggagaauggaguuuguggcaucagaagcaccacacgcauggaaaaccuucucuggaaacagaucgcuaaugagcugaacuauauucugugggaaaauaacaucaagcucaccguggucgugggggacauuaucggaguucuggagcagggcaaacggacgcuuaccccucagcccauggagcugaaguacucuuggaaaacaugggggaaggccaagauugugaccgccgaaacacaaaacuccagcuucaucaucgauggaccuaauacccccgagugcccgucugcuuccagagcguggaacgucugggaaguggaggacuauggcuuuggcguguucacaaccaauauuuggcucaaacugcgcgaagucuacacgcagcugugugaccaccggcuuaugagcgccgcuguuaaggaugagagagccgugcacgccgacaugggguacuggaucgagucccagaaaaacggaucuuggaagcucgaaaaagcuagccugauugaggugaagacaugcaccuggccuaagucccauacccuguggucuaauggcguccucgaaagcgauaugaucauucccaaaucccuggccgggccuaucagccagcacaacuaucgccccggauaccauacacaaaccgcgggcccuuggcaccuugggaagcuggagcucgacuuuaauuauugcgagggaacgacagugguuaucaccgaaaacuguggcacacggggccccucucugagaaccacaaccguguccgggaaacugauucacgaguggugcugucgcagcugcacgcuuccgccucuccgguacaugggagaagauggcuguugguaugggauggagaucagacccauuucugaaaaggaggagaauauggucaaaucccuggugagcgcuggaucuggcgaaguugacaacuucaccaugggggugcugugccucgccauccuguuugaggaagucaugcggggaaaguucggcaagaaacauaugauugccggcaucuucuuuacauucgugcuucugcucagcgggcagauuaccuggcgcgauauggcucacacacugaucaugaucggauccaaugccagcgacagaaugggcauggggguuaccuaccuggcgcuuauugcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccaucuucacacugaccgucgccuggcgcacagcuacccucauucuggccggcgugucccugcuuccggugugccaaucuagcuccaugcggaaaacggacuggcugcccaugacagucgcugccauggggguuccuccccucccucuguuuaucuucucucucaaggauacccugaagagacgcagcuggccccuuaaugaaggagugauggccgugggccuggucuccauucuggcuucuagccuccugagaaacgacgugccuauggcggggccccuuguugccggaggccugcucaucgcuuguuacgugauuaccgggacauccgccgaucugaccgucgagaaagccgcugacgugacaugggaagaggaagccgagcagacgggaguuagccauaaccucaugaucaccguggacgaugacggcacaaugcggaucaaggaugacgagaccgaaaauauucugacaguccuucugaaaaccgcgcugcucaucgugucuggcauuuuuccguacuccaucccugcuacgcugcuugucuggcacaccuggcagaagcagacacaacgcagcggggugcugugggauguucccucuccucccgagacccagaaagccgaacucgaggagggaguguauagaauuaagcagcagggcaucuucgggaaaacacaagucggagugggcguucagaaggaagggguguuucauaccauguggcacgucacacggggagccgugcugacguacaacggcaagcgccucgagccgaauugggcuuccgugaaaaaggaccugauuagcuauggcgggggauggagacuuucugcccaguggcaaaaaggcgaagagguucaggucaucgcgguggaaccugggaagaaccccaaaaauuuccagaccaugccuggaacauuccagaccaccacaggcgagaucggggcuauugcccuggauuuuaagcccggaacguccggcagccccaucauuaaccgggagggcaagaucguggggcuguacggaaauggcgucgugaccaaaaacgggggauauguuuccggcauugcccaaacaaaugcugaaccugacgggccgacccccgagcucgaagaggaaauguucaagaaacgcaaccugacaaucauggaucuucacccuggcagcggaaagaccagaaaauaccugcccgccaucgugcgggaggcuauuaagcgcagacuccggacgcugauccucgccccuacaagagucguggcggccgagauggaagaggcucugaagggccuucccauucgcuaucagaccaccgccacaaaaucugaacauaccgggcgggagaucguugaccugaugugccacgcuacauuuaccaugagacugcucagcccugugcgcgucccgaauuacaaccugauuaucauggaugaagcccauuucacggaccccgccuccaucgcugcgcggggauacauuucuacaagagugggcaugggggaggccgcugccaucuuuaugaccgccacaccucccggaaccgcugaugccuucccucagagcaaugcgcccauucaggacgaggaacgcgacaucccggagcgguccuggaacucuggcaaugaauggauuacggauuuugcugggaagaccguuugguucgugccuagcaucaaagccggcaacgacauugccaacugucuuagaaagaauggcaaaaaggucauccaacugucccgcaagacauuugauaccgaguaucagaaaacaaagcucaacgacugggauuucguggugaccacagacaucucugagaugggagcuaauuuuaaagccgaucgggucauugaccccagacggugccugaagcccguuauccugaccgaugggccugaacgcgugauucucgcgggacccaugccugugacggccgcuagcgccgcucagagacggggccgcgucgggagaaacccgcagaaagagaaugaccaauacaucuucacaggacagccccuuaacaaugaugaagaccacgcccauuggaccgaggcuaagaugcugcuggacaacauuaauaccccugaaggcaucauccccgcccucuucgagccugagcgggaaaaguccgcggccauugauggggaguauagacugaaaggcgaaagccgcaagacauuuguggagcuuaugcggagaggagaccugcccguuuggcucgcucacaaaguggccucugaaggcaucaaguacaccgaucgcaaauggugcuucgacgggcagcggaacaaucagauucuggaggagaacauggaugucgaaaucuggacaaaggagggagagaagaagaagcugagaccgcgcuggcucgacgcucggacguauuccgauccucuugcccugaaagaguuuaaggacuucgccgcuggcagaaaaagcauugcgcuggaucucgugaccgaaaucgggcgcguucccacacaccuggcccauagaacccggaaugcucuugacaaccuggugaugcuccacacaucugagcauggaggcaaggccuaccgccacgccgucgaggaacugccugagaccauggaaacgcugcuccuucugggccugaugauccuccugaccgggggagcuaugcuuuuucugauuuccggcaaagggaucggaaagacaagcauuggccucaucugugugauugccuccucugggaugcuguggauggcggagaucccccugcaauggauugccagcgcuaucguccucgaguucuuuaugauggugcuucugaucccugaacccgagaagcagagaaccccgcaggauaaucaacuggccuauguugugauuggaauccucacacuggcugccauuaucgcggccaacgaaaugggccuucuggagaccacgaaacgggaccucggcauguccaaggaaccugggguggucagccccacaucuuaccuggauguugaccugcaccccgcuuccgccuggacccucuacgcuguggccacaaccgugauuaccccuaugcuucgccauacaaucgagaauagcacggcuaacgucucucuggccgcgaucgccaaccaggcugugguucugaugggacucgacaaaggcuggccgauuagcaagauggaucugggggugccccuucuggcccucggaugcuauucccaggucaauccucugacccugacagcugccgugcuccuucugaucacccacuacgccauuaucggccccgggcugcaggcgaaagcuacaagagaggcccaaaagcggaccgcugccggaauuaugaagaacccuacggucgacggcaucaugacaaucgaucucgaccccgugauuuaugauucuaaauucgaaaagcagcugggccagguuaugcuucuggugcucugugccguccagcugcugcucaugagaaccagcugggcucuuugcgaggcccugacccuggcgacagggccuaucaccacacucugggaaggauccccgggcaaauuuuggaauacgaccauugccgugucuauggcuaacaucuuccgcgggagcuaccuggccggagcuggccuugccuuuuccauuaugaaaagcguugggacaggaaaacggggcaccggcucucaaggggagacacugggagaaaaguggaagaaaaagcucaaucagcuguccagaaaagaguucgaccuguauaagaaaagcggcaucaccgagguggaucgcacggaagcgaaggaggggcucaaacggggagaaauuacccaucacgccgucuccagaggcucugcuaaacuucagugguuuguggagcggaacauggugauccccgaagggcgcguuaucgaccugggauguggcagaggcggguggagcuacuauugcgccggacugaagaaagucacagaggugcggggcuacaccaaagggggaccuggccaugaggaacccgugccuauguccacauacggguggaauauugucaaacucaugucuggaaaggauguuuucuaucugcccccggagaaaugugacacccuucugugcgauaucggcgaaagcuccccuagccccacaguggaggagucucgcaccauuagagugcucaagauggucgaacccuggcugaagaacaaucaguucuguaucaaagugcugaacccuuacaugcccacgguuauugagcaccucgaacggcuucaacgcaagcacggcgggaugcuggugagaaauccucugucccggaacagcacacaugagauguauuggaucucuaauggaaccggcaacaucgucgcuuccgugaauaugguuagccgccuccugcuuaacagauuuaccaugacacaccggagaccgacgauugaaaaagacguggaucugggggccggaacccgccaugucaacgcugagcccgagacaccuaauauggacgugaucggcgaacggauuaagagaaucaaagaggaacacaacucuaccuggcacuacgacgaugagaaucccuauaagacaugggccuaccaugggagcuaugaagugaaggcgaccggauccgccucuagcaugauuaacggcgucguuaaacuccugacaaagccuugggacguggugcccauggucacccagauggcuaugacggauaccacaccguucggccagcaacgcguguuuaaagagaagguugacacccggacaccuagauccaugcccgggacccgccgggugaugggaaucacggccgaguggcuguggagaacacucggccgcaauaaaaagccucggcugugcaccagagaagaguucacaaagaaaguccgcaccaacgcugccaugggggccguguuuacggaagagaaucagugggauagcgcgaaggcugccguugaagacgaggauuucuggaaacuuguggaccgggagagagaacugcacaagcucggaaaauguggcuccugcgucuacaacaugauggggaagcgcgagaaaaagcugggcgaauuuggaaaggccaaaggcucuagagcuaucugguacauguggcuuggggcccgguaucuggaguucgaggcucucggauuucugaaugaagaucauugguucagccgcgagaacuccuacucuggcguggaaggggagggacugcacaagcucggcuauauucugagagacaucagcaaaauucccgggggcgccauguacgcggaugacaccgccggaugggacacacggaucaccgaagaugaccuucauaaugaggagaagauuacacagcagauggauccugaacacagacaacuggcuaacgccaucuuuaaacucaccuaucagaauaagguugugaagguccagcggcccacaccgaccggcacggugauggacaucauuucccgcaaagaucagagagggucuggacaagucggcacauacgggcugaacaccuucaccaauauggaggcucagcuuauccggcagauggaaggagagggcgugcugagcaaggccgaccucgaaaacccucaucugcccgagaaaaagauuacacaguggcuggagaccaaagggguugaacgccucaagagaauggcgaucuccggcgaugacugcguggucaagcccauugaugaccgguuugccaacgcucugcuugcccugaaugauaugggaaaagugcgcaaggacaucccucaauggcagccgagcaaaggcuggcaugauuggcaacaggugcccuucuguucucaccauuuccacgagcucauuaugaaggacgggagaaaacugguugugccuugccggccccaagacgaacuuaucggacgcgcuagaaucucccagggcgccggguggagccugcgggagacagcuugucucggaaaggccuaugcgcagauguggucucugauguacuuucaccgcagagaucugcggcucgccuccaacgcuauuugcagcgccgucccugugcauuggguucccacgucucgcaccacaugguccauccacgcccaucaccaauggaugaccacagaagacaugcugaccguguggaauagagucuggauugaggauaacccuuggauggaggacaagacgcccgugaccacaugggaaaaugucccguaccuuggcaaacgggaggaucaguggugugggagccugaucggccucaccuccagagcuacaugggcccagaacauuccuaccgcgauccagcaagugcgcagccugaucggaaaugaagaguuccuugacuauaugcccucuaugaagcgguuuagaaaagaggaagagagcgaaggcgcuauuugguga

SEQ ID NO: 20764 - RNA, 9873 nt, Artificial Sequence
  derived and/or modified CDS sequence (opt5) from DENV-3__FJ639763__SS-prME
accagccugugccucaugaugauccugcccgcggcucuugccuuccaccugacgucccgggacggcgaaccucggaugauuguggggaagaacgaacgcggaaagucucuccuguuuaagacggcgagcggcaucaauauguguacccuuauugcuauggaucugggggagaugugcgacgauacagucaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaaggcugugauuuucauccugcuuaugcuggucaccccuucuaugacaaugagaugugugggaguuggcaaccgggacuuuguggaagggcucagcggagccaccugggucgauguggugcuggagcacggcgggugcgucaccacaauggcuaagaauaaacccacgcuggacauugagcuccagaagaccgaagccacacagcuggcgacccuucgcaaacuguguaucgagggaaagauuacaaacaucaccacggauuccagaugcccuacacagggcgaagccguucucccggaggaacaggaccagaauuauguguguaaacacaccuacguggaucggggcugggggaacggaugcggccuguucgggaagggaagccuugugaccugcgcuaaguuucaaugucuggagcccauugagggcaaagugguucaguaugaaaaucucaaguacacagugaucaucaccguccauacaggggaccagcaccaggugggaaacgagacgcaaggcguuaccgccgaaauuacaccucaggcuucuaccacagaggccauccugcccgaauauggcacccuggggcucgagugcuccccucgcacgggacuggacuucaaugagaugauucuucugaccaugaaaaacaaggccuggauggugcauagacagugguuuuucgaucucccccugccguggacaagcggcgcuaccacagaaaccccuacguggaaucggaaagagcuucuggucacauuuaagaacgcgcacgccaaaaagcaagaaguggucgugcucgggucucaggagggagcuaugcacaccgcccugacaggcgccaccgaaauccaaaauuccgggggcaccagcauuuucgcuggacaucugaagugucgccucaaaauggacaagcuggagcuuaaaggcaugucuuacgccaugugcacaaacacguuuguucugaagaaagagguguccgaaacccagcacgggacaauccucaucaaggucgaguacaagggagaagaugugcccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggccaagaucgugaccgcugaaacacaaaacuccagcuucauuaucgauggaccuaauacccccgagugcccgucugcguccagagccuggaacgucugggaaguggaggacuauggcuuuggcguguucacaaccaauaucuggcucaaacugcgcgaagucuacacgcagcugugugaccaccggcuuaugagcgcugccguuaaggaugagagagccgugcacgcugacaugggguacuggauugagucccagaaaaacggaucuuggaagcucgaaaaagccagccugaucgaggugaagacaugcaccuggccuaagucccauacccuguggucuaauggcguccucgaaagcgauaugauuauccccaaaucccuggcggggccuauuagccagcacaacuaucgccccggauaccauacacaaaccgcuggcccuuggcaccuugggaagcuggagcucgacuuuaauuauugcgagggaacgacagugguuaucaccgaaaacuguggcacacggggccccucucugagaaccacaaccguguccgggaaacugauccacgaguggugcugucgcagcugcacgcuuccgccucuccgguacaugggagaagauggcuguugguaugggauggagauuagacccaucucugaaaaggaggagaauauggucaaaucccuggugagcgccggaucuggcgaaguugacaacuucaccaugggggugcugugccucgccauucuguuugaggaagucaugcggggaaaguucggcaagaaacauaugaucgcuggcguguucuuuacauucguucuucugcucagcgggcagauuaccuggcgcgauauggcccacacacugaucaugauuggauccaaugcgagcgacagaaugggcaugggggugaccuaccuggcucuuaucgccacguuuaagauccagcccuuccuggcccucggauuuuuccugcggaaacucacaucuagagagaaccugcuucugggcgucgggcucgcuauggccaccacacugcaacugccugaagauauugagcagauggcuaauggaaucgcccuuggccugauggcgcucaagcugauuacccaguuugagaccuaucagcucuggacagcccugaucucccuuacguguagcaacaccauuuucacacugaccguggcuuggcgcacagccacccucauccuggcuggcgugucccugcuuccggucugccaaucuagcuccaugcggaaaacggacuggcugcccaugacaguugccgccaugggggugccuccccucccucuguuuaucuucucucucaaggauacccugaagagacgcagcuggccccuuaaugaaggagugauggcugucggccugguguccauucuggcgucuagccuccugagaaacgacguuccuauggccgggccccuuguggcuggaggccugcucaucgccuguuacgucauuaccgggacauccgccgaucugaccguggagaaagcugccgacguuacaugggaagaggaagcggagcagacgggagugagccauaaccucaugaucaccgucgacgaugacggcacaaugcggauuaaggaugacgagaccgaaaauauccugacagugcuucugaaaaccgcucugcucaucgucucuggcauuuuuccguacuccaucccugccacgcugcuuguguggcacaccuggcagaagcagacacaacgcagcgggguucugugggaugugcccucuccucccgagacccagaaagccgaacucgaggagggagucuauagaauuaagcagcagggcaucuucgggaaaacacaagugggaguuggcgugcagaaggaaggggucuuucauaccauguggcacgugacacggggagcugugcugacguacaacggcaagcgccucgagccgaauugggccuccguuaaaaaggaccugauuagcuauggcgggggauggagacuuucugcgcaguggcaaaaaggcgaagagguccaggugaucgcuguggaaccugggaagaaccccaaaaauuuccagaccaugccuggaacauuccagaccaccacaggcgagauuggggccaucgcccuggauuuuaagcccggaacguccggcagccccaucauuaaccgggagggcaaggucguggggcuguacggaaauggcguugugaccaaaaacgggggauaugucuccggcaucgcucaaacaaaugccgaaccugacgggccgacccccgagcucgaagaggaaauguucaagaaacgcaaccugacaauuauggaucuucacccuggcagcggaaagaccagaaaauaccugcccgcuaucgugcgggaggccauuaagcgcagacuccggacgcugauccucgcgccuacaagaguuguggccgcugagauggaagaggcccugaagggccuucccauccgcuaucagaccaccgcuacaaaaucugaacauaccgggcgggagauugucgaccugaugugccacgccacauuuaccaugagacugcucagcccugugcgcguuccgaauuacaaccugaucauuauggaugaagcccauuucacggaccccgcuuccaucgcggcccggggauacauuucuacaagagugggcaugggggaggcugccgccaucuuuaugaccgcuacaccucccggaaccgccgaugcguucccucagagcaaugcucccauccaggacgaggaacgcgacauuccggagcgguccuggaacucuggcaaugaauggaucacggauuuugccgggaagaccgucugguucgugccuagcauuaaagccggcaacgacaucgcuaacugucuuagaaagaauggcaaaaaggugauucaacugucccgcaagacauuugauaccgaguaucagaaaacaaagcucaacgacugggauuucgucguuaccacagacaucucugagaugggagccaauuuuaaagcggaucgggugauugaccccagacggugccugaagcccgugauccugaccgaugggccugaacgcgucauccucgccggacccaugccugugacggcugccagcgcugcccagagacggggccgcguugggagaaacccgcagaaagagaaugaccaauacauuuucacaggacagccccuuaacaaugaugaagaccacgcucauuggaccgaggccaagaugcugcuggacaacaucaauaccccugaaggcauuauccccgcccucuucgagccugagcgggaaaaguccgccgcuauugauggggaguauagacugaaaggcgaaagccgcaagacauuuguggagcuuaugcggagaggagaccugcccgucuggcucgcccacaaaguggcuucugaaggcaucaaguacaccgaucgcaaauggugcuucgacgggcagcggaacaaucagauccuggaggagaacauggauguugaaauuuggacaaaggagggagagaagaagaagcugagaccgcgcuggcucgacgcccggacguauuccgauccucuugcccugaaagaguuuaaggacuucgcugcgggcagaaaaagcaucgcccuggaucucgugaccgaaauugggcgcguccccucucaccuggcucauagaacacggaaugcccuugacaaccuggugaugcuccacaccuccgagcauggaggcaaggccuaccgccacgcugucgaggaacugccugagacaauggaaacccugcuccuucugggccugaugauccuccugacagggggagccaugcuuuuucugauuagcggcaaagggaucggaaagaccuccaucggccucauuugugugaucgcgucuagcgggaugcuguggauggccgagauuccccugcaauggaucgcuuccgccauuguucucgaguucuuuaugauggugcuucugaucccugaacccgagaagcagagaacaccgcaggauaaucaacuggcuuauguggucauuggaauccucacccuggccgcgaucauugccgcuaacgaaaugggccuucuggagacaaccaaacgggaccucggcaugagcaaggaaccugggguugugucucccacguccuaccuggauguggaccugcaccccgccagcgcuuggacacucuacgccgucgcuaccacagugaucaccccuaugcuucgccauaccauugaaaauucuacagccaacguuagccuggcggccaucgcuaaccaggccgugguccugaugggacucgacaaaggcuggccgauuuccaagauggaucugggggugccccuucuggcucucggaugcuauucucaggucaauccucugacgcugaccgccgccgugcuccuucugaucacacacuacgcgaucauuggccccgggcugcaggcuaaagccaccagagaggcucaaaagcggacagccgccggaaucaugaagaacccuaccguugacggcauuaugacgaucgaucucgaccccgugauuuaugauagcaaauucgagaagcagcugggccaggucaugcuucuggugcucugugcuguucagcugcugcucaugagaacauccugggcccuuugcgaggcgcugacccuggccaccgggccuaucacaacccucugggaaggaucuccgggcaaauuuuggaauacaacgaucgcugugagcauggccaacauuuuccgcggguccuaccuggcuggagccggccuugcguuuagcaucaugaagucugucgggaccggaaaacggggcacaggcucccaaggggagacccugggagaaaaguggaagaaaaagcucaaucagcugagcagaaaagaguucgaccuguauaagaaauccggcauuacagagguggaucgcaccgaagccaaggaggggcucaaacggggagaaaucacgcaucacgcugugucuagaggcagcgccaaacuucagugguuuguugagcggaacauggucauucccgaagggcgcgugaucgaccugggauguggcagaggcgggugguccuacuauugcgcuggacugaagaaagugaccgagguccggggcuacacaaaagggggaccuggccaugaggaacccguuccuaugucuaccuacggguggaauauugugaaacucaugagcggaaaggauguguucuaucugcccccggagaaaugugacacacuucugugcgauaucggcgaauccagcccuucucccaccgucgaggagucccgcacaaucagagugcucaagaugguugaacccuggcugaagaacaaucaguucuguauuaaagugcugaacccuuacaugcccaccgucaucgagcaccucgaacggcuucaacgcaagcacggcgggaugcuggugagaaauccucugagccggaacucuacgcaugagauguauuggauuuccaauggaacaggcaacaucguugccagcgugaauauggucucucgccuccugcuuaacagauuuaccaugacccaccggagaccgacaauugaaaaagacguggaucugggggcuggaacgcgccaugugaacgccgagcccgagaccccuaauauggacgucaucggcgaacggaucaagagaauuaaagaggaacacaacagcacauggcacuacgacgaugagaaucccuauaagaccugggcguaccauggguccuaugaaguuaaggccacaggaucugcuagcuccaugaucaacggcguggugaaacuccugaccaagccuugggacgucgugcccaugguuacacagauggccaugaccgauacgaccccguucggccagcaacgcguguuuaaagagaaggucgacacacggaccccuagaagcaugcccgggacacgccgggugaugggaauuaccgcugaguggcuguggagaacgcucggccgcaauaaaaagccucggcugugcacaagagaagaguucaccaagaaaguucgcacaaacgccgccaugggggcgguguuuaccgaagagaaucagugggauuccgcuaaggccgccgucgaagacgaggauuucuggaaacuuguggaccgggagagagaacugcacaagcucggaaaauguggcucuugcguuuacaacaugauggggaagcgcgagaaaaagcugggcgaauuuggaaaggcuaaaggcagcagagccaucugguacauguggcuuggggcucgguaucuggaguucgaggcccucggauuucugaaugaagaucauugguucucccgcgagaacucuuacagcggcguggaaggggagggacugcacaagcucggcuauauucugagagacaucuccaaaauccccgggggcgcgauguacgccgaugacacggcuggaugggacacccggauuacagaagaugaccuucauaaugaggagaagaucacccagcagauggauccugaacacagacaacuggccaacgcuauuuuuaaacucacauaucagaauaaggucgugaagguccagcggcccaccccgacaggcaccgugauggacaucauuucucgcaaagaucagagagggagcggacaaguuggcacguacgggcugaacacauucaccaauauggaggcccagcuuauccggcagauggaaggagagggcgugcuguccaaggcggaccucgaaaacccucaucugcccgagaaaaagaucacccaguggcuggagacaaacggggucgaacgccucaaaagaauggccauuagcggcgaugacugcguggugaagcccaucgaugaccgguuugcuaaugcccugcuugcucugaacgauaugggaaagguucgcaaagacauuccucaauggcagccgucuaagggcuggcaugauuggcaacaggugcccuucuguucccaccauuuccacgagcucaucaugaaagacgggagaaagcuggucgugccuugccggccccaagacgaacuuauuggacgcgccagaaucagccagggcgcuggguggucucugcgggagaccgccugucucggaaaagcguaugcccagauguggucccugauguacuuucaccgcagagaucugcggcucgcuagcaaugccauuugcucugccguuccugugcauuggguccccacaucccgcacgaccuggagcauccacgcucaucaccaauggaugacaaccgaagacaugcugacaguguggaacagagucuggaucgaggauaauccuuggauggaggacaagacccccgugacgaccugggaaaacguuccguaccuuggcaagcgggaggaucaguggugugggucccugauuggccucacaagcagagccaccugggcgcagaauaucccuacagcuauucagcaagugcgcucucugaucggaaacgaagaguuccuugacuauaugcccagcaugaaacgguuuagaaaggaggaagaguccgaaggcgccauuugguga

SEQ ID NO: 20765 - RNA, 9873 nt, Artificial Sequence
  derived and/or modified CDS sequence (opt5) from DENV-3__FJ639765__SS-prME
accagccugugccucaugaugauccugcccgccgcucuugccuuccaccugacaucccgggacggcgagccucggaugauuguggggaagaacgaacgcggaaagucucuccuguuuaagacggcgagcggcaucaauauguguacccuuauugcuauggaucugggggaaaugugcgacgauacagugaccuacaaguguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaacggcaagcgccucgagccgaauugggcuuccgucaaaaaggaccugauuagcuauggcgggggauggagacuuucugcccaguggcaaaaaggcgaagagguccaggugaucgcggucgaaccugggaagaaccccaaaaauuuccagaccaugccuggaacauuccagaccaccacaggcgagauuggggcuaucgcccuggauuuuaagcccggaacguccggcagccccaucauuaaccgggagggcaaggugguugggcuguacggaaauggcguggucaccaaaaacgggggauauguguccggcaucgcccaaacaaaugcugaaccugacgggccgacccccgagcucgaagaggaaauguucaagaaacgcaaccugacaauuauggaucuucacccuggcagcggaaagaccagaaaauaccugcccgccaucguucgggaggcuauuaagcgcagacuccggacgcugauccucgccccuacaagaguggucgcggccgagauggaagaggcucugaagggccuucccauccgcuaucagaccaccgccacaaaaucugaacauaccgggcgggagauuguggaccugaugugccacgcuacauuuaccaugagacugcucagcccuguucgcgugccgaauuacaaccugaucauuauggaugaagcccauuucacggaccccgccuccaucgcugcgcggggauacauuucuacaagagucggcaugggggaggccgcugccaucuuuaugaccgccacaccucccggaaccgcugaugccuucccucagagcaaugcgcccauccaggacgaggaacgcgacauuccggagcgguccuggaacucuggcaaugaauggaucacggauuuugcugggaagaccgugugguucgugccuagcauuaaagccggcaacgacaucgccaacugucuuagaaagaauggcaaaaaggucauucaacugucccgcaagacauuugauaccgaguaucagaaaacaaagcucaacgacugggauuucguugugaccacagacaucucugagaugggagcuaauuuuaaagccgaucgggugauugaccccagacggugccugaagcccgucauccugaccgaugggccugaacgcgugauccucgcgggacccaugccuguuacggccgcuagcgccgcucagagacggggccgcguggggagaaacccgcagaaagagaaugaccaauacauuuucacaggacagccccuuaacaaugaugaagaccacgcccauuggaccgaggcuaagaugcugcuggacaacaucaauaccccugaaggcauuauccccgcccucuucgagccugagcgggaaaaguccgcggccauugauggggaguauagacugaaaggcgaaagccgcaagacauuugucgagcuuaugcggagaggagaccugcccguguggcucgcucacaaaguugccucugaaggcaucaaguacaccgaucgcaaauggugcuucgacgggcagcggaacaaucagauccuggaggagaacauggauguggaaauuuggacaaaggagggagagaagaagaagcugagaccgcgcuggcucgacgcucggacguauuccgauccucuugcccugaaagaguuuaaggacuucgccgcuggcagaaaaagcaucgcgcuggaucucgucaccgaaauugggcgcgugcccacacaccuggcccauagaacccggaaugcucuugacaaccuggucaugcuccacacaucugagcauggaggcaaggccuaccgccacgccguggaggaacugccugagaccauggaaacgcugcuccuucugggccugaugauccuccugaccgggggagcuaugcuuuuucugauuuccggcaaagggaucggaaagacaagcaucggccucauuuguguuaucgccuccucugggaugcuguggauggcggagauuccccugcaauggaucgccagcgcuauuauccucgaguucuuuaugauggugcuucugauuccugaacccgagaagcagagaaccccgcaggauaaucaacuggccuauguggucaucggaauccucacacuggcugccauuaucgcggccaacgaaaugggccuucuggagaccacgaaacgggaccucggcauguccaaggaaccugggguugugagccccacaucuuaccuggauguggaccugcaccccgcuuccgccuggacccucuacgcugucgccacaaccgugauuaccccuaugcuucgccauacaaucgagaauagcacggcuaacguuucucuggccgcgauugccaaccaggcugugguccugaugggacucgacaaaggcuggccgaucagcaagauggaucugggggugccccuucuggcccucggaugcuauucccaggucaauccucugacccugacagcugccgugcuccuucugaucacccacuacgccauuaucggccccgggcugcaggcgaaagcuacaagagaggcccaaaagcggaccgcugccggaauuaugaagaacccuacgguugacggcaucaugacaauugaucucgaccccgugaucuaugauucuaaauucgaaaagcagcugggccaggucaugcuucuggugcucugugccguucagcugcugcucaugagaaccagcugggcucuuugcgaggcccugacccuggcgacagggccuaucaccacacucugggaaggauccccgggcaaauuuuggaauacgaccauugccgugucuauggcuaacaucuuccgcgggagcuaccuggccggagcuggccuugccuuuuccauuaugaaaagcgucgggacaggaaaacggggcaccggcucucaaggggagacacugggagaaaaguggaagaaaaagcucaaucagcuguccagaaaagaguucgaccuguauaagaaaagcggcaucaccgagguggaucgcacggaagcgaaggaggggcucaaacggggagaaauuacccaucacgccguguccagaggcucugcuaaacuucagugguuuguugagcggaacauggucauccccgaagggcgcgugauugaccugggauguggcagaggcggguggagcuacuauugcgccggacugaagaaagugacagagguccggggcuacaccaaagggggaccuggccaugaggaacccguuccuauguccacauacggguggaauaucgugaaacucaugucuggaaaggauguguucuaucugcccccggagaaaugugacacccuucugugcgauaucggcgaaagcuccccuagccccacagucgaggagucucgcaccauuagagugcucaagaugguugaacccuggcugaagaacaaucaguucuguaucaaagugcugaacccuuacaugcccacggucauugagcaccucgaacggcuucaacgcaagcacggcgggaugcuggugagaaauccucugucccggaacagcacacaugagauguauuggaucucuaauggaaccggcaacauuguugcuuccgugaauauggucagccgccuccugcuuaacagauuuaccaugacacaccggagaccgacgaucgaaaaagacguggaucugggggccggaacccgccaugugaacgcugagcccgagacaccuaauauggacgucaucggcgaacggauuaagagaaucaaagaggaacacaacucuaccuggcacuacgacgaugagaaucccuauaagacaugggccuaccaugggagcuaugaaguuaaggcgaccggauccgccucuagcaugauuaacggcguggugaaacuccugacaaagccuugggacgucgugcccaugguuacccagauggcuaugacggauaccacaccguucggccagcaacgcguguuuaaagagaaggucgacacccggacaccuagauccaugcccgggacccgccgggugaugggaaucacggccgaguggcuguggagaacacucggccgcaauaaaaagccucggcugugcaccagagaagaguucacaaagaaaguucgcaccaacgcugccaugggggccguguuuacggaagagaaucagugggauagcgcgaaggcugccgucgaagacgaggauuucuggaaacuuguggaccgggagagagaacugcacaagcucggaaaauguggcuccugcguuuacaacaugauggggaagcgcgagaaaaagcugggcgaauuuggaaaggccaaaggcucuagagcuauuugguacauguggcuuggggcccgguaucuggaguucgaggcucucggauuucugaaugaagaucauugguucagccgcgagaacuccuacucuggcguggaaggggagggacugcacaagcucggcuauauccugagagacaucagcaaaauucccgggggcgccauguacgcggaugacaccgccggaugggacacacggaucaccgaagaugaccuucauaaugaggagaagauuacacagcagauggauccugaacacagacaacuggcuaacgccaucuuuaaacucaccuaucagaauaaggucgugaagguccagcggcccacaccgaccggcacggugauggacauuaucucccgcaaagaucagagagggucuggacaaguuggcacauacgggcugaacaccuucaccaauauggaggcucagcuuauccggcagauggaaggagagggcgugcugagcaaggccgaccucgaaaacccucaucugcccgagaaaaagauuacacaguggcuggagaccaaaggggucgaacgccucaagagaauggcgaucuccggcgaugacugcguggugaagcccauugaugaccgguuugccaacgcucugcuugcccugaaugauaugggaaaaguucgcaaggacaucccucaauggcagccgagcaaaggcuggcaugauuggcaacaggugcccuucuguucucaccauuuccacgagcucauuaugaaggacgggagaaaacuggucgugccuugccggccccaagacgaacuuaucggacgcgcuagaauuucccagggcgccggguggagccugcgggagacagcuugucucggaaaggccuaugcgcagauguggucucugauguacuuucaccgcagagaucugcggcucgccuccaacgcuaucugcagcgccguuccugugcauuggguccccacgucucgcaccacaugguccauccacgcccaucaccaauggaugaccacagaagacaugcugaccguguggaauagagucuggauugaggauaacccuuggauggaggacaagacgcccgugaccacaugggaaaauguuccguaccuuggcaaacgggaggaucaguggugugggagccugaucggccucaccuccagagcuacaugggcccagaacauuccuaccgcgauccagcaagugcgcagccugauuggaaaugaagaguuccuugacuauaugcccucuaugaagcgguuuagaaaagaggaagagagcgaaggcgcuaucugguga

SEQ ID NO: 20766 - RNA, 9873 nt, Artificial Sequence
  derived and/or modified CDS sequence (opt5) from DENV-3__FJ639766__SS-prME
accagccugugccucaugaugauccugcccgccgcucuugccuuccaccugacaucccgggacggcgagccucggaugauuguggggaagaaugaacgcggaaagucucuccuguuuaagacggcgagcggcaucaauauguguacccuuauugcuauggaucugggggaaaugugcgacgauacagugaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucaaucucaaggauacccugaagagacgcucuuggccccuuaacgaaggagucauggccgugggccugguuagcauucuggcuuccucucuccugagaaacgacgugccuauggcggggccccuugucgccggaggccugcucaucgcuuguuacgugauuaccgggacaagcgccgaucugaccguugagaaagccgcugacgugacaugggaagaggaagccgagcagacgggagucucccauaaucucaugaucaccguggacgaugacggcacaaugcggauuaaggaugacgagaccgaaaacauccugacaguccuucugaaaaccgcgcugcucaucgugagcggcauuuuuccguacucuaucccugcuacgcugcuuguuuggcacaccuggcagaagcagacacaacgcuccggggugcugugggauguccccagcccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaauggcaagcgccucgagccgaacugggcuucugucaaaaaggaccugauuuccuauggcgggggauggagacuuagcgcccaguggcaaaaaggcgaagagguccaggugaucgcggucgaaccugggaagaaucccaaaaacuuccagaccaugccuggaacauuccagaccaccacaggcgagauuggggcuaucgcccuggauuuuaagcccggaacgucuggcucccccaucauuaaucgggagggcaaggugguugggcuguacggaaacggcguggucaccaaaaaugggggauaugugagcggcaucgcccaaacaaacgcugaaccugacgggccgacccccgagcucgaagaggaaauguucaagaaacgcaaucugacaauuauggaucuucacccuggcuccggaaagaccagaaaauaccugcccgccaucguucgggaggcuauuaagcgcagacuccggacgcugauccucgccccuacaagaguggucgcggccgagauggaagaggcucugaagggccuucccauccgcuaucagaccaccgccacaaaaagcgaacauaccgggcgggagauuguggaccugaugugccacgcuacauuuaccaugagacugcucucuccuguucgcgugccgaacuacaaucugaucauuauggaugaagcccauuucacggaccccgccagcaucgcugcgcggggauacauuuccacaagagucggcaugggggaggccgcugccaucuuuaugaccgccacaccucccggaaccgcugaugccuucccucagucuaacgcgcccauccaggacgaggaacgcgacauuccggagcggagcuggaacuccggcaacgaauggaucacggauuuugcugggaagaccgugugguucgugccuucuauuaaagccggcaacgacaucgccaauugucuuagaaagaacggcaaaaaggucauucaacugagccgcaagacauuugauaccgaguaucagaaaacaaagcucaaugacugggauuucguugugaccacagacaucuccgagaugggagcuaacuuuaaagccgaucgggugauugaccccagacggugccugaagcccgucauccugaccgaugggccugaacgcgugauccucgcgggacccaugccuguuacggccgcuucugccgcucagagacggggccgcguggggagaaauccgcagaaagagaacgaccaauacauuuucacaggacagccccuuaauaacgaugaagaccacgcccauuggaccgaggcuaagaugcugcuggacaauaucaacaccccugaaggcauuauccccgcccucuucgagccugagcgggaaaagagcgcggccauugauggggaguauagacugaaaggcgaaucccgcaagacauuugucgagcuuaugcggagaggagaccugcccguguggcucgcucacaaaguugccagcgaaggcaucaaguacaccgaucgcaaauggugcuucgacgggcagcggaauaaccagauccuggaggagaauauggauguggaaauuuggacaaaggagggagagaagaagaagcugagaccgcgcuggcucgacgcucggacguauucugauccucuugcccugaaagaguuuaaggacuucgccgcuggcagaaaauccaucgcgcuggaucucgucaccgaaauugggcgcgugcccacacaccuggcccauagaacccggaacgcucuugacaaucuggucaugcuccacacaagcgagcauggaggcaaggccuaccgccacgccguggaggaacugccugagaccauggaaacgcugcuccuucugggccugaugauccuccugaccgggggagcuaugcuuuuucugauuucuggcaaagggaucggaaagacauccaucggccucauuuguguuaucgccagcuccgggaugcuguggauggcggagauuccccugcaauggaucgccucugcuauugugcucgaguucuuuaugauggugcuucugaucccugaacccgagaagcagagaaccccgcaggauaaccaacuggccuaugucguuauuggaauccucacacuggcugccaucauugcggccaaugaaaugggccuucuggagaccacgaaacgggaccucggcaugagcaaggaaccugggguggugucccccacaagcuaccuggaugucgaccugcaccccgcuucugccuggacccucuacgcuguggccacaaccguuaucaccccuaugcuucgccauacaauugagaacuccacggcuaacgugagccuggccgcgaucgccaaucaggcugucgugcugaugggacucgacaaaggcuggccgauuucuaagauggaucugggggucccccuucuggcccucggaugcuauagccaggugaacccucugacccugacagcugccguucuccuucugaucacccacuacgccaucauuggccccgggcugcaggcgaaagcuacaagagaggcccaaaagcggaccgcugccggaaucaugaagaauccuacgguggacggcauuaugacaaucgaucucgaccccgucauuuaugauuccaaauucgaaaagcagcugggccaggugaugcuucugguucucugugccgugcagcugcugcucaugagaaccucuugggcucuuugcgaggcccugacccuggcgacagggccuaucaccacacucugggaaggaagcccgggcaaauuuuggaacacgaccaucgccgucuccauggcuaauauuuuccgcgggucuuaccuggccggagcuggccuugccuuuagcaucaugaaguccguggggacaggaaaacggggcaccggcagccaaggggagacacugggagaaaaguggaagaaaaagcucaaccagcugucuagaaaagaguucgaccuguauaagaaauccggcauuaccgagguggaucgcacggaagcgaaggaggggcucaaacggggagaaaucacccaucacgccguuagcagaggcuccgcuaaacuucagugguuugucgagcggaauauggugauucccgaagggcgcgugaucgaccugggauguggcagaggcggguggucuuacuauugcgccggacugaagaaagucacagagguucggggcuacaccaaagggggaccuggccaugaggaacccgugccuaugagcacauacggguggaacauugugaaacucauguccggaaaggaugucuucuaucugcccccggagaaaugugacacccuucugugcgauaucggcgaaucuagcccuucccccacaguggaggagagccgcaccaucagaguucucaagaugguggaacccuggcugaagaauaaccaguucuguauuaaaguccugaauccuuacaugcccacggugaucgagcaccucgaacggcuucaacgcaagcacggcgggaugcugguuagaaacccucugucuagaaauuccacacaugagauguauuggauuagcaacggaaccggcaauaucguggcuucugucaacauggugucccgccuccugcuuaacagauuuaccaugacacaccggagaccgacgauugaaaaagacguggaucugggggccggaacccgccaugucaaugcugagcccgagacaccuaacauggacguuaucggcgaacggaucaagagaauuaaagaggaacacaauagcaccuggcacuacgacgaugagaaccccuauaagacaugggccuaccaugggucuuaugaagugaaggcgaccggaagcgccuccucuaugaucaauggcguggucaaacuccugacaaagccuugggacgugguucccauggugacccagauggcuaugacggauaccacaccguucggccagcaacgcgucuuuaaagagaagguggacacccggacaccuagaagcaugcccgggacccgccggguuaugggaauuacggccgaguggcuguggagaacacucggccgcaacaaaaagccucggcugugcaccagagaagaguucacaaagaaagugcgcaccaaugcugccaugggggccgucuuuacggaagagaaccagugggauuccgcgaaggcugccguggaagacgaggauuucuggaaacuuguugaccgggagagagaacugcacaagcucggaaaauguggcagcugcguguacaauaugauggggaagcgcgagaaaaagcugggcgaauuuggaaaggccaaaggcuccagagcuaucugguacauguggcuuggggcccgguaucuggaguucgaggcucucggauuucugaacgaagaucauugguucucucgcgagaauagcuacuccggcgucgaaggggagggacugcacaagcucggcuauauucugagagacaucucuaaaauccccgggggcgccauguacgcggaugacaccgccggaugggacacacggauuaccgaagaugaccuucauaacgaggagaagaucacacagcagauggauccugaacacagacaacuggcuaaugccauuuuuaaacucaccuaucagaacaagguggucaaggugcagcggcccacaccgaccggcacgguuauggacaucauuagccgcaaagaucagagaggguccggacaagugggcacauacgggcugaauaccuucaccaacauggaggcucagcuuauccggcagauggaaggagagggcguccugucuaaggccgaccucgaaaacccucaucugcccgagaaaaagaucacacaguggcuggagaccaaagggguggaacgccucaagagaauggcgauuagcggcgaugacugcgugguuaagcccaucgaugaccgguuugccaaugcucugcuugcccugaacgauaugggaaaagugcgcaaggacauuccucaauggcagccguccaaaggcuggcaugauuggcagcagguccccuucuguagccaccauuuccacgagcucaucaugaaggacgggagaaaacuggugguuccuugccggccccaagacgaacuuauuggacgcgcuagaaucucucagggcgccggguggucccugcgggagacagcuugucucggaaaggccuaugcgcagauguggagccugauguacuuucaccgcagagaucugcggcucgccucuaaugcuauuugcuccgccgugccuguccauugggugcccacgagccgcaccacauggucuauccacgcccaucaccaauggaugaccacagaagacaugcugaccgucuggaacagaguguggaucgaggauaauccuuggauggaggacaagacgcccguuaccacaugggaaaacgugccguaccuuggcaaacgggaggaucaguggugugggucccugauuggccucaccagcagagcuacaugggcccagaauaucccuaccgcgauucagcaaguccgcucccugaucggaaacgaagaguuccuugacuauaugcccagcaugaagcgguuuagaaaagaggaagagucugaaggcgcuauuugguga

SEQ ID NO: 20767 - RNA, 9873 nt, Artificial Sequence
  derived and/or modified CDS sequence (opt5) from DENV-3__FJ639767__SS-prME
accagccugugccucaugaugauccugcccgccgcucuugccuuccaccugacgucccgggacggcgaaccucggaugauuguggggaagaacgaacgcggaaagucucuccuguuuaagacggcgagcggcaucaauauguguacccuuauugcuauggaucugggggagaugugcgacgauacagugaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaacggcaagcgccucgagccgaauugggcuuccgucaaaaaggaccugauuagcuauggcgggggauggagacuuucugcccaguggcaaaaaggcgaagagguccaggugaucgcggucgaaccugggaagaaccccaaaaauuuccagaccaugccuggaacauuccagaccaccacaggcgagauuggggcuaucgcccuggauuuuaagcccggaacguccggcagccccaucauuaaccgggagggcaaggugguugggcuguacggaaauggcguggucaccaaaaacgggggauauguguccggcaucgcccaaacaaaugcugaaccugacgggccgacccccgagcucgaagaggaaauguucaagaaacgcaaccugacaauuauggaucuucacccuggcagcggaaagaccagaaaauaccugcccgccaucguucgggaggcuauuaagcgcagacuccggacgcugauccucgccccuacaagaguggucgcggccgagauggaagaggcucugaagggccuucccauccgcuaucagaccaccgccacaaaaucugaacauaccgggcgggagauuguggaccugaugugccacgcuacauuuaccaugagacugcucagcccuguucgcgugccgaauuacaaccugaucauuauggaugaagcccauuucacggaccccgccuccaucgcugcgcggggauacauuucuacaagagucggcaugggggaggccgcugccaucuuuaugaccgccacaccucccggaaccgcugaugccuucccucagagcaaugcgcccauccaggacgaggaacgcgacauuccggagcgguccuggaacucuggcaaugaauggaucacggauuuugcugggaagaccgugugguucgugccuagcauuaaagccggcaacgacaucgccaacugucuuagaaagaauggcaaaaaggucauucaacugucccgcaagacauuugauaccgaguaucagaaaacaaagcucaacgacugggauuucguugugaccacagacaucucugagaugggagcuaauuuuaaagccgaucgggugauugaccccagacggugccugaagcccgucauccugaccgaugggccugaacgcgugauccucgcgggacccaugccuguuacggccgcuagcgccgcucagagacggggccgcguggggagaaacccgcagaaagagaaugaccaauacauuuucacaggacagccccuuaacaaugaugaagaccacgcccauuggaccgaggcuaagaugcugcuggacaacaucaauaccccugaaggcauuauccccgcccucuucgagccugagcgggaaaaguccgcggccauugauggggaguauagacugaaaggcgaaagccgcaagacauuugucgagcuuaugcggagaggagaccugcccguguggcucgcucacaaaguugccucugaaggcaucaaguacaccgaucgcaaauggugcuucgacgggcagcggaacaaucagauccuggaggagaacauggauguggaaauuuggacaaaggagggagagaagaagaagcugagaccgcgcuggcucgacgcucggacguauuccgauccucuugcccugaaagaguuuaaggacuucgccgcuggcagaaaaagcaucgcgcuggaucucgucaccgaaauugggcgcgugcccucucaccuggcccauagaacacggaaugcucuugacaaccuggucaugcuccacaccuccgagcauggaggcaaggccuaccgccacgccguggaggaacugccugagacaauggaaacccugcuccuucugggccugaugauccuccugacagggggagcuaugcuuuuucugauuagcggcaaagggaucggaaagaccuccaucggccucauuuguguuaucgccucuagcgggaugcuguggauggcggagauuccccugcaauggaucgccuccgcuauugugcucgaguucuuuaugauggugcuucugaucccugaacccgagaagcagagaacaccgcaggauaaucaacuggccuaugucguuauuggaauccucacccuggcugccaucauugcggccaacgaaaugggccuucuggagacaaccaaacgggaccucggcaugagcaaggaaccugggguggugucucccaucuccuaccuggaugucgaccugcaccccgcuagcgccuggacgcucuacgcuguggccacaaccguuauuacaccuaugcuucgccauaccaucgaaaauucuaccgcuaacgugagccuggccgcgauugccaaccaggcugucgugcugaugggacucgacaaaggcuggccgaucuccaagauggaucugggggucccccuucuggcccucggaugcuauucucaggugaauccucugacacugacggcugccguucuccuucugaucacccacuacgccauuaucggccccgggcugcaggcgaaagcuacaagagaggcccaaaagcggaccgcugccggaauuaugaagaacccuacaguggacggcaucaugaccauugaucucgaccccgucaucuaugauagcaaauucgagaagcagcugggccaggugaugcuucugguucucugugccgugcagcugcugcucaugagaacguccugggcucuuugcgaggcccugacacuggcgaccgggccuaucaccacacucugggaaggaucuccgggcaaauuuuggaauaccacaauugccgucagcauggcuaacaucuuccgcggguccuaccuggccggagcuggccuugccuuuagcauuaugaagucuguggggacgggaaaacggggcaccggcucccaaggggagacacugggagaaaaguggaagaaaaagcucaaucagcugagcagaaaagaguucgaccuguauaagaaauccggcaucaccgagguggaucgcacagaagcgaaggaggggcucaaacggggagaaauuacccaucacgccguuucuagaggcagcgcuaaacuucagugguuugucgagcggaacauggugauccccgaagggcgcgugauugaccugggauguggcagaggcgggugguccuacuauugcgccggacugaagaaagucacggagguucggggcuacaccaaagggggaccuggccaugaggaacccgugccuaugucuacauacggguggaauaucgugaaacucaugagcggaaaggaugucuucuaucugcccccggagaaaugugacacccuucugugcgauaucggcgaauccagcccuucucccacaguggaggagucccgcaccauuagaguucucaagaugguggaacccuggcugaagaacaaucaguucuguaucaaaguccugaacccuuacaugcccacagugauugagcaccucgaacggcuucaacgcaagcacggcgggaugcugguuagaaauccucugagccggaacucuacccaugagauguauuggaucuccaauggaacgggcaacauuguggcuagcgucaauauggugucucgccuccugcuuaacagauuuacaaugacccaccggagaccgaccaucgaaaaagacguggaucugggggccggaacacgccaugucaacgcugagcccgagacgccuaauauggacguuaucggcgaacggauuaagagaaucaaagaggaacacaacagcaccuggcacuacgacgaugagaaucccuauaagacaugggccuaccauggguccuaugaagugaaggcgaccggaucugccagcuccaugauuaacggcguggucaaacuccugacaaagccuugggacgugguucccauggugacccagauggcuaugacagauaccacgccguucggccagcaacgcgucuuuaaagagaagguggacacccggacaccuagaagcaugcccgggacccgccggguuaugggaaucacagccgaguggcuguggagaacccucggccgcaauaaaaagccucggcugugcacgagagaagaguucacaaagaaagugcgcaccaacgcugccaugggggccgucuuuacagaagagaaucagugggauuccgcgaaggcugccguggaagacgaggauuucuggaaacuuguugaccgggagagagaacugcacaagcucggaaaauguggcucuugcguguacaacaugauggggaagcgcgagaaaaagcugggcgaauuuggaaaggccaaaggcagcagagcuauuugguacauguggcuuggggcccgguaucuggaguucgaggcucucggauuucugaaugaagaucauugguucucccgcgagaacucuuacagcggcgucgaaggggagggacugcacaagcucggcuauauccugagagacaucuccaaaauucccgggggcgccauguacgcggaugacaccgccggaugggacacgcggaucaccgaagaugaccuucauaaugaggagaagauuacacagcagauggauccugaacacagacaacuggcuaacgccaucuuuaaacucaccuaucagaauaagguggucaaggugcagcggcccacaccgaccggcacaguuauggacauuaucucucgcaaagaucagagagggagcggacaagugggcaccuacgggcugaacacguucacaaauauggaggcucagcuuauccggcagauggaaggagagggcguccuguccaaggccgaccucgaaaacccucaucugcccgagaaaaagauuacccaguggcuggagaccaaagggguggaacgccucaagagaauggcgaucagcggcgaugacugcgugguuaagcccauugaugaccgguuugccaacgcucugcuugcccugaaugauaugggaaaagugcgcaaggacaucccucaauggcagccgucuaaaggcuggcaugauuggcagcagguccccuucuguucccaccauuuccacgagcucauuaugaaggacgggagaaaacuggugguuccuugccggccccaagacgaacuuaucggacgcgcuagaauuagccagggcgccggguggucucugcgggagacagcuugucucggaaaggccuaugcgcagauguggucccugauguacuuucaccgcagagaucugcggcucgccagcaacgcuaucugcucugccgugccuguccauugggugcccaccucccgcacaacguggagcauccacgcccaucaccaauggaugaccacagaagacaugcugaccgucuggaauagaguguggauugaggauaacccuuggauggaggacaagacacccguuaccacgugggaaaaugugccguaccuuggcaaacgggaggaucaguggugugggucccugaucggccucaccagcagagcuacaugggcccagaacauuccuaccgcgauccagcaaguccgcucucugauuggaaaugaagaguuccuugacuauaugcccagcaugaagcgguuuagaaaagaggaagaguccgaaggcgcuaucugguga

SEQ ID NO: 20768 - RNA, 9873 nt, Artificial Sequence
  derived and/or modified CDS sequence (opt5) from DENV-3__FJ639768__SS-prME
accagccucugccucaugaugauccugcccgccgcucuugccuuccaccugacgucccgggacggcgaaccucggaugauuguggggaagaaugaacgcggaaagucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaacggcaagcgccucgagccgaauugggcuuccgucaaaaaggaccugauuagcuauggcgggggauggagacuuaacgcccaguggcaaaaaggcgaagagguccaggugaucgcggucgaaccugggaagaaucccaaaaacuuccagaccaugccuggaacauuccagaccaccacaggcgagauuggggcuaucgcccuggauuuuaagcccggaacgucuggcucccccaucauuaaucgggagggcaaggugguugggcuguacggaaacggcguggucaccaaaaaugggggauaugugagcggcaucgcccaaacaaacgcugaaccugacgggccgacccccgagcucgaagaggaaauguucaagaaacgcaaucugacaauuauggaucuucacccuggcuccggaaagaccagaaaauaccugcccgccaucguucgggaggcuauuaagcgcagacuccggacgcugauccucgccccuacaagaguggucgcggccgagauggaagaggcucugaagggccuucccauccgcuaucagaccaccgccacaaaaagcgaacauaccgggcgggagauuguggaccugaugugccacgcuacauuuaccaugagacugcucucuccuguucgcgugccgaacuacaaucugaucauuauggaugaagcccauuucacggaccccgccagcaucgcugcgcggggauacauuuccacaagagucggcaugggggaggccgcugccaucuuuaugaccgccacaccucccggaaccgcugaugccuucccucagucuaacgcgcccauccaggacgaggaacgcgacauuccggagcggagcuggaacuccggcaacgaauggaucacggauuuugcugggaagaccgugugguucgugccuucuauuaaagccggcaacgacaucgccaauugucuuagaaagaacggcaaaaaggucauucaacugagccgcaagacauuugauaccgaguaucagaaaacaaagcucaaugacugggauuucguugugaccacagacaucuccgagaugggagcuaacuuuaaagccgaucgggugauugaccccagacggugccugaagcccgucauccugaccgaugggccugaacgcgugauccucgcgggacccauuccuguuacggccgcuucugccgcucagagacggggccgcguggggagaaauccgcagaaagagaacgaccaauacaucuucacaggacagccccuuaauaacgaugaagaccacgcccauuggaccgaggcuaagaugcugcuggacaauauuaacaccccugaaggcaucauucccgcccucuucgagccugagcgggaaaagagcgcggccaucgauggggaguauagacugaaaggcgaaucccgcaagacauuugucgagcuuaugcggagaggagaccugcccguguggcucgcucacaaaguugccagcgaaggcaucaaguacaccgaucgcaaauggugcuucgacgggcagcggaauaaccagauucuggaggagaauauggauguggaaaucuggacaaaggagggagagaagaagaagcugagaccgcgcuggcucgacgcucggacguauucugauccucuugcccugaaagaguuuaaggacuucgccgcuggcagaaaauccauugcgcuggaucucgucaccgaaaucgggcgcgugcccagccaccuggcccauagaacacggaacgcucuugacaaucuggucaugcuccacaccucugagcauggaggcaaggccuaccgccacgccguggaggaacugccugagacaauggaaacccugcuccuucugggccugaugauucuccugacagggggagcuaugcuuuuucugaucuccggcaaagggaucggaaagaccagcauuggccucaucuguguuauugccuccucugggaugcuguggauggcggagaucccccugcaauggauugccagcgcuaucgugcucgaguucuuuaugauggugcuucugauuccugaacccgagaagcagagaacaccgcaggauaaccaacuggccuaugucguuaucggaauccucacccuggcugccauuaucgcggccaaugaaaugggccuucuggagacaaccaaacgggaccucggcauguccaaggaaccugggguggugagccccacgucuuaccuggaugucgaccugcaccccgcuuccgccuggacacucuacgcuguggccaccacaguuauuaccccuaugcuucgccauaccaucgagaacagcacagcuaacgugucucuggccgcgauugccaaucaggcugucgugcugaugggacucgacaaaggcuggccgaucagcaagauggaucugggggucccccuucuggcccucggaugcuauucccaggugaacccucugacgcugaccgcugccguucuccuucugaucacacacuacgccauuaucggccccgggcugcaggcgaaagcuaccagagaggcccaaaagcggacagcugccggaauuaugaagaauccuaccguggacggcaucaugacgauugaucucgaccccgucaucuaugauucuaaauucgaaaagcagcugggccaggugaugcuucugguucucugugccgugcagcugcugcucaugagaacaagcugggcucuuugcgaggcccugacccuggcgaccgggccuaucacaacccucugggaaggauccccgggcaaauuuuggaacacaacgauugccgucucuauggcuaauaucuuccgcgggagcuacauugccggagcuggccuggccuuuuccaucaugaaaagcguggggaccggaaaacggggcacaggcucucaaggggagacccuuggagaaaaguggaagaaaaagcugaaccagcucuccagaaaagaguucgaccuguauaagaaaagcggcauuacagagguggaucgcaccgaagcgaaggaggggcugaaacggggagaaaucacgcaucacgccguuuccagaggcucugcuaagcuccagugguuugucgagcggaauauggugauucccgaagggcgcgugaucgaccuuggauguggcagaggcggguggagcuacuauugcgccggacugaagaaagucaccgagguucggggcuacacaaaagggggaccuggccaugaggaacccgugccuauguccaccuacggguggaacaucgugaaacugaugucuggaaaggaugucuucuaucugcccccggagaaaugugacacacugcuuugcgauauuggcgaaagcuccccuagccccaccguggaggagucucgcacaaucagaguucugaagaugguggaacccuggcucaagaauaaccaguucuguauuaaaguccugaauccuuacaugcccaccgugaucgagcaccuggaacggcuccaacgcaagcacggcgggaugcuuguuagaaacccucugucccggaauagcacgcaugagauguauuggauuucuaacggaacaggcaauaucguggcuuccgucaacauggugagccgccugcuccugaacagauuuaccaugacccaccggagaccgacaaucgaaaaagacguggaucuuggggccggaacgcgccaugucaaugcugagcccgagaccccuaacauggacguuauuggcgaacggaucaagagaauuaaagaggaacacaauucuacauggcacuacgacgaugagaaccccuauaagaccugggccuaccaugggagcuaugaagugaaggcgacaggauccgccucuagcaugaucaauggcguggucaaacugcucaccaagccuugggacgugguucccauggugacacagauggcuaugaccgauacgaccccguucggccagcaacgcgucuuuaaagagaagguggacacacggaccccuagauccaugcccgggacacgccggguuaugggaauuaccgccgaguggcuguggagaacgcugggccgcaacaaaaagccucggcucugcacaagagaagaguucaccaagaaagugcgcacaaaugcugccaugggggccgucuuuaccgaagagaaccagugggauagcgcgaaggcugccguggaagacgaggauuucuggaaacugguugaccgggagagagaacuucacaagcugggaaaauguggcuccugcguguacaauaugauggggaagcgcgagaaaaagcucggcgaauuuggaaaggccaaaggcucuagagcuaucugguacauguggcugggggcccgguaucuugaguucgaggcucugggauuucucaacgaagaucauugguucagccgcgaaaauuccuacucuggcgucgagggggagggacugcacaagcugggcuauauccucagagacauuagcaaaauccccgggggcgccauguacgcggaugacacggccggaugggacacccggauuacagaagaugaccugcauaacgaggagaagaucacccagcagauggauccugaacacagacaacuugcuaaugccauuuuuaaacugacauaucagaacaagguggucaaggugcagcggcccaccccgacaggcaccguuauggacaucaucucccgcaaagaucagagagggucuggacaagugggcacguacgggcucaauacauucaccaacauggaggcucagcugauucggcagauggaaggagagggcguccuuagcaaggccgaccuggaaaacccucaccuccccgagaaaaagaucacccaguggcuggagacaaaagggguggaacgccugaagagaauggcgauuuccggcgaugacugcgugguuaagcccaucgaugaccgguuugccaaugcucuccuggcccuuaacgauaugggaaaagugcgcaaggacauuccucaauggcagccgagcaaaggcuggcaugauuggcagcagguccccuucuguucucaccauuuccacgagcugaucaugaaggacgggagaaaacucgugguuccuugccggccccaagacgaacugauuggacgcgcuagaaucucccagggcgccggguggagccuucgggagaccgcuugucugggaaaggccuaugcgcagauguggucucucauguacuuucaccgcagagaucugcggcuggccuccaaugcuaucugcagcgccgugccuguccauugggugcccacaucucgcacgaccugguccauucacgcccaucaccaauggaugacaaccgaagacaugcucacagucuggaacagaguguggaucgaggauaauccuuggauggaggacaagacccccguuacgaccugggaaaacgugccguaccugggcaaacgggaggaucaguggugugggagccuuauuggccugacauccagagcuaccugggcccagaauaucccuacagcgauucagcaaguccgcagccucaucggaaacgaagaguuccuggacuauaugcccucuaugaagcgguuuagaaaagaggaagagagcgaaggcgcuaucugguga

SEQ ID NO: 20769 - RNA, 9873 nt, Artificial Sequence
  derived and/or modified CDS sequence (opt5) from DENV-3__FJ639769__SS-prME
accagccugugccucaugaugauccugcccgccgcucuugccuuccaccugacaucccgggacggcgagccucggaugauuguggggaagaacgaacgcggaaagucucuccuguuuaagacggcgagcggcaucaauauguguacccuuauugcuauggaucugggggaaaugugcgacgauacagugaccuacaaguguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaacggcaagcgccucgagccgaauugggcuuccgucaaaaaggaccugauuagcuauggcgggggauggagacuuucugcccaguggcaaaaaggcgaagagguccaggugaucgcggucgaaccugggaagaaccccaaaaauuuccagaccaugccuggaacauuccagaccaccacaggcgagauuggggcuaucgcccuggauuuuaagcccggaacguccggcagccccaucauuaaccgggagggcaaggugguugggcuguacggaaauggcguggucaccaaaaacgggggauauguguccggcaucgcccaaacaaaugcugaaccugacgggccgacccccgagcucgaagaggaaauguucaagaaacgcaaccugacaauuauggaucuucacccuggcagcggaaagaccagaaaauaccugcccgccaucguucgggaggcuauuaagcgcagacuccggacgcugauccucgccccuacaagaguggucgcggccgagauggaagaggcucugaagggccuucccauccgcuaucagaccaccgccacaaaaucugaacauaccgggcgggagauuguggaccugaugugccacgcuacauuuaccaugagacugcucagcccuguucgcgugccgaauuacaaccugaucauuauggaugaagcccauuucacggaccccgccuccaucgcugcgcggggauacauuucuacaagagucggcaugggggaggccgcugccaucuuuaugaccgccacaccucccggaaccgcugaugccuucccucagagcaaugcgcccauccaggacgaggaacgcgacauuccggagcgguccuggaacucuggcaaugaauggaucacggauuuugcugggaagaccgugugguucgugccuagcauuaaagccggcaacgacaucgccaacugucuuagaaagaauggcaaaaaggucauucaacugucccgcaagacauuugauaccgaguaucagaaaacaaagcucaacgacugggauuucguugugaccacagacaucucugagaugggagcuaauuuuaaagccgaucgggugauugaccccagacggugccugaagcccgucauccugaccgaugggccugaacgcgugauccucgcgggacccaugccuguuacggccgcuagcgccgcucagagacggggccgcguggggagaaacccgcagaaagagaaugaccaauacauuuucacaggacagccccuuaacaaugaugaagaccacgcccauuggaccgaggcuaagaugcugcuggacaacaucaauaccccugaaggcauuauccccgcccucuucgagccugagcgggaaaaguccgcggccauugauggggaguauagacugaaaggcgaaagccgcaagacauuugucgagcuuaugcggagaggagaccugcccguguggcucgcucacaaaguugccucugaaggcaucaaguacaccgaucgcaaauggugcuucgacgggcagcggaacaaucagauccuggaggagaacauggauguggaaauuuggacaaaggagggagagaagaagaagcugagaccgcgcuggcucgacgcucggacguauuccgauccucuugcccugaaagaguuuaaggacuucgccgcuggcagaaaaagcaucgcgcuggaucucgucaccgaaauugggcgcgugcccacacaccuggcccauagaacccggaaugcucuugacaaccuggucaugcuccacacaucugagcauggaggcaaggccuaccgccacgccguggaggaacugccugagaccauggaaacgcugcuccuucugggccugaugauccuccugaccgggggagcuaugcuuuuucugauuuccggcaaagggaucggaaagacaagcaucggccucauuuguguuaucgccuccucugggaugcuguggauggcggagauuccccugcaauggaucgccagcgcuauugugcucgaguucuuuaugauggugcuucugaucccugaacccgagaagcagagaaccccgcaggauaaucaacuggccuaugucguuauuggaauccucacacuggcugccaucauugcggccaacgaaaugggccuucuggagaccacgaaacgggaccucggcauguccaaggaaccugggguggugagccccacaucuuaccuggaugucgaccugcaccccgcuuccgccuggacccucuacgcuguggccacaaccguuaucaccccuaugcuucgccauacaauugagaauagcacggcuaacgugucucuggccgcgaucgccaaccaggcugucgugcugaugggacucgacaaaggcuggccgauuagcaagauggaucugggggucccccuucuggcccucggaugcuauucccaggugaauccucugacccugacagcugccguucuccuucugaucacccacuacgccaucauuggccccgggcugcaggcgaaagcuacaagagaggcccaaaagcggaccgcugccggaaucaugaagaacccuacgguggacggcauuaugacaaucgaucucgaccccgucauuuaugauucuaaauucgaaaagcagcugggccaggugaugcuucugguucucugugugguccagcugcugcucaugagaaccagcugggcccuuugcgaggcucugacccuggccacagggccuaucaccacacucugggaaggauccccgggcaaauuuuggaauacgaccaucgcggugucuauggccaacauuuuccgcgggagcuaccuggcuggagccggccuugcuuuuuccaucaugaaaagcguggggacaggaaaacggggcaccggcucucaaggggagacacugggagaaaaguggaagaaaaagcucaaucagcuguccagaaaagaguucgaccuguauaagaaaagcggcauuaccgagguugaucgcacggaagccaaggaggggcucaaacggggagaaaucacccaucacgcggucuccagaggcucugccaaacuucagugguuuguggagcggaacauggugauucccgaagggcgcgucaucgaccugggauguggcagaggcggguggagcuacuauugcgcuggacugaagaaaguuacagaggugcggggcuacaccaaagggggaccuggccaugaggaacccgugccuauguccacauacggguggaauauugucaaacucaugucuggaaaggauguguucuaucugcccccggagaaaugugacacccuucugugcgauaucggcgaaagcuccccuagccccacaguugaggagucucgcaccaucagagugcucaagauggucgaacccuggcugaagaacaaucaguucuguauuaaagugcugaacccuuacaugcccacgguuaucgagcaccucgaacggcuucaacgcaagcacggcgggaugcuggugagaaauccucugucccggaacagcacacaugagauguauuggauuucuaauggaaccggcaacaucgucgccuccgugaauauggugagccgccuccugcuuaacagauuuaccaugacacaccggagaccgacgauugaaaaagacgucgaucugggggcuggaacccgccauguuaacgccgagcccgagacaccuaauauggacgugaucggcgaacggaucaagagaauuaaagaggaacacaacucuaccuggcacuacgacgaugagaaucccuauaagacaugggcuuaccaugggagcuaugaagugaaggccaccggauccgcgucuagcaugaucaacggcgucgugaaacuccugacaaagccuugggacguugugcccauggucacccagauggccaugacggauaccacaccguucggccagcaacgcguguuuaaagagaagguugacacccggacaccuagauccaugcccgggacccgccgggugaugggaauuacggcugaguggcuguggagaacacucggccgcaauaaaaagccucggcugugcaccagagaagaguucacaaagaaaguccgcaccaacgccgcuaugggggccguguuuacggaagagaaucagugggauagcgccaaggcggcuguugaagacgaggauuucuggaaacuuguggaccgggagagagaacugcacaagcucggaaaauguggcuccugcgucuacaacaugauggggaagcgcgagaaaaagcugggcgaauuuggaaaggccaaaggcucuagagccaucugguacauguggcuuggggcucgguaucuggaguucgaggcccucggauuucugaaugaagaucauugguucagccgcgagaacuccuacucuggcguggaaggggagggacugcacaagcucggcuauauucugagagacaucagcaaaauccccgggggcgcuauguacgccgaugacaccgcgggaugggacacacggauuaccgaagaugaccuucauaaugaggagaagaucacacagcagauggauccugaacacagacaacuggccaacgcuauuuuuaaacucaccuaucagaauaaggucgugaagguucagcggcccacaccgaccggcacggugauggacaucauuucccgcaaagaucagagagggucuggacaagucggcacauacgggcugaacaccuucaccaauauggaggcccagcuuauccggcagauggaaggagagggcgugcugagcaaggcugaccucgaaaacccucaucugcccgagaaaaagaucacacaguggcuggagaccaaagggguggaacgccucaagagaauggccauuuccggcgaugacugcguugugaagcccaucgaugaccgguuugcgaacgcccugcuugcucugaaugauaugggaaaaguccgcaaggacauuccucaauggcagccgagcaaaggcuggcaugauuggcaacaggugcccuucuguucucaccauuuccacgagcucaucaugaaggacgggagaaaacugguugugccuugccggccccaagacgaacuuauuggacgcgccagaaucucccagggcgcuggguggagccugcgggagacagccugucucggaaaggcuuaugcccagauguggucucugauguacuuucaccgcagagaucugcggcucgcguccaacgccauuugcagcgcugucccugugcauuggguccccacgucucgcaccacaugguccauccacgcccaucaccaauggaugaccacagaagacaugcugaccguguggaauagaguuuggaucgaggauaacccuuggauggaggacaagacgcccgugaccacaugggaaaaugucccguaccuuggcaaacgggaggaucaguggugugggagccugauuggccucaccuccagagccacaugggcucagaacaucccuaccgccauucagcaagugcgcagccugaucggaaaugaagaguuccuugacuauaugcccucuaugaagcgguuuagaaaagaggaagagagcgaaggcgcgauuugguga

SEQ ID NO: 20770 - RNA, 9873 nt, Artificial Sequence
  derived and/or modified CDS sequence (opt5) from DENV-3__FJ882577__SS-prME
accagccugugccucaugaugauccugcccgccgcucuugccuuccaccugacaucccgggacggagagccucggaugauuguggggaagaacgaacgcggaaagucucuccuguuuaagacggcgagcggcaucaauauguguacccuuauugcuauggaucugggggaaaugugcgacgauacagucaccuacaaguguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcauuuucuuuacauucguucuucugcucagcgggcagaucaccuggcgcgauauggcucacacacugauuaugaucggauccaaugccagcgacagaaugggcaugggggugaccuaccuggcgcuuaucgcuacguuuaagauucagcccuuccuggcccucggauuuuuccugcggaaacucacaucuagagagaaccugcuucugggcgucgggcucgccauggcuaccacacugcaacugccugaagauaucgagcagauggccaauggaauugcucuuggccugauggcccucaagcugaucacccaguuugagaccuaucagcucuggacagcgcugauuucccuuacguguagcaacaccaucuucacacugaccguggccuggcgcacagcuacccucauccuggccggcgugucccugcuuccggucugccaaucuagcuccaugcggaaaacggacuggcugcccaugacaguugcugccaugggggugccuccccucccucuguuuauuuucucucucaaggauacccugaagagacgcagcuggccccuuaaugaaggagugauggccgucggccugguguccauccuggcuucuagccuccugagaaacgacguuccuauggcggggccccuuguggccggaggccugcucauugcuuguuacgucaucaccgggacauccgccgaucugaccguggagaaagccgcugacguuacaugggaagaggaagccgagcagacgggagugagccauaaccucaugauuaccgucgacgaugacggcacaaugcggaucaaggaugacgagaccgaaaauauccugacagugcuucugaaaaccgcgcugcucauugucucuggcaucuuuccguacuccauuccugcuacgcugcuuguguggcacaccuggcagaagcagacacaacgcagcgggguucugugggaugugcccucuccucccgagacccagaaagccgaacucgaggagggagucuauagaaucaagcagcagggcauuuucgggaaaacacaagugggaguuggcgugcagaaggaaggggucuuucauaccauguggcacgugacacggggagccgugcugacguacaacggcaagcgccucgagccgaauugggcuuccguuaaaaaggaccugaucagcuauggcgggggauggagacuuucugcccaguggcaaaaaggcgaagagguccaggugauugcgguggaaccugggaagaaccccaaaaauuuccagaccaugccuggaacauuccagaccaccacaggcgagaucggggcuaucgcccuggauuuuaagcccggaacguccggcagccccauuaucaaccgggagggcaagauugucgggcuguacggaaauggcgugguuaccaaaaacgggggauauguguccggcaucgcccaaacaaaugcugaaccugacgggccgacccccgagcucgaagaggaaauguucaagaaacgcaaccugacaauuauggaucuucacccuggcagcggaaagaccagaaaauaccugcccgccaucguccgggaggcuaucaagcgcagacuccggacgcugauucucgccccuacaagagugguugcggccgagauggaagaggcucugaagggccuucccauccgcuaucagaccaccgccacaaaaucugaacauaccgggcgggagauuguggaccugaugugccacgcuacauuuaccaugagacugcucagcccuguccgcgugccgaauuacaaccugaucauuauggaugaagcccauuucacggaccccgccuccaucgcugcgcggggauacaucucuacaagaguuggcaugggggaggccgcugccauuuuuaugaccgccacaccucccggaaccgcugaugccuucccucagagcaaugcgcccauccaggacgaggaacgcgacauuccggagcgguccuggaacucuggcaaugaauggaucacggauuuugcugggaagaccgugugguucgucccuagcauuaaagccggcaacgacaucgccaacugucuuagaaagaauggcaaaaaggugauucaacugucccgcaagacauuugauaccgaguaucagaaaacaaagcucaacgacugggauuucguggucaccacagacaucucugagaugggagcuaauuuuaaagccgaucggguuaucgaccccagacggugccugaagcccgugauucugaccgaugggccugaacgcgugauccucgcgggacccaugccugucacggccgcuagcgccgcucagagacggggccgcguggggagaaacccgcagaaagagaaugaccaauacauuuucacaggacagccccuuaacaaugaugaagaccacgcccauuggaccgaggcuaagaugcugcuggacaacaucaauaccccugaaggcauuauccccgcccucuucgagccugagcgggaaaaguccgcggccaucgauggggaguauagacugaaaggcgaaagccgcaagacauuuguugagcuuaugcggagaggagaccugcccguguggcucgcucacaaagucgccucugaaggcauuaaguacaccgaucgcaaauggugcuucgacgggcagcggaacaaucagauccuggaggagaacauggauguggaaauuuggacaaaggagggagagaagaagaagcugagaccgcgcuggcucgacgcucggacguauuccgauccucuugcccugaaagaguuuaaggacuucgccgcuggcagaaaaagcaucgcgcuggaucucguuaccgaaauugggcgcgugcccacacaccuggcccauagaacccggaaugcucuugacaaccuggucaugcuccacacaucugagcauggaggcaaggccuaccgccacgccguggaggaacugccugagaccauggaaacgcugcuccuucugggccugaugauccuccugaccgggggagcuaugcuuuuucugaucuccggcaaagggauuggaaagacaagcaucggccucauuugugucaucgccuccucugggaugcuguggauggcggagauuccccugcaauggaucgccagcgcuauugugcucgaguucuuuaugaugguucuucugaucccugaacccgagaagcagagaaccccgcaggauaaucaacuggccuauguggugaucggcauucucacacuggcugccaucauugcggccaacgaaaugggccuucuggagaccacgaaacgggaccucggcauguccaaggaaccuggggucguuagccccacaucuuaccuggauguggaccugcaccccgcuuccgccuggacccucuacgcuguggccacaaccgucaucaccccuaugcuucgccauacaauugagaauagcacggcuaacgugucucuggccgcgaucgccaaccaggcuguugugcugaugggacucgacaaaggcuggccgaucagcaagauggaucugggggucccccuucuggcccucggaugcuauucccaggugaauccucugacccugacagcugccguccuccuucugauuacccacuacgccaucauuggccccgggcugcaggcgaaagcuacaagagaggcccaaaagcggaccgcugccggaaucaugaagaacccuacgguggacggcauuaugacaaucgaucucgaccccguuaucuaugauucuaaauucgaaaagcagcugggccaggugaugcuucugguccucugugccgugcagcugcugcucaugagaaccagcugggcucuuugcgaggcccugacccuggcgacagggccuauuaccacacucugggaaggauccccgggcaaauuuuggaauacgaccaucgccguuucuauggcuaacauuuuccgcgggagcuaccuggccggagcuggccuugccuuuuccaucaugaaaagcguggggacaggaaaacggggcaccggcucucaaggggagacacugggagaaaaguggaagaaaaagcucaaucagcuguccagaaaagaguucgaccuguauaagaaaagcggcauuaccgaggucgaucgcacggaagcgaaggaggggcucaaacggggagaaaucacccaucacgccguguccagaggcucugcuaaacuucagugguuuguggagcggaacaugguuauucccgaagggcgcgucaucgaccugggauguggcagaggcggguggagcuacuauugcgccggacugaagaaagugacagaggugcggggcuacaccaaagggggaccuggccaugaggaacccgucccuauguccacauacggguggaauaucguuaaacucaugucuggaaaggauguguucuaucugcccccggagaaaugugacacccuucugugcgauauuggcgaaagcuccccuagccccacaguggaggagucucgcaccaucagaguccucaagaugguggaacccuggcugaagaacaaucaguucuguauuaaaguucugaacccuuacaugcccacggugaucgagcaccucgaacggcuucaacgcaagcacggcgggaugcuggucagaaauccucugucccggaacagcacacaugagauguauuggauuucuaauggaaccggcaacaucguggcuuccguuaauauggugagccgccuccugcuuaacagauuuaccaugacacaccggagaccgacgaucgaaaaagacgucgaucugggggccggaacccgccaugugaacgcugagcccgagacaccuaauauggacgugauuggcgaacggaucaagagaauuaaagaggaacacaacucuaccuggcacuacgacgaugagaaucccuauaagacaugggccuaccaugggagcuaugaagucaaggcgaccggauccgccucuagcaugaucaacggcguugugaaacuccugacaaagccuugggacgugguccccauggugacccagauggcuaugacggauaccacaccguucggccagcaacgcguuuuuaaagagaagguggacacccggacaccuagauccaugcccgggacccgccgggucaugggaauuacggccgaguggcuguggagaacacucggccgcaauaaaaagccucggcugugcaccagagaagaguucacaaagaaagugcgcaccaacgcugccaugggggccguuuuuacggaagagaaucagugggauagcgcgaaggcugccguggaagacgaggauuucuggaaacuugucgaccgggagagagaacugcacaagcucggaaaauguggcuccugcguguacaacaugauggggaagcgcgagaaaaagcugggcgaauuuggaaaggccaaaggcucuagagcuaucugguacauguggcuuggggcccgguaucuggaguucgaggcucucggauuucugaaugaagaucauugguucagccgcgagaacuccuacucuggcguugaaggggagggacugcacaagcucggcuauauccugagagacauuagcaaaauccccgggggcgccauguacgcggaugacaccgccggaugggacacacggauuaccgaagaugaccuucauaaugaggagaagaucacacagcagauggauccugaacacagacaacuggcuaacgccauuuuuaaacucaccuaucagaauaagguggucaaggugcagcggcccacaccgaccggcacggucauggacaucaucucccgcaaagaucagagagggucuggacaagugggcacauacgggcugaacaccuucaccaauauggaggcucagcuuauucggcagauggaaggagagggcguucugagcaaggccgaccucgaaaacccucaucugcccgagaaaaagaucacacaguggcuggagaccaaagggguggaacgccucaagagaauggcgauuuccggcgaugacugcgucgugaagcccaucgaugaccgguuugccaacgcucugcuugcccugaaugauaugggaaaagugcgcaaggacauuccucaauggcagccgagcaaaggcuggcaugauuggcagcagguucccuucuguucucaccauuuccacgagcucaucaugaaggacgggagaaaacugguggucccuugccggccccaagacgaacuuauuggacgcgcuagaaucucccagggcgccggguggagccugcgggagacagcuugucucggaaaggccuaugcgcagauguggucucugauguacuuucaccgcagagaucugcggcucgccuccaacgcuaucugcagcgccgugccuguucauugggugcccacgucucgcaccacaugguccauucacgcccaucaccaauggaugaccacagaagacaugcugaccgucuggaauagaguguggaucgaggauaacccuuggauggaggacaagacgcccgucaccacaugggaaaaugugccguaccuuggcaaacgggaggaucaguggugugggagccugauuggccucaccuccagagcuacaugggcccagaacaucccuaccgcgauucagcaaguucgcagccugaucggaaaugaagaguuccuugacuauaugcccucuaugaagcgguuuagaaaagaggaagagagcgaaggcgcuaucugguga

SEQ ID NO: 20771 - RNA, 9873 nt, Artificial Sequence
  derived and/or modified CDS sequence (opt5) from DENV-3__FJ850096__SS-prME
accagccugugccugaugaugauccugcccgccgcucuugccuuccaccugacaucccgggacggcgaaccucggaugauuguggggaagaacgaacgcggaaagucucuccuguuuaagacggcgagcggcaucaauauguguacccuuauugcuauggaucugggggagaugugcgacgauacagucaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggccuccugcuuaccuggaucgggcucaauucuaagaacacaagcauguccuuuucuugcauugcuaucggaaucauuacccucuaucugggcgccgugguucaggcugacauggggugugugaucaauuggaaaggaaaggagcugaagugcggcagcgggauuuucgucacaaacgaggugcauacguggaccgaacaguacaaauuucaagccgauucccccaagcggcuugcgacagccaucgcuggcgccugggagaauggaguuuguggcauuagaagcaccacacgcauggaaaaccuccuguggaaacagaucgcuaaugagcugaacuauauccucugggaaaauaacauuaagcugaccguggucgugggggacaucauuggaguucuugagcagggcaaacggacgcugaccccucagcccauggagcucaaguacucuuggaaaacaugggggaaggccaagaucgugaccgccgaaacacaaaacuccagcuucauuaucgauggaccuaauacccccgagugcccgucugcuuccagagcguggaacgucugggaaguggaggacuauggcuuuggcguguucacaaccaauaucuggcugaaacugcgcgaagucuacacgcagcuuugugaccaccggcucaugagcgccgcuguuaaggaugagagagccgugcacgccgacaugggguacuggauugagucccagaaaaacggaucuuggaagcuggaaaaagcuagccugaucgaggugaagacaugcaccuggccuaagucccauacccucuggucuaauggcguccuggaaagcgauaugauuauccccaaaucccuugccgggccuauuagccagcacaacuaucgccccggauaccauacacaaaccgcgggcccuuggcaccuggggaagcucgagcuggacuuuaauuauugcgagggaacgacagugguuaucaccgaaaacuguggcacacggggccccucucugagaaccacaaccguguccgggaaacuuauccacgaguggugcugucgcagcugcacgcucccgccucugcgguacaugggagaagauggcuguugguaugggauggagauuagacccaucucugaaaaggaggagaauauggucaaaucccuggugagcgcuggaucuggcgaaguugacaacuucaccaugggggugcucugccuggccauucuuuuugaggaagucaugcggggaaaguucggcaagaaacauaugaucgccggcguguucuuuacauucguucugcuccugagcgggcagauuaccuggcgcgauauggcucacacacugaucaugauuggauccaaugccagcgacagaaugggcaugggggugaccuaccuugcgcugaucgcuacguuuaagauccagcccuuccucgcccugggauuuuuccuccggaaacugacaucuagagagaaccuucugcucggcgucgggcuggccauggcuaccacacugcaacuuccugaagauauugagcagauggccaauggaaucgcucugggccucauggcccugaagcucauuacccaguuugagaccuaucagcuguggacagcgcuuaucucccugacguguagcaacaccauuuucacacucaccguggccuggcgcacagcuacccugauccuggccggcgugucccuucugccggucugccaaucuagcuccaugcggaaaacggacuggcuccccaugacaguugcugccaugggggugccuccccugccucucuuuaucuucucucugaaggauacccuuaagagacgcagcuggccccugaaugaaggagugauggccgucggccugguguccauucucgcuucuagccugcuuagaaacgacguuccuauggcggggccccugguggccggaggccuccugaucgcuuguuacgucauuaccgggacauccgccgaucucaccguggagaaagccgcugacguuacaugggaagaggaagccgagcagacgggagugagccauaaccugaugaucaccgucgacgaugacggcacaaugcggauuaaggaugacgagaccgaaaauauccuuacagugcugcugaaaaccgcgcuccugaucgucucuggcauuuuuccguacuccaucccugcuacgcuucugguguggcacaccuggcagaagcagacacaacgcagcgggguucucugggaugugcccucuccucccgagacccagaaagccgaacuggaggagggagucuauagaauuaagcagcagggcaucuucgggaaaacacaagugggaguuggcgugcagaaggaaggggucuuucauaccauguggcacgugacacggggagccgugcucacguacaacggcaagcgccuggagccgaauugggcuuccguuaaaaaggaccuuauuagcuauggcgggggauggagacugucugcccaguggcaaaaaggcgaagagguccaggugaucgcgguggaaccugggaagaaccccaaaaauuuccagaccaugccuggaacauuccagaccaccacaggcgagauuggggcuaucgcccuggauuuuaagcccggaacguccggcagccccaucauuaaccgggagggcaaggucguggggcucuacggaaauggcguugugaccaaaaacgggggauaugucuccggcaucgcccaaacaaaugcugaaccugacgggccgacccccgagcuggaagaggaaauguucaagaaacgcaaccuuacaauuauggaucugcacccuggcagcggaaagaccagaaaauaccuccccgccaucgugcgggaggcuauuaagcgcagacugcggacgcucauccuggccccuacaagaguuguggcggccgagauggaagaggcucuuaagggccugcccauccgcuaucagaccaccgccacaaaaucugaacauaccgggcgggagauugucgaccugaugugccacgcuacauuuaccaugagacuccugagcccugugcgcguuccgaauuacaaccuuaucauuauggaugaagcccauuucacggaccccgccuccaucgcugcgcggggauacauuucuacaagagugggcaugggggaggccgcugccaucuuuaugaccgccacaccucccggaaccgcugaugccuucccucagagcaaugcgcccauccaggacgaggaacgcgacauuccggagcgguccuggaacucuggcaaugaauggaucacggauuuuaccgggaagacagucugguucgugccuagcauuaaagcuggcaacgacaucgccaacugucugagaaagaauggcaaaaaggugauucaacucucccgcaagaccuuugauacagaguaucagaaaaccaagcugaacgacugggauuucgucguuacaaccgacaucucugagaugggagccaauuuuaaagcugaucgggugauugaccccagacggugccugaagcccgugauccucacggaugggccugaacgcgucauccuugccggacccaugccugugacagcggccagcgcugcccagagacggggccgcguugggagaaacccgcagaaagagaaugaccaauacauuuucaccggacagccccugaacaaugaugaagaccacgcucauuggaccgaggccaagaugcugcucgacaacaucaauacaccugaaggcauuauccccgcucuguucgagccugagcgggaaaaguccgccgcgauugauggggaguauagacuuaaaggcgaaagccgcaagaccuuuguggagcugaugcggagaggagaccuccccgucuggcuggcccacaaaguggcuucugaaggcaucaaguacacagaucgcaaauggugcuucgacgggcagcggaacaaucagauccuggaggagaacauggauguugaaauuuggacgaaggagggagagaagaagaagcucagaccgcgcuggcuugacgcccggaccuauuccgauccucuggcucugaaagaguuuaaggacuucgccgccggcagaaaaagcaucgcucucgaucuggugacagaaauugggcgcguccccucucaccuugcgcauagaacccggaaugcccuggacaaccucgugaugcugcacacauccgagcauggaggcaaggcuuaccgccacgccgucgaggaacugccugagaccauggaaacgcuccuucugcugggccucaugauccugcuuaccgggggagccaugcuguuucucauuagcggcaaagggaucggaaagacauccaucggccugauuugugugaucgcuucuagcgggaugcuguggauggccgagauuccccuccaauggaucgcguccgccauuguucuugaguucuuuaugauggugcugcugaucccugaacccgagaagcagagaaccccgcaggauaaucaacucgcuuauguggucauuggaauccugacacuugccgcuaucauugccgcgaacgaaaugggccugcucgagaccacgaaacgggaccugggcaugagcaaggaaccugggguugugucucccacauccuaccuggauguggaccuccaccccgccagcgcuuggacccuuuacgccgucgcuacaaccgugaucaccccuaugcugcgccauacaauugaaaauucuacggccaacguuagccuggcugccaucgcgaaccaggccgugguccucaugggacuggacaaaggcuggccgauuuccaagauggaucuuggggugccccugcucgcucugggaugcuauucucaggucaauccucugacccucacagccgcugugcuucugcugaucacccacuacgccaucauuggccccgggcuccaggccaaagcgacaagagaggcucaaaagcggaccgccgcuggaaucaugaagaacccuacgguugacggcauuaugacaaucgaucuggaccccgugauuuaugauagcaaauucgagaagcagcuuggccaggucaugcugcucgugcugugugccguucagcugcuccuuaugagaaccuccugggcccugugcgaggcucugacccucgccacagggccuaucaccacacugugggaaggaucuccgggcaaauuuuggaauacgaccaucgcggugagcauggccaacauuuuccgcggguccuaccuugcuggagccggccuggcuuuuagcaucaugaagucugucgggacaggaaaacggggcaccggcucccaaggggagacacucggagaaaaguggaagaaaaagcugaaucagcugagcagaaaagaguucgaccucuauaagaaauccggcauuaccgagguggaucgcacggaagccaaggaggggcuuaaacggggagaaaucacccaucacgcggugucuagaggcagcgccaagcugcagugguuuguugagcggaacauggucauucccgaagggcgcgugaucgaccugggauguggcagaggcgggugguccuacuauugcgcuggacucaagaaagugacagagguccggggcuacaccaaagggggaccuggccaugaggaacccguuccuaugucuacauacggguggaauauugugaaacugaugagcggaaaggauguguucuaucuucccccggagaaaugugacacccugcucugcgauaucggcgaauccagcccuucucccacagucgaggagucccgcaccaucagagugcugaagaugguugaacccuggcugaagaacaaucaguucuguauuaaagugcucaacccuuacaugcccacggucaucgagcaccuugaacggcugcaacgcaagcacggcgggaugcuggugagaaauccucucagccggaacucuacacaugagauguauuggauuuccaauggaaccggcaacaucguugccagcgugaauauggucucucgccugcuucugaacagauuuaccaugacacaccggagaccgacgauugaaaaagacguggaucucggggcuggaacccgccaugugaacgccgagcccgagacaccuaauauggacgucaucggcgaacggaucaagagaauuaaagaggaacacaacagcaccuggcacuacgacgaugagaaucccuauaagacaugggcuuaccauggguccuaugaaguuaaggccaccggaucugcgagcuccaugaucaacggcguggugaaacugcugacaaagccuugggacgucgugcccaugguuacccagauggccaugacggauaccacaccguucggccagcaacgcguguuuaaagagaaggucgacacccggacaccuagaagcaugcccgggacccgccgggugaugggaauuacggcugaguggcucuggagaacacugggccgcaauaaaaagccucggcuuugcaccagagaagaguucacaaagaaaguucgcaccaacgccgcuaugggggccguguuuacggaagagaaucagugggauuccgccaaggcggcugucgaagacgaggauuucuggaaacugguggaccgggagagagaacuccacaagcugggaaaauguggcucuugcguuuacaacaugauggggaagcgcgagaagaaacuuggcgaauuuggaaaagccaaaggcagcagagccaucugguacauguggcugggggcucgguaucucgaguucgaggcccugggauuucugaaugaagaucauugguucucccgcgagaacucuuacagcggcguggaaggggagggacuccacaagcugggcuauauucuuagagacaucuccaaaauccccgggggcgcuauguacgccgaugacaccgcgggaugggacacacggauuaccgaagaugaccugcauaaugaggagaagaucacacagcagauggauccugaacacagacaacucgccaacgcuauuuuuaaacugaccuaucagaauaaggucgugaagguccagcggcccacaccgaccggcacggugauggacaucauuucucgcaaagaucagagagggagcggacaaguuggcacauacgggcuuaacaccuucaccaauauggaggcccagcugauccggcagauggaaggagagggcgugcucuccaaggcugaccuggaaaacccucaucugcccgagaaaaagaucacacaguggcucgagaccaaaggggucgaacgccugaagagaauggccauuagcggcgaugacugcguggugaagcccaucgaugaccgguuugcgaacgcccuucuggcucucaaugauaugggaaaaguucgcaaggacauuccucaauggcagccgucuaaaggcuggcaugauuggcaacaggugcccuucuguucccaccauuuccacgagcugaucaugaaggacgggagaaaacuugucgugccuugccggccccaagacgaacugauuggacgcgccagaaucagccagggcgcuggguggucucuccgggagacagccugucugggaaaggcuuaugcccagauguggucccugauguacuuucaccgcagagaucuccggcuggcgagcaacgccauuugcucugcuguuccugugcauuggguccccacgucccgcaccacauggagcauccacgcccaucaccaauggaugaccacagaagacaugcuuaccguguggaauagagucuggaucgaggauaacccuuggauggaggacaagacgcccgugaccacaugggaaaauguuccguaccugggcaaacgggaggaucaguggugugggucccucauuggccugaccagcagagccacaugggcucagaacaucccuaccgccauucagcaagugcgcucucuuaucggaaaugaagaguuccuggacuauaugcccagcaugaagcgguuuagaaaagaggaagaguccgaaggcgcgauuugguga

SEQ ID NO: 20772 - RNA, 9873 nt, Artificial Sequence
  derived and/or modified CDS sequence (opt5) from DENV-3__FJ882578__SS-prME
accagccugugccucaugaugauccugcccgccgcucuugccuuccaccugacaucccgggacggcgagccucggaugauuguggggaagaacgaacgcggaaagucucuccuguuuaagacggcgagcggcaucaauauguguacccuuauugcuauggaucugggggaaaugugcgacgauacagugaccuacaaguguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacacgaucggagugcuggagcagggcaaacggauucuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaacggcaagcgccucgagccgaauugggcuuccgucaaaaaggaccugauuagcuauggcgggggauggagacuuucugcccaguggcaaaaaggcgaagagguccaggugaucgcggucgaaccugggaagaaccccaaaaauuuccagaccaugccuggaacauuccagaccaccacaggcgagauuggggcuaucgcccuggauuuuaagcccggaacguccggcagccccaucauuaaccgggagggcaaggugguugggcuguacggaaauggcguggucaccaaaaacgggggauauguguccggcaucgcccaaacaaaugcugaaccugacgggccgacccccgagcucgaagaggaaauguucaagaaacgcaaccugacaauuauggaucuucacccuggcagcggaaagaccagaaaauaccugcccgccaucguucgggaggcuauuaagcgcagacuccggacgcugauccucgccccuacaagaguggucgcggccgagauggaagaggcucugaagggccuucccauccgcuaucagaccaccgccacaaaaucugaacauaccgggcgggagauuguggaccugaugugccacgcuacauuuaccaugagacugcucagcccuguucgcgugccgaauuacaaccugaucauuauggaugaagcccauuucacggaccccgccuccaucgcugcgcggggauacauuucuacaagagucggcaugggggaggccgcugccaucuuuaugaccgccacaccucccggaaccgcugaugccuucccucagagcaaugcgcccauccaggacgaggaacgcgacauuccggagcgguccuggaacucuggcaaugaauggaucacggauuuugcugggaagaccgugugguucgugccuagcauuaaagccggcaacgacaucgccaacugucuuagaaagaauggcaaaaaggucauucaacugucccgcaagacauuugauaccgaguaucagaaaacaaagcucaacgacugggauuucguugugaccacagacaucucugagaugggagcuaauuuuaaagccgaucgggugauugaccccagacggugccugaagcccgucauccugaccgaugggccugaacgcgugauccucgcgggacccaugccuguuacggccgcuagcgccgcucagagacggggccgcguggggagaaacccgcagaaagagaaugaccaauacauuuucacaggacagccccuuaacaaugaugaagaccacgcccauuggaccgaggcuaagaugcugcuggacaacaucaauaccccugaaggcauuauccccgcccucuucgagccugagcgggaaaaguccgcggccauugauggggaguauagacugaaaggcgaaagccgcaagacauuugucgagcuuaugcggagaggagaccugcccguguggcucgcucacaaaguugccucugaaggcaucaaguacaccgaucgcaaauggugcuucgacgggcagcggaacaaucagauccuggaggagaacauggauguggaaauuuggacaaaggagggagagaagaagaagcugagaccgcgcuggcucgacgcucggacguauuccgauccucuugcccugaaagaguuuaaggacuucgccgcuggcagaaaaagcaucgcgcuggaucucgucaccgaaauugggcgcgugcccacacaccuggcccauagaacccggaaugcucuugacaaccuggucaugcuccacacaucugagcauggaggcaaggccuaccgccacgccguggaggaacugccugagaccauggaaacgcugcuccuucugggccugaugauccuccugaccgggggagcuaugcuuuuucugauuuccggcaaagggaucggaaagacaagcaucggccucauuuguguuaucgccuccucugggaugcuguggauggcggagauuccccugcaauggaucgccagcgcuauugugcucgaguucuuuaugauggugcuucugaucccugaacccgagaagcagagaaccccgcaggauaaucaacuggccuaugucguuauuggaauccucacacuggcugccaucauugcggccaacgaaaugggccuucuggagaccacgaaacgggaccucggcauguccaaggaaccugggguggugagccccacaucuuaccuggaugucgaccugcaccccgcuuccgccuggacccucuacgcuguggccacaaccguuaucaccccuaugcuucgccauacaauugagaauagcacggcuaacgugucucuggccgcgaucgccaaccaggcugucgugcugaugggacucgacaaaggcuggccgauuagcaagauggaucugggggucccccuucuggcccucggaugcuauucccaggugaauccucugacccugacagcugccguucuccuucugaucacccacuacgccaucauuggccccgggcugcaggcgaaagcuacaagagaggcccaaaagcggaccgcugccggaaucaugaagaacccuacgguggacggcauuaugacaaucgaucucgaccccgucauuuaugauucuaaauucgaaaagcagcugggccaggugaugcuucugguucucugugccgugcagcugcugcucaugagaaccagcugggcucuuugcgaggcccugacccuggcgacagggccuaucaccacacucugggaaggauccccgggcaaauuuuggaauacgaccaucgccgucucuauggcuaacauuuuccgcgggagcuaccuggccggagcuggccuugccuuuuccaucaugaaaagcguggggacaggaaaacggggcaccggcucucaaggggagacacugggagaaaaguggaagaaaaagcucaaucagcuguccagaaaagaguucgaccuguauaagaaaagcggcauuaccgagguggaucgcacggaagcgaaggaggggcucaaacggggagaaaucacccaucacgccguuuccagaggcucugcuaaacuucagugguuugucgagcggaacauggugauucccgaagggcgcgugaucgaccugggauguggcagaggcggguggagcuacuauugcgccggacugaagaaagucacagagguucggggcuacaccaaagggggaccuggccaugaggaacccgugccuauguccacauacggguggaauauugugaaacucaugucuggaaaggaugucuucuaucugcccccggagaaaugugacacccuucugugcgauaucggcgaaagcuccccuagccccacaguggaggagucucgcaccaucagaguucucaagaugguggaacccuggcugaagaacaaucaguucuguauuaaaguccugaacccuuacaugcccacggugaucgagcaccucgaacggcuucaacgcaagcacggcgggaugcugguuagaaauccucugucccggaacagcacacaugagauguauuggauuucuaauggaaccggcaacaucguggcuuccgucaauauggugagccgccuccugcuuaacagauuuaccaugacacaccggagaccgacgauugaaaaagacguggaucugggggccggaacccgccaugucaacgcugagcccgagacaccuaauauggacguuaucggcgaacggaucaagagaauuaaagaggaacacaacucuaccuggcacuacgacgaugagaaucccuauaagacaugggccuaccaugggagcuaugaagugaaggcgaccggauccgccucuagcaugaucaacggcguggucaaacuccugacaaagccuugggacgugguucccauggugacccagauggcuaugacggauaccacaccguucggccagcaacgcgucuuuaaagagaagguggacacccggacaccuagauccaugcccgggacccgccggguuaugggaauuacggccgaguggcuguggagaacacucggccgcaauaaaaagccucggcugugcaccagagaagaguucacaaagaaagugcgcaccaacgcugccaugggggccgucuuuacggaagagaaucagugggauagcgcgaaggcugccguggaagacgaggauuucuggaaacuuguugaccgggagagagaacugcacaagcucggaaaauguggcuccugcguguacaacaugauggggaagcgcgagaaaaagcugggcgaauuuggaaaggccaaaggcucuagagcuaucugguacauguggcuuggggcccgguaucuggaguucgaggcucucggauuucugaaugaagaucauugguucagccgcgagaacuccuacucuggcgucgaaggggagggacugcacaagcucggcuauauucugagagacaucagcaaaauccccgggggcgccauguacgcggaugacaccgccggaugggacacacggauuaccgaagaugaccuucauaaugaggagaagaucacacagcagauggauccugaacacagacaacuggcuaacgccauuuuuaaacucaccuaucagaauaagguggucaaggugcagcggcccacaccgaccggcacgguuauggacaucauuucccgcaaagaucagagagggucuggacaagugggcacauacgggcugaacaccuucaccaauauggaggcucagcuuauccggcagauggaaggagagggcguccugagcaaggccgaccucgaaaacccucaucugcccgagaaaaagaucacacaguggcuggagaccaaagggguggaacgccucaagagaauggcgauuuccggcgaugacugcgugguuaagcccaucgaugaccgguuugccaacgcucugcuugcccugaaugauaugggaaaagugcgcaaggacauuccucaauggcagccgagcaaaggcuggcaugauuggcagcagguccccuucuguucucaccauuuccacgagcucaucaugaaggacgggagaaaacuggugguuccuugccggccccaagacgaacuuauuggacgcgcuagaaucucccagggcgccggguggagccugcgggagacagcuugucucggaaaggccuaugcgcagauguggucucugauguacuuucaccgcagagaucugcggcucgccuccaacgcuauuugcagcgccgugccuguccauugggugcccacgucucgcaccacaugguccauccacgcccaucaccaauggaugaccacagaagacaugcugaccgucuggaauagaguguggaucgaggauaacccuuggauggaggacaagacgcccguuaccacaugggaaaaugugccguaccuuggcaaacgggaggaucaguggugugggagccugauuggccucaccuccagagcuacaugggcccagaacaucccuaccgcgauucagcaaguccgcagccugaucggaaaugaagaguuccuugacuauaugcccucuaugaagcgguuuagaaaagaggaagagagcgaaggcgcuauuugguga

SEQ ID NO: 20773 - RNA, 9873 nt, Artificial Sequence
  derived and/or modified CDS sequence (opt5) from DENV-3__FJ639770__SS-prME
accagccugugccucaugaugauccugcccgccgcucuugccuuccaccugacguccagagacggcgaaccucggaugauuguggggaagaacgaacgcggaaagucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggcggcaggucgaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggcuagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacgugaucggaguccuggagcagggcaaacggacgcuuacccugcagccuauggagcucaaguacucuuggaaaacaugggggaaggccaagauugugaccgccgaaacacaaaacuccagcuucaucauugauggacccaauaccccugagugccccucugcuuccagagcguggaacgugugggaagucgaggacuauggcuuuggcguuuucacaaccaauaucuggcugaaacugcgcgaaguguacacgcagcuuugugaccaccggcucaugagcgccgcugugaaggaugagagagccguccacgccgacaugggguacuggaucgagucccagaaaaacggaucuuggaagcuggaaaaagcuagccugauugaggugaagacaugcaccuggccgaagucccauacccucuggucuaauggcguucuggaaagcgauaugaucauuccuaaaucccuugccgggcccaucagccagcacaacuaucgcccuggauaccauacacaaaccgcgggccccuggcaccuggggaagcucgagcuggacuuuaauuauugcgagggaacgacaguggucauuaccgaaaacuguggcacacggggcccuucucugagaaccacaaccguguccgggaaacuuauccacgaguggugcugucgcagcugcacgcugcccccgcugcgguacaugggagaagauggcuguugguaugggauggagaucagaccuauuucugaaaaggaggagaauaugguuaaaucccuggugagcgcuggaucuggcgaagucgacaacuucaccaugggggugcucugccuggccauccuuuuugaggaaguuaugcggggaaaguucggcaagaaacauaugauugccggcguguucuuuacauucguccugcuccugagcgggcagaucaccuggcgcgauauggcucacacacugauuaugaucggauccaaugccagcgacagaaugggcaugggggugaccuaccuugcgcugauugcuacguuuaagauccagcccuuccucgcccugggauuuuuccuccggaaacugacaucuagagagaaccuucugcucggcguggggcuggccauggcuaccacacugcaacuucccgaagauaucgagcagauggccaauggaauugcucugggccucauggcccugaagcucaucacccaguuugagaccuaucagcuguggacagcgcuuauuucccugacguguagcaacaccaucuucacacucaccgucgccuggcgcacagcuacccugauucuggccggcguuucccuucugccugugugccaaucuagcuccaugcggaaaacggacuggcucccgaugacaguggcugccaugggggugcccccucugccccucuuuaucuucucucugaaggauacccuuaagagacgcagcuggccucugaaugaaggagugauggccguuggccugguguccauccucgcuucuagccugcuuagaaacgacguccccauggcggggccucugguggccggaggccuccugauugcuuguuacguuaucaccgggacauccgccgaucucaccguggagaaagccgcugacgucacaugggaagaggaagccgagcagacgggagugagccauaaccugaugauuaccgucgacgaugacggcacaaugcggaucaaggaugacgagaccgaaaauauucuuacagugcugcugaaaaccgcgcuccugaucguuucuggcaucuuucccuacuccauuccggcuacgcuucugguguggcacaccuggcagaagcagacacaacgcagcgggguccucugggaugugccuucucccccugagacccagaaagccgaacuggaggagggaguuuauagaaucaagcagcagggcauuuucgggaaaacacaagugggagucggcgugcagaaggaagggguguuucauaccauguggcacguuacacggggagccguccucacguacaacggcaagcgccuggagcccaauugggcuuccgugaaaaaggaccuuaucagcuauggcgggggauggagacugucugcccaguggcaaaaaggcgaagaggugcaggucauugcgguggaaccggggaagaacccuaaaaauuuccagaccaugcccggaacauuccagaccaccacaggcgagaucggggcuauugcccuggauuuuaagccuggaacguccggcagccccaucaucaaccgggagggcaagguuguggggcucuacggaaauggcgucgugaccaaaaacgggggauauguuuccggcauugcccaaacaaaugcugaacccgacgggccuaccccggagcuggaagaggaaauguucaagaaacgcaaccuuacaaucauggaucugcaccccggcagcggaaagaccagaaaauaccucccugccauugugcgggaggcuaucaagcgcagacugcggacgcucauucuggcccccacaagagucguggcggccgagauggaagaggcucuuaagggccugccuauccgcuaucagaccaccgccacaaaaucugaacauaccgggcgggagaucguugaccugaugugccacgcuacauuuaccaugagacuccugagccccgugcgcgucccuaauuacaaccuuauuaucauggaugaagcccauuucacggacccggccuccauugcugcgcggggauacaucucuacaagagugggcaugggggaggccgcugccauuuuuaugaccgccacacccccuggaaccgcugaugccuucccccagagcaaugcgccuauccaggacgaggaacgcgacauccccgagcgguccuggaacucuggcaaugaauggauuacggauuuugcugggaagaccgugugguucgucccgagcaucaaagccggcaacgacauugccaacugucugagaaagaauggcaaaaagguuauccaacucucccgcaagacauuugauaccgaguaucagaaaacaaagcugaacgacugggauuucguggugaccacagacauuucugagaugggagcuaauuuuaaagccgaucgggucaucgacccuagacggugccugaagcccgugauucucaccgaugggcccgaacgcguuauccuugcgggaccuaugcccgugacggccgcuagcgccgcucagagacggggccgcgucgggagaaacccucagaaagagaaugaccaauacaucuucacaggacagccgcugaacaaugaugaagaccacgcccauuggaccgaggcuaagaugcugcucgacaacauuaauacccccgaaggcaucauuccugcccuguucgagcccgagcgggaaaaguccgcggccaucgauggggaguauagacuuaaaggcgaaagccgcaagacauuuguggagcugaugcggagaggagaccucccuguuuggcuggcucacaaaguggccucugaaggcauuaaguacaccgaucgcaaauggugcuucgacgggcagcggaacaaucagauccuggaggagaacauggaugucgaaaucuggacaaaggagggagagaagaagaagcucagaccccgcuggcuugacgcucggacguauuccgauccgcuggcccugaaagaguuuaaggacuucgccgcuggcagaaaaagcauugcgcucgaucuggugaccgaaaucgggcgcgucccuucucaccuugcccauagaacacggaaugcucuggacaaccucgugaugcugcacaccuccgagcauggaggcaaggccuaccgccacgccguugaggaacugcccgagacaauggaaacccuccuucugcugggccucaugauucugcuuacagggggagcuaugcuguuucucaucagcggcaaagggauuggaaagaccuccaucggccugaucugugugauugccucuagcgggaugcuguggauggcggagaucccucuccaauggauugccuccgcuaucgugcuugaguucuuuaugaugguccugcugauucccgaaccugagaagcagagaacaccccaggauaaucaacucgccuauguugugaucggcauucucacccuugcugccaucaucgcggccaacgaaaugggacugcucgagacaaccaaacgggaccugggcaugagcaaggaaccggggguggucucuccuacguccuaccuggauguggaccuccaccccgcuagcgccuggacacuuuacgcuguugccaccacagugauuacccccaugcugcgccauaccaucgaaaauucuacagcuaacgucagccuggccgcgauugccaaccaggcugugguccucaugggacuggacaaaggcuggccuaucuccaagauggaucuuggggugccgcugcucgcccugggaugcuauucucagguuaauccccugacgcucaccgcugccgugcuucugcugauuacacacuacgccaucaucggcccugggcuccaggcgaaagcuaccagagaggcccaaaagcggacagcugccggaauuaugaagaaccccaccgucgacggcaucaugacgauugaucuggacccugugaucuaugauagcaaauucgagaagcagcuuggccagguuaugcugcucgugcugugugccguccagcugcuccuuaugagaacauccugggcucugugcgaggcccugacccucgcgaccgggcccauuacaacccugugggaaggaucuccuggcaaauuuuggaauacaacgaucgccgugagcauggcuaacaucuuccgcggguccuaccuugccggagcuggccuggccuuuagcauuaugaagucuguggggaccggaaaacggggcacaggcucccaaggggagacccucggagaaaaguggaagaaaaagcugaaucagcugagcagaaaagaguucgaccucuauaagaaauccggcaucacagagguugaucgcaccgaagcgaaggaggggcuuaaacggggagaaauuacgcaucacgccgucucuagaggcagcgcuaagcugcagugguuuguggagcggaacauggugaucccggaagggcgcgucauugaccugggauguggcagaggcgggugguccuacuauugcgccggacucaagaaaguuaccgaggugcggggcuacacaaaagggggacccggccaugaggaaccugugcccaugucuaccuacggguggaauaucgucaaacugaugagcggaaaggauguguucuaucuuccucccgagaaaugugacacacugcucugcgauauuggcgaauccagcccgucuccuaccguugaggagucccgcacaaucagagugcugaagauggucgaacccuggcugaagaacaaucaguucuguaucaaagugcucaaccccuacaugccuaccguuguggagcaccuugaacggcugcaacgcaagcacggcgggaugcuggucagaaauccccucagccggaacucuacgcaugagauguauuggauuuccaauggaacaggcaacaucguggcuagcgugaauauggucucucgccugcuucugaacagauuuaccaugacccaccggagaccuacaauugaaaaagacguugaucucggggccggaacgcgccaugugaacgcugagccggagacccccaauauggacgugaucggcgaacggauuaagagaaucaaagaggaacacaacagcacauggcacuacgacgaugagaauccuuauaagaccugggccuaccauggguccuaugaagucaaggcgacaggaucugccagcuccaugaucaacggcgugguuaaacugcugaccaagcccugggacguggucccuauggugacacagauggcuaugaccgauacgacccccuucggccagcaacgcguuuuuaaagagaagguggacacacggaccccgagaagcaugccugggacacgccgggucaugggaauuaccgccgaguggcucuggagaacgcugggccgcaauaaaaagccccggcuuugcacaagagaagaguucaccaagaaagugcgcacaaacgcugccaugggggccguuuuuaccgaagagaaucagugggauuccgcgaaggcugccguggaagacgaggauuucuggaaacuggucgaccgggagagagaacuccacaagcugggaaaauguggcucuugcguguacaacaugauggggaagcgcgagaagaaacuuggcgaauuuggaaaagccaaaggcagcagagcuaucugguacauguggcugggggcccgguaucucgaguucgaggcucugggauuucugaaugaagaucauugguucucccgcgagaacucuuacagcggcgucgaaggggagggacuccacaagcugggcuauauucuuagagacaucuccaaaauuccugggggcgccauguacgcggaugacacggccggaugggacacccggaucacagaagaugaccugcauaaugaggagaagaucacccagcagauggaucccgaacacagacaacucgcuaacgccauuuuuaaacugacauaucagaauaaggugguuaaggugcagcggccuacccccacaggcaccgucauggacaucauuucucgcaaagaucagagagggagcggacaagugggcacguacgggcuuaacacauucaccaauauggaggcucagcugauccggcagauggaaggagagggcgugcucuccaaggccgaccuggaaaacccgcgccugccugagaaaaagauuacccaguggcucgagacaaaagggguugaaagacugaagcggauggcgaucagcggcgaugacugcguggucaagcccaucgaugaccgcuuugccaacgcccuucuggcccucaaugauaugggaaaagugagaaaggacauuccccaauggcagccuucuaaaggcuggcacgauuggcagcagguuccguucuguucccaucacuuccaugagcugaucaugaaggacgggcggaaacuugugguccccugccgcccucaagacgaacugauuggacgggcucggaucagccagggcgccggguggucucuccgcgagaccgcuugucugggaaaggccuaugcgcagauguggucccugauguacuuucacagacgggaucuccgccuggccagcaacgcuauuugcucugccgugcccguccacugggugccuacauccagaacgaccuggagcauccaugcccaccaucaauggaugacaaccgaagacaugcuuacaguuuggaaucggguguggauugaggauaaccccuggauggaggacaagaccccugucacgaccugggaaaaugugcccuaccugggcaaaagagaggaucaguggugugggucccucaucggccugacaagccgcgcuaccugggcccagaacaucccgacagcgauucagcaaguucggucucuuaucggaaaugaagaguuccuggacuauaugccuagcaugaagagauuucgcaaagaggaagaguccgaaggcgcuauuugguga

SEQ ID NO: 20774 - RNA, 9873 nt, Artificial Sequence
  derived and/or modified CDS sequence (opt5) from DENV-3__FJ639771__SS-prME
accagccugugccucaugaugauccugcccgccgcucuugccuuccaccugacgucccgggacggagaaccucggaugauuguggggaagaacgaacgcggaaagucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggcuagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugcgggaaaauaacauuaagcucaccgucgugguuggggacgugaucggaguccuggagcagggcaaaagaacgcuuaccccucagcccauggagcugaaguacucuuggaaaacaugggggaaggccaagauugugaccgccgaaacacaaaacuccagcuucaucauugauggaccuaauacccccgagugcccgucugcuucccgcgcguggaacgugugggaagucgaggacuauggcuuuggcguuuucacaaccaauaucuggcucaaacugcgggaaguguacacgcagcugugugaccacagacuuaugagcgccgcugugaaggaugagcgcgccguccacgccgacaugggguacuggaucgagucccagaaaaacggaucuuggaagcucgaaaaagcuagccugauugaggugaagacaugcaccuggccuaagucccauacccuguggucuaauggcguucucgaaagcgauaugaucauucccaaaucccuggccgggccuaucagccagcacaacuaucggcccggauaccauacacaaaccgcgggcccuuggcaccuugggaagcuggagcucgacuuuaauuauugcgagggaacgacaguggucauuaccgaaaacuguggcacaagaggccccucucugcgcaccacaaccguguccgggaaacugauccacgaguggugcugucggagcugcacgcuuccgccucucagauacaugggagaagauggcuguugguaugggauggagauccggcccauuucugaaaaggaggagaauaugguuaaaucccuggugagcgcuggaucuggcgaagucgacaacuucaccaugggggugcugugccucgccauccuguuugaggaaguuaugcgcggaaaguucggcaagaaacauaugauugccggcguguucuuuacauucguccuucugcucagcgggcagaucaccuggagagauauggcucacacacugauuaugaucggauccaaugccagcgaccggaugggcaugggggugaccuaccuggcgcuuauugcuacguuuaagauccagcccuuccuggcccucggauuuuuccugagaaaacucacaucucgcgagaaccugcuucugggcguggggcucgccauggcuaccacacugcaacugccugaagauaucgagcagauggccaauggaauugcucuuggccugauggcccucaagcugaucacccaguuugagaccuaucagcucuggacagcgcugauuucccuuacguguagcaacaccaucuucacacugaccgucgccuggcggacagcuacccucauucuggccggcguuucccugcuuccggugugccaaucuagcuccaugagaaaaacggacuggcugcccaugacaguggcugccaugggggucccuccccucccucuguuuaucuucucucucaaggauacccugaagcgcagaagcuggccccuuaaugaaggagugauggccguuggccugguguccauccuggcuucuagccuccugcggaacgacgucccuauggcggggccccuuguggccggaggccugcucauugcuuguuacguuaucaccgggacauccgccgaucugaccguggagaaagccgcugacgucacaugggaagaggaagccgagcagacgggagugagccauaaccucaugauuaccgucgacgaugacggcacaaugcgcaucaaggaugacgagaccgaaaauauucugacagugcuucugaaaaccgcgcugcucaucguuucuggcaucuuuccguacuccauuccugcuacgcugcuuguguggcacaccuggcagaagcagacacaaagaagcgggguccugugggaugugcccucuccucccgagacccagaaagccgaacucgaggagggaguuuaucggaucaagcagcagggcauuuucgggaaaacacaagugggagucggcgugcagaaggaagggguguuucauaccauguggcacguuacacgcggagccguccugacguacaacggcaagagacucgagccgaauugggcuuccgugaaaaaggaccugaucagcuauggcgggggauggcggcuuucugcccaguggcaaaaaggcgaagaggugcaggucauugcgguggaaccugggaagaaccccaaaaauuuccagaccaugccuggaacauuccagaccaccacaggcgagaucggggcuauugcccuggauuuuaagcccggaacguccggcagccccaucaucaaccgcgagggcaagguuguggggcuguacggaaauggcgucgugaccaaaaacgggggauauguuuccggcauugcccaaacaaaugcugaaccugacgggccgacccccgagcucgaagaggaaauguucaagaaaagaaaccugacaaucauggaucuucacccuggcagcggaaagacccggaaauaccugcccgccauugugcgcgaggcuaucaagagacggcucagaacgcugauucucgccccuacacgcgucguggcggccgagauggaagaggcucugaagggccuucccauccgguaucagaccaccgccacaaaaucugaacauaccgggagagagaucguugaccugaugugccacgcuacauuuaccaugcgccugcucagcccugugcgggucccgaauuacaaccugauuaucauggaugaagcccauuucacggaccccgccuccauugcugcgagaggauacaucucuacacgcgugggcaugggggaggccgcugccauuuuuaugaccgccacaccucccggaaccgcugaugccuucccucagagcaaugcgcccauccaggacgaggaacgggacaucccggagagauccuggaacucuggcaaugaauggauuacggauuuugcugggaagaccgugugguucgucccuagcaucaaagccggcaacgacauugccaacugucuucgcaagaauggcaaaaagguuauccaacugucccggaagacauuugauaccgaguaucagaaaacaaagcucaacgacugggauuucguggugaccacagacauuucugagaugggagcuaauuuuaaagccgauagagucaucgacccccggcgcugccugaagcccgugauucugaccgaugggccugaaagaguuauccucgcgggacccaugccugugacggccgcuagcgccgcucagcggcgcggcagagucgggcggaacccgcagaaagagaaugaccaauacaucuucacaggacagccccuuaacaaugaugaagaccacgcccauuggaccgaggcuaagaugcugcuggacaacauuaauaccccugaaggcaucauucccgcccucuucgagccugagagagaaaaguccgcggccaucgauggggaguaucgccugaaaggcgaaagccggaagacauuuguggagcuuaugagacgcggagaccugcccguuuggcucgcucacaaaguggccucugaaggcauuaaguacaccgaucggaaauggugcuucgacgggcagagaaacaaucagauccuggaggagaacauggaugucgaaaucuggacaaaggagggagagaagaagaagcugcgcccgcgguggcucgacgcuagaacguauuccgauccucuugcccugaaagaguuuaaggacuucgccgcuggccgcaaaagcauugcgcuggaucucgugaccgaaaucgggagaguccccucucaccuggcccaucggacacgcaaugcucuugacaaccuggugaugcuccacaccuccgagcauggaggcaaggccuacagacacgccguugaggaacugccugagacaauggaaacccugcuccuucugggccugaugauucuccugacagggggagcuaugcuuuuucugaucagcggcaaagggauuggaaagaccuccaucggccucaucugugugauugccucuagcgggcugcuguggauggcggagaucccccuccaauggauugccuccgcuaucgugcuugaguucuuuaugaugguccugcugauuccugaacccgagaagcagcggacaccgcaggauaaucaacucgccuauguugugaucggcauucugacccuugcugccaucaucgcggccaacgaaaugggccugcucgagacaaccaaacgcgaccugggcaugagcaaggaaccugggguggucucucccacguccuaccuggauguggaccuccaccccgcuagcgccuggacacuuuacgcuguugccaccacagugauuaccccuaugcugagacauaccaucgaaaauucuacagcuaacgucagccuggccgcgauugccaaccaggcugugguccucaugggacuggacaaaggcuggccgaucuccaagauggaucuuggggugccccugcucgcccugggaugcuauucucagguuaauccucugacgcucaccgcugccgugcuucugcugauuacacacuacgccaucaucggccccgggcuccaggcgaaagcuacccgggaggcccaaaagagaacagcugccggaauuaugaagaacccuaccgucgacggcaucaugacgauugaucuggaccccgugaucuaugauagcaaauucgagaagcagcuuggccagguuaugcugcucgugcugugugccguccagcugcuccuuaugcgcacauccugggcucugugcgaggcccugacccucgcgaccgggccuauuacaacccugugggaaggaucuccgggcaaauuuuggaauacaacgaucgccgugagcauggcuaacaucuuccggggguccuaccuugccggagcuggccuggccuuuagcauuaugaagucuguggggaccggaaaaagaggcacaggcucccaaggggagacccucggagaaaaguggaagaaaaagcugaaucagcugagccgcaaagaguucgaccucuauaagaaauccggcaucacagagguugaucggaccgaagcgaaggaggggcuuaaaagaggagaaauuacgcaucacgccgucucucggggcagcgcuaagcugcagugguuuguggagcgcaacauggugauccccgaagggagagucauugaccugggauguggccggggcgggugguccuacuauugcgccggacucaagaaaguuaccgaggugcgcggcuacacaaaagggggaccuggccaugaggaacccgugccuaugucuaccuacggguggaauaucgucaaacugaugagcggaaaggauguguucuaucuucccccggagaaaugugacacacugcucugcgauauuggcgaauccagcccuucucccaccguugaggaguccagaacaauccgggugcugaagauggucgaacccuggcugaagaacaaucaguucuguaucaaagugcucaacccuuacaugcccaccguuguggagcaccuugaacgccugcaaagaaagcacggcgggaugcugguccggaauccucucagccgcaacucuacgcaugagauguauuggauuuccaauggaacaggcaacaucguggcuagcgugaauauggucucuagacugcuucugaaccgguuuaccaugacccacagacgcccgacaauugaaaaagacguugaucucggggccggaacgcggcaugugaacgcugagcccgagaccccuaauauggacgugaucggcgaaagaauuaagcgcaucaaagaggaacacaacagcacauggcacuacgacgaugagaaucccuauaagaccugggccuaccauggguccuaugaagucaaggcgacaggaucugccagcuccaugaucaacggcgugguuaaacugcugaccaagccuugggacgugguccccauggugacacagauggcuaugaccgauacgaccccguucggccagcaacggguuuuuaaagagaagguggacacaagaaccccucgcagcaugcccgggacacggagagucaugggaauuaccgccgaguggcucuggcgcacgcugggccggaauaaaaagccuagacuuugcacacgcgaagaguucaccaagaaagugcggacaaacgcugccaugggggccguuuuuaccgaagagaaucagugggauuccgcgaaggcugccguggaagacgaggauuucuggaaacuggucgacagagagcgcgaacuccacaagcugggaaaauguggcucuugcguguacaacaugauggggaagagagagaagaaacuuggcgaauuuggaaaagccaaaggcagccgggcuaucugguacauguggcugggggcccgcuaucucgaguucgaggcucugggauuucugaaugaagaucauugguucuccagagagaacucuuacagcggcgucgaaggggagggacuccacaagcugggcuauauucuucgggacaucuccaaaauucccgggggcgccauguacgcggaugacacggccggaugggacaccagaaucacagaagaugaccugcauaaugaggagaagaucacccagcagauggauccugaacaccggcaacucgcuaacgccauuuuuaaacugacauaucagaauaaggugguuaaggugcagcgccccaccccgacaggcaccgucauggacaucauuucuagaaaagaucagcgggggagcggacaagugggcacguacgggcuuaacacauucaccaauauggaggcucagcugauccgccagauggaaggagagggcgugcucuccaaggccgaccuggaaaacccuagacugcccgagaaaaagauuacccaguggcucgagacaaaagggguugaacggcugaagcgcauggcgaucagcggcgaugacugcguggucaagcccaucgaugacagauuugccaacgcccuucuggcccucaaugauaugggaaaagugcggaaggacauuccucaauggcagccgucuaaaggcuggcacgauuggcagcagguucccuucuguucccaucacuuccaugagcugaucaugaaggacgggcgcaaacuuguggucccuugcagaccccaagacgaacugauuggacgggcucgcaucagccagggcgccggguggucucucagagagaccgcuugucugggaaaggccuaugcgcagauguggucccugauguacuuucaccggcgcgaucucagacuggccagcaacgcuauuugcucugccgugccuguccacugggugcccacaucccggacgaccuggagcauccaugcccaccaucaauggaugacaaccgaagacaugcuuacaguuuggaauagaguguggauugaggauaacccuuggauggaggacaagacccccgucacgaccugggaaaaugugccguaccugggcaaacgcgaggaucaguggugugggucccucaucggccugacaagccgggcuaccugggcccagaacaucccuacagcgauucagcaaguuagaucucuuaucggaaaugaagaguuccuggacuauaugcccagcaugaagcgcuuucggaaagaggaagaguccgaaggcgcuauuugguga

SEQ ID NO: 20775 - RNA, 9873 nt, Artificial Sequence
  derived and/or modified CDS sequence (opt5) from DENV-3__FJ639772__SS-prME
accagccugugccucaugaugauccugcccgccgcucuugccuuccaccugacgucccgggacggcgaaccucggaugauuguggggaagaacgaacgcggaaaaucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucgggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggccaagaucgugaccgcugaaacacaaaacuccagcuucauuaucgauggaccuaauacccccgagugcccgucugcguccagagccuggaacgucugggaaguggaggacuauggcuuuggcguguucacaaccaauaucuggcucaaacugcgcgaagucuacacgcagcugugugaccaccggcuuaugagcgcugccguuaaggaugagagagccgugcacgcugacaugggguacuggauugagucccagaaaaacggaucuuggaagcucgaaaaagccagccugaucgaggugaagacaugcaccuggccuaagucccauacccuguggucuaauggcguccucgaaagcgauaugauuauccccaaaucccuggcggggccuauuagccagcacaacuaucgccccggauaccauacacaaaccgcuggcccuuggcaccuugggaagcuggagcucgacuuuaauuauugcgagggaacgacagugguuaucaccgaaaacuguggcacacggggccccucucugagaaccacaaccguguccgggaaacugauccacgaguggugcugucgcagcugcacgcuuccgccucuccgguacaugggagaagauggcuguugguaugggauggagauuagacccaucucugaaaaggaggagaauauggucaaaucccuggugagcgccggaucuggcgaaguugacaacuucaccaugggggugcugugccucgccauucuguuugaggaagucaugcggggaaaguucggcaagaaacauaugaucgcuggcguguucuuuacauucguucuucugcucagcgggcagauuaccuggcgcgauauggcccacacacugaucaugauuggauccaaugcgagcgacagaaugggcaugggggugaccuaccuggcucuuaucgccacguuuaagauccagcccuuccuggcccucggauuuuuccugcggaaacucacaucuagagagaaccugcuucugggcgucgggcucgcuauggccaccacacugcaacugccugaagauauugagcagauggcuaauggaaucgcccuuggccugauggcgcucaagcugauuacccaguuugagaccuaucagcucuggacagcccugaucucccuuacguguagcaacaccauuuucacacugaccguggcuuggcgcacagccacccucauccuggcuggcgugucccugcuuccggucugccaaucuagcuccaugcggaaaacggacuggauccccaugacaguugccgccaugggggugccuccccugccucucuuuauuuucucucugaaggauacccucaagagacgcagcuggccccugaaugaaggagugauggcugucggccuuguguccauccuggcgucuagccugcucagaaacgacguuccuauggccgggccccugguggcuggaggccuucugauugccuguuacgucaucaccgggacauccgccgaucucaccguggagaaagcugccgacguuacaugggaagaggaagcggagcagacgggagugagccauaaccugaugauuaccgucgacgaugacggcacaaugcggaucaaggaugacgagaccgaaaauauccucacagugcugcuuaaaaccgcucugcugauugucucuggcaucuuuccguacuccauuccugccacgcuccugguguggcacaccuggcagaagcagacacaacgcagcgggguucuuugggaugugcccucuccucccgagacccagaaagccgaacuggaggagggagucuauagaaucaagcagcagggcauuuucgggaaaacacaagugggaguuggcgugcagaaggaaggggucuuucauaccauguggcacgugacacggggagcugugcucacguacaacggcaagcgccuggagccgaauugggccuccguuaaaaaggaccucaucagcuauggcgggggauggagacugucugcgcaguggcaaaaaggcgaagagguccaggugauugcuguggaaccugggaagaaccccaaaaauuuccagaccaugccuggaacauuccagaccaccacaggcgagaucggggccaucgcccuugauuuuaagcccggaacguccggcagccccauuaucaaccgggagggcaagauugucgggcuguacggaaauggcgugguuaccaaaaacgggggauauguguccggcaucgcucaaacaaaugccgaaccugacgggccgacccccgagcuggaagaggaaauguucaagaaacgcaaccucacaauuauggaucugcacccuggcagcggaaagaccagaaaauaccuucccgcuaucguccgggaggccaucaagcgcagacugcggacgcucauucuggcgccuacaagagugguugccgcugagauggaagaggcccucaagggccugcccauccgcuaucagaccucugcuaccaaaagcgaacauacagggcgggagauuguggaccuuaugugccacgccaccuuuacaaugagacugcuguccccuguccgcgugccgaauuacaaccucaucauuauggaugaagcccauuucaccgaccccgcuucuaucgcggcccggggauacaucagcacgagaguuggcaugggggaggcugccgccauuuuuaugacagcuaccccucccggaacagccgaugcguucccucaguccaaugcucccauccaggacgaggaacgcgacauuccggagcggucuuggaacagcggcaaugaauggaucaccgauuuugccgggaagacggugugguucgucccuuccauuaaagccggcaacgacaucgcuaacugucugagaaagaauggcaaaaaggugauucaacuuucucgcaagaccuuugauacagaguaucagaaaaccaagcugaacgacugggauuucguggucacaaccgacaucagcgagaugggagccaauuuuaaagcggaucggguuaucgaccccagacggugccucaagcccgugauucugacagaugggccugaacgcgugauccuggccggacccaugccugucaccgcugccuccgcugcccagagacggggccgcguggggagaaacccgcagaaagagaaugaccaauacauuuucacgggacagccccucaacaaugaugaagaccacgcucauuggacagaggccaagaugcuucuggacaacaucaauaccccugaaggcauuauccccgcgcuguucgagccugagcgggaaaagagcgccgcuaucgauggggaguauagacucaaaggcgaaucucgcaagaccuuuguugagcugaugcggagaggagaccuucccguguggcuggcccacaaagucgcuuccgaaggcauuaaguacacagaucgcaaauggugcuucgacgggcagcggaacaaucagauccucgaggagaacauggauguggaaauuuggaccaaggagggagagaagaagaagcugagaccgcgcuggcuggacgcccggacauauagcgauccucucgcccuuaaagaguuuaaggacuucgcugcgggcagaaaaucuaucgcccuggaucugguuacggaaauugggcgcgugcccacccaccucgcucauagaacacggaaugcccuggacaaccuugucaugcugcacaccuccgagcauggaggcaaggccuaccgccacgcuguggaggaacucccugagacaauggaaacccugcugcuccuuggccugaugauccugcucacagggggagccaugcuguuucuuaucagcggcaaagggauuggaaagaccuccaucggccugauuugugucaucgcgucuagcgggaugcucuggauggccgagauuccccugcaauggaucgcuuccgccauugugcuggaguucuuuaugaugguucuccuuaucccugaacccgagaagcagagaacaccgcaggauaaucaacuggcuuauguggugaucggcauucucacccucgccgcgaucauugccgcuaacgaaaugggacugcuugagacaaccaaacgggaccugggcaugagcaaggaaccuggggucguuucucccacguccuaccucgauguggaccugcaccccgccagcgcuuggacacuguacgccguggcuaccacagucaucaccccuaugcuccgccauaccauugaaaauucuacagccaacgugagccuugcggccaucgcuaaccaggccguugugcugaugggacuggacaaaggcuggccgaucuccaagauggaucucggggucccccugcuugcucugggaugcuauucucaggugaauccucucacgcugaccgccgccguccugcuccuuauuacacacuacgcgaucauuggccccgggcugcaggcuaaagccaccagagaggcucaaaagcggacagccgccggaaucaugaagaacccuaccguggacggcauuaugacgaucgaucuggaccccguuaucuaugauagcaaauucgagaagcagcucggccaggugaugcugcuuguccugugugcugugcagcuccugcugaugagaacauccugggcccucugcgaggcgcuuacccuggccaccgggccuauuacaacccugugggaaggaucuccgggcaaauuuuggaauacaacgaucgcuguuagcauggccaacauuuuccgcggguccuaccucgcuggagccggccuggcguuuagcaucaugaagucuguggggaccggaaaacggggcacaggcucccaaggggagacccuuggagaaaaguggaagaaaaagcugaaucagcucagcagaaaagaguucgaccuguauaagaaauccggcauuacagaggucgaucgcaccgaagccaaggaggggcugaaacggggagaaaucacgcaucacgcugugucuagaggcagcgccaagcuccagugguuuguggagcggaacaugguuauucccgaagggcgcgucaucgaccuuggauguggcagaggcgggugguccuacuauugcgcuggacugaagaaagugaccgaggugcggggcuacacaaaagggggaccuggccaugaggaacccgucccuaugucuaccuacggguggaauaucguuaaacugaugagcggaaaggauguguucuaucugcccccggagaaaugugacacacugcuuugcgauauuggcgaauccagcccuucucccaccguggaggagucccgcacaaucagaguccugaagaugguggaacccuggcucaagaacaaucaguucuguauuaaaguucugaacccuuacaugcccaccgugaucgagcaccuggaacggcuccaacgcaagcacggcgggaugcuugucagaaauccucugagccggaacucuacgcaugagauguauuggauuuccaauggaacaggcaacaucguggccagcguuaauauggugucucgccugcuccugaacagauuuaccaugacccaccggagaccgacaaucgaaaaagacgucgaucuuggggcuggaacgcgccaugugaacgccgagcccgagaccccuaauauggacgugauuggcgaacggaucaagagaauuaaagaggaacacaacagcacauggcacuacgacgaugagaaucccuauaagaccugggcguaccauggguccuaugaagucaaggccacaggaucugcuagcuccaugaucaacggcguugugaaacugcucaccaagccuugggacgugguccccauggugacacagauggccaugaccgauacgaccccguucggccagcaacgcguuuuuaaagagaagguggacacacggaccccuagaagcaugcccgggacacgccgggucaugggaauuaccgcugaguggcuguggagaacgcugggccgcaauaaaaagccucggcucugcacaagagaagaguucaccaagaaagugcgcacaaacgccgccaugggggcgguuuuuaccgaagagaaucagugggauuccgcuaaggccgccguggaagacgaggauuucuggaaacuggucgaccgggagagagaacuucacaagcugggaaaauguggcucuugcguguacaacaugauggggaagcgcgagaaaaagcucggcgaauuuggaaaggcuaaaggcagcagagccaucugguacauguggcugggggcucgguaucuugaguucgaggcccugggauuucucaaugaagaucauugguucucccgcgagaacucuuacagcggcguugaaggggagggacugcacaagcugggcuauauccucagagacauuuccaaaauccccgggggcgcgauguacgccgaugacacggcuggaugggacacccggauuacagaagaugaccugcauaaugaggagaagaucacccagcagauggauccugaacacagacaacuugccaacgcuauuuuuaaacugacauaucagaauaagguggucaaggugcagcggcccaccccgacaggcaccgucauggacaucaucucucgcaaagaucagagagggagcggacaagugggcacguacgggcucaacacauucaccaauauggaggcccagcugauucggcagauggaaggagagggcguucuuuccaaggcggaccuggaaaacccucaccuccccgagaaaaagaucacccaguggcuggagacaaaagggguggaacgccugaagagaauggccauuagcggcgaugacugcgucgugaagcccaucgaugaccgguuugcuaacgcccuccuggcucuuaaugauaugggaaaagugcgcaaggacauuccucaauggcagccgucuaaaggcuggcaugauuggcagcagguucccuucuguucccaccauuuccacgagcugaucaugaaggacgggagaaaacucguggucccuugccggccccaagacgaacugauuggacgcgccagaaucagccagggcgcuggguggucucuucgggagaccgccugucugggaaaggcguaugcccagauguggucccucauguacuuucaccgcagagaucugcggcuggcuagcaacgccaucugcucugccgugccuguucauugggugcccacaucccgcacgaccuggagcauucacgcucaucaccaauggaugacaaccgaagacaugcucacagucuggaauagaguguggaucgaggauaacccuuggauggaggacaagacccccgucacgaccugggaaaaugugccguaccugggcaaacgggaggaucaguggugugggucccuuauuggccugacaagcagagccaccugggcgcagaacaucccuacagcuauucagcaaguucgcucucucaucggaaaugaagaguuccuggacuauaugcccagcaugaagcgguuuagaaaagaggaagaguccgaaggcgccaucugguga

SEQ ID NO: 20776 - RNA, 9873 nt, Artificial Sequence
  derived and/or modified CDS sequence (opt5) from DENV-3__FJ639774__SS-prME
acaagccugugccucaugaugauccugcccgccgcucuugccuuccaccugacauccagagacggagagccucggaugauuguggggaagaaugaaagaggaaaaucucuccuguuuaagacggcgagcggcaucaauauguguacccuuauugcuauggaucugggggagaugugcgacgauacagugaccuacaaauguccgcacaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggcggcaaguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcaccacaaccgaaacgccuacauggaaucggaaagagcuucuggugaccuuuaagaacgcccacgcuaaaaagcaagaagucgugguucucgggucucaggagggagcgaugcacacagcccugaccggcgcuaccgaaauccaaaauuccgggggcacaagcauuuucgccggacaucugaagugucgccucaaaauggacaagcuggagcuuaaaggcaugucuuacgccaugugcacgaacaccuuugugcugaagaaagaggucuccgaaacacagcacgggaccauccucaucaagguggaguacaagggagaagauguucccuguaaaauuccuuucagcacagaggacggccaagggaaggcucauaacggaagacugaucaccgccaaucccguggucacgaaaaaggaggaacccgugaacauugaggcggaaccuccguucggcgaguccaauaucgugauugggaucggcgauaacgcucugaaaaucaauugguauaagaagggaucuagcauuggcaaaauguuugaagccacagccagaggggcuagacgcauggccauccuuggagacaccgcuugggauuucggcuccguugggggaguccucaacagccugggcaagauggugcaccagauuuuugggucugccuacaccgcgcuguucuccggcgugagcugggucaugaaaaucggaauuggcgugcuccugacauggaucgggcuuaauucuaagaacaccagcauguccuuuucuugcauugccaucggaaucauuacacuguaucucggcgcuguugugcaggccgacauggggugugucaucaauuggaaaggaaaggagcugaagugcggcagcgggauuuucgugacgaacgagguucauaccuggacagaacaguacaaauuucaagcugauucccccaagcggcuggccaccgcgaucgccggcgcuugggagaauggaguguguggcauuagaagcacaacccgcauggaaaaccuucucuggaaacagaucgccaaugagcugaacuauauccugugggaaaauaacauuaagcucacggucgugguuggggacaucauuggagugcuggagcagggcaaacggacccuuacaccucagcccauggagcugaaguacucuuggaaaaccugggggaaggcuaagaucgucacagccgaaacccaaaacuccagcuucauuaucgauggaccuaauacacccgagugcccgaacgccucuagagcuuggaaugugugggaaguggaggacuauggcuuuggcgucuucaccacgaacaucuggcucaaacugcgcgaaguuuacacacagcugugugaccaccggcuuauguccgcggccgugaaggaugagagagcugugcacgccgacaugggguacuggauugagagccagaaaaauggauccuggaagcucgaaaaagccucucugaucgaggucaagaccugcaccuggccuaagagccauacacugugguccaacggcgugcucgaaucugauaugauuauccccaaaagccuggcugggccuauuucccagcacaauuaucgccccggauaccauacccaaacggccggcccuuggcaccuugggaagcuggagcucgacuuuaacuauugcgagggaacaaccguugugaucacagaaaauuguggcacccggggccccagccugagaacaaccacggucucugggaaacugauccacgaguggugcugucgcuccugcacccuuccgccucuccgguacaugggagaagauggcuguugguaugggauggagauuagacccaucagcgaaaaggaggagaacauggugaaaucucugguuuccgcgggaagcggcgaaguggacaauuucacaauggggguccugugccucgcuauucuguuugaggaagugaugcggggaaaguucggcaagaaacauaugaucgccggcguuuucuuuaccuucgugcuucugcucucugggcagauuacauggcgcgauauggcccacacccugaucaugauuggaagcaacgcuuccgacagaaugggcaugggggucacguaccuggcccuuaucgcgacauuuaagauccagcccuuccuggcucucggauuuuuccugcggaaacucaccagcagagagaaucugcuucugggcguggggcucgccauggccacaacccugcaacugccugaagauauugagcagauggcuaacggaaucgcccuuggccugauggcucucaagcugauuacccaguuugagacauaucagcucuggacggcccugaucucucuuaccuguuccaauacaauuuucacccugacaguggcguggcgcaccgccacgcucauccuggcuggcgucagccugcuuccgguuugccaauccucuagcaugcggaaaacagacuggcugcccaugaccguggccgcuaugggggugccuccccucccucuguuuaucuucucccucaaggauacccugaagagacgcucuuggccccuuaacgaaggagucauggccgugggccugguuagcauucuggccuccucucuccugagaaacgacgugccuauggcugggccccuugucgcgggaggccugcucaucgccuguuacgugauuacagggaccagcgcugaucugacaguugagaaagccgccgacgugacgugggaagaggaagcugagcagaccggagucucccauaaucucaugaucacaguggacgaugacggcaccaugcggauuaaggaugacgagacagaaaacauccugaccguccuucugaaaacggcccugcucaucgugagcggcauuuuuccguacucuaucccugcgacccugcuuguuuggcacacauggcagaagcagacccaacgcuccggggugcugugggauguccccagcccucccgagacacagaaagcugaacucgaggagggaguguauagaauuaagcagcagggcaucuucgggaaaacccaaguuggagugggcguccagaaggaagggguguuucauacaauguggcacgugacgcggggagccguucugaccuacaauggcaagcgccucgagccgaacugggccucugucaaaaaggaccugauuuccuauggcgggggauggagacuuagcgcucaguggcaaaaaggcgaagagguccaggugaucgccgucgaaccugggaagaaucccaaaaacuuccagacaaugccuggaaccuuccagaccacaacgggcgagauuggggcgaucgcucuggauuuuaagcccggaaccucuggcucccccaucauuaaucgggagggcaaggugguugggcuguacggaaacggcguggucaccaagaaugggggauaugugagcggcaucgcccaaaccaacgccgaaccugacgggccgacacccgagcucgaagaggaaauguucaagaaacgcaaucugaccauuauggaucuucacccuggcuccggaaagacgagaaaauaccugcccgcuaucguucgggaggccauuaagcgcagacuccggacacugauccucgcuccuaccagaguggucgccgcggagauggaagaggcccugaagggccuucccauccgcuaucagaccacagcuaccaaaagcgaacauacagggcgggagauuguggaccugaugugccacgccaccuuuacgaugagacugcucucuccuguucgcgugccgaacuacaaucugaucauuauggaugaagcucauuucacagaccccgccagcaucgccgcucggggauacauuuccaccagagucggcaugggggaggcggccgcuaucuuuaugacagccaccccucccggaacggccgaugcuuucccucagucuaacgcccccauccaggacgaggaacgcgacauuccggagcggagcuggaacuccggcaacgaauggaucaccgauuuugcggggaagacagugugguucgugccuucuauuaaagcuggcaacgacaucgccaauugucuuagaaagaacggcaaaaaggucauucaacugagccgcaagaccuuugauacagaguaucagaaaaccaagcucaaugacugggauuucguugugacaaccgacaucuccgagaugggagccaacuuuaaagcugaucgggugauugaccccagacggugccugaagcccgucauccugacggaugggccugaacgcgugauccucgccggacccaugccuguuacagcggccucugcugcccagagacggggccgcguggggagaaauccgcagaaagagaacgaccaauacauuuucaccggacagccccuuaauaacgaugaagaccacgcucauuggaccgaggccaagaugcugcuggacaauaucaacacaccugaaggcauuauccccgcucucuucgagccugagcgggaaaagagcgccgcgauugauggggaguauagacugaaaggcgaaucccgcaagaccuuugucgagcuuaugcggagaggagaccugcccguguggcucgcccacaaaguugcuagcgaaggcaucaaguacacagaucgcaaauggugcuucgacgggcagcggaauaaccagauccuggaggagaauauggauguggaaauuuggacgaaggagggagaacgcaagaaacugcgcccgcgguggcucgacgccagaaccuauucugauccucuugcucugaaagaguuuaaagacuucgccgccggccgcaaguccaucgcucuggaucucgucacagaaauugggagagugcccacccaccuggcgcaucggacacgcaacgcccuugacaaucuggucaugcuccacaccagcgagcauggaggcaaggcuuacagacacgccguggaggaacugccugagacgauggaaacccugcuccuucugggccugaugauccuccugacagggggagccaugcuuuuucugauuucuggcaaggggaucggaaaaaccuccaucggccucauuuguguuaucgcuagcuccgggaugcuguggauggccgagauuccccugcaauggaucgcgucugccauugugcucgaguucuuuaugauggugcuucugaucccugaacccgagaagcagcggacaccgcaggauaaccaacuggcuuaugucguuauuggaauccucacccuggccgcuaucauugccgcgaaugaaaugggccuucuggagacgacaaagcgcgaccucggcaugagcaaagaaccugggguggugucccccaccagcuaccuggaugucgaccugcaccccgccucugcuuggacacucuacgccguggcuaccaccguuaucacaccuaugcuuagacauacgauugagaacuccaccgccaacgugagccuggcugccaucgcgaaucaggccgucgugcugaugggacucgacaagggcuggccgauuucuaaaauggaucugggggucccccuucuggcucucggaugcuauagccaggugaacccucugacacugaccgccgcuguucuccuucugaucacacacuacgccaucauuggccccgggcugcaggccaaggcgacccgggaggcucagaaacggacggccgcuggaaucaugaagaauccuacaguggacggcauuaugaccaucgaucucgaccccgucauuuaugauuccaaguucgaaaaacagcugggccaggugaugcuucugguucucugugccgugcagcugcugcucaugcgcaccucuugggcccuuugcgaggcucugacacuggccaccgggccuaucacaacgcucugggaaggaagcccgggcaaguuuuggaacaccacaaucgcggucuccauggccaauauuuuccgggggucuuaccuggcuggagccggccuugcuuuuagcaucaugaaauccguggggaccggaaagagaggcacaggcagccaaggggagacccugggagaaaaauggaagaagaaacucaaccagcugucucgcaaggaguucgaccuguauaaaaaguccggcauuacggagguggaucggaccgaagccaaagaggggcucaagagaggagaaaucacacaucacgcgguuagccggggcuccgccaaacuucagugguuugucgagcgcaauauggugauucccgaagggagagugaucgaccugggauguggccggggcggguggucuuacuauugcgcuggacugaagaaggucaccgagguucgcggcuacacaaaagggggaccuggccaugaggaacccgugccuaugagcaccuacggguggaacauugugaagcucauguccggaaaagaugucuucuaucugcccccggagaagugugacacacuucugugcgauaucggcgaaucuagcccuucccccaccguggaggagagcagaacgauccggguucucaaaaugguggaacccuggcugaagaauaaccaguucuguauuaagguccugaauccuuacaugcccgccgugaucgagcaccucgaacgccuucaaagaaaacacggcgggaugcugguucggaacccucugucucgcaauuccacacaugagauguauuggauuagcaacggaaccggcaauaucguggcuucugucaacaugguguccagacuccugcuuaaccgguuuaccaugacacacagacgcccgacgauugaaaaggacguggaucugggggccggaacccggcaugucaaugcugagcccgagacaccuaacauggacguuaucggcgaaagaaucaaacgcauuaaggaggaacacaauagcaccuggcacuacgacgaugagaaccccuauaaaacaugggccuaccaugggucuuaugaagugaaggcgaccggaagcgccuccucuaugaucaauggcguggucaagcuccugacaaaaccuugggacgugguucccauggugacccagauggcuaugacggauaccacaccguucggccagcaacgggucuuuaaggagaaaguggacaccagaacaccucgcagcaugcccgggacccggagaguuaugggaauuacggccgaguggcuguggcgcacacucggccggaacaagaaaccuagacugugcacccgcgaagaguucacaaagaaggugcggaccaaugcugccaugggggccgucuuuacggaagagaaccagugggauuccgcgaaagcugccguggaagacgaggauuucuggaaacuuguugacagagagcgcgaacugcacaaacucggaaaguguggcagcugcguguacaauaugauggggaaaagagagaagaaacugggcgaauuuggaaaggccaagggcucccgggcuaucugguacauguggcuuggggcccgcuaucuggaguucgaggcucucggauuucugaacgaagaucauugguucucuagagagaauagcuacuccggcgucgaaggggagggacugcacaaacucggcuauauucugcgggacaucucuaagauccccgggggcgccauguacgcggaugacaccgccggaugggacacaagaauuaccgaagaugaccuucauaacgaggagaaaaucacacagcagauggauccugaacaccggcaacuggcuaaugccauuuuuaagcucaccuaucagaacaaaguggucaaggugcagcgccccacaccgaccggcacgguuauggacaucauuagcagaaaggaucagcggggguccggacaagugggcacauacgggcugaauaccuucaccaacauggaggcucagcuuauccgccagauggaaggagagggcguccugucuaaagccgaccucgaaaacccucaucugcccgagaagaaaaucacacaguggcuggagaccaaggggguggaaagacucaaacggauggcgauuagcggcgaugacugcgugguuaagcccaucgaugaccgcuuugccaaugcucugcuugcccugaacgauaugggaaaggugagaaaagacauuccucaauggcagccguccaagggcuggcaugauuggcagcagguccccuucuguagccaccauuuccacgagcucaucaugaaagacgggcggaagcuggugguuccuugccgcccccaagacgaacuuauuggcagagcucggaucucucagggcgccggguggucccugcgcgagacagcuugucucggaaaagccuaugcgcagauguggagccugauguacuuucacagacgggaucugcgccucgccucuaaugcuauuugcuccgccgugccuguccauugggugcccacgagcagaaccacauggucuauccacgcccaucaccaauggaugaccacagaagacaugcugaccgucuggaaccggguguggaucgaggauaauccuuggauggaggacaagacgcccguuaccacaugggaaaacgugccguaccuuggcaagagagaggaucaguggugugggucccugauuggccucaccagccgcgcuacaugggcccagaauaucccuaccgcgauucagcaaguccggucccugaucggaaacgaagaguuccuugacuauaugcccagcaugaaaagauuucgcaaggaggaagagucugaaggcgcuauuugguga

SEQ ID NO: 20777 - RNA, 9873 nt, Artificial Sequence
  derived and/or modified CDS sequence (opt5) from DENV-3__FJ639775__SS-prME
accagccugugccucaugaugauccugcccgccgcucuugccuuccaccugacgucccgggacggcgaaccucggaugauuguggggaagaacgaacgcggaaagucucuccuguuuaagacggcgagcggcaucaauauguguacccuuauugcuauggaucugggggagaugugcgacgauacagugaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaacggcaagcgccucgagccgaauugggcuuccgucaaaaaggaccugauuagcuauggcgggggauggagacuuucugcccaguggcaaaaaggcgaagagguccaggugaucgcggucgaaccugggaagaaccccaaaaauuuccagaccaugccuggaacauuccagaccaccacaggcgagauuggggcuaucgcccuggauuuuaagcccggaacguccggcagccccaucauuaaccgggagggcaaggugguugggcuguacggaaauggcguggucaccaaaaacgggggauauguguccggcaucgcccaaacaaaugcugaaccugacgggccgacccccgagcucgaagaggaaauguucaagaaacgcaaccugacaauuauggaucuucacccuggcagcggaaagaccagaaaauaccugcccgccaucguucgggaggcuauuaagcgcagacuccggacgcugauccucgccccuacaagaguggucgcggccgagauggaagaggcucugaagggccuucccauccgcuaucagaccaccgccacaaaaucugaacauaccgggcgggagauuguggaccugaugugccacgcuacauuuaccaugagacugcucagcccuguucgcgugccgaauuacaaccugaucauuauggaugaagcccauuucacggaccccgccuccaucgcugcgcggggauacauuucuacaagagucggcaugggggaggccgcugccaucuuuaugaccgccacaccucccggaaccgcugaugccuucccucagagcaaugcgcccauccaggacgaggaacgcgacauuccggagcgguccuggaacucuggcaaugaauggaucacggauuuugcugggaagaccgugugguucgugccuagcauuaaagccggcaacgacaucgccaacugucuuagaaagaauggcaaaaaggucauucaacugucccgcaagacauuugauaccgaguaucagaaaacaaagcucaacgacugggauuucguugugaccacagacaucucugagaugggagcuaauuuuaaagccgaucgggugauugaccccagacggugccugaagcccgucauccugaccgaugggccugaacgcgugauccucgcgggacccaugccuguuacggccgcuagcgccgcucagagacggggccgcguggggagaaacccgcagaaagagaaugaccaauacauuuucacaggacagccccuuaacaaugaugaagaccacgcccauuggaccgaggcuaagaugcugcuggacaacaucaauaccccugaaggcauuauccccgcccucuucgagccugagcgggaaaaguccgcggccauugauggggaguauagacugaaaggcgaaagccgcaagacauuugucgagcuuaugcggagaggagaccugcccguguggcucgcucacaaaguugccucugaaggcaucaaguacaccgaucgcaaauggugcuucgacgggcagcggaacaaucagauccuggaggagaacauggauguggaaauuuggacaaaggagggagagaagaagaagcugagaccgcgcuggcucgacgcucggacguauuccgauccucuugcccugaaagaguuuaaggacuucgccgcuggcagaaaaagcaucgcgcuggaucucgucaccgaaauugggcgcgugcccucucaccuggcccauagaacacggaaugcucuugacaaccuggucaugcuccacaccuccgagcauggaggcaaggccuaccgccacgccguggaggaacugccugagacaauggaaacccugcuccuucugggccugaugauccuccugacagggggagcuaugcuuuuucugauuagcggcaaagggaucggaaagaccuccaucggccucauuuguguuaucgccucuagcgggaugcuguggauggcggagauuccccugcaauggaucgccuccgcuauugugcucgaguucuuuaugauggugcuucugaucccugaacccgagaagcagagaacaccgcaggauaaucaacuggccuaugucguuauuggaauccucacccuggcugccaucauugcggccaacgaaaugggccuucuggagacaaccaaacgggaccucggcaugagcaaggaaccugggguggugucucccacguccuaccuggaugucgaccugcaccccgcuagcgccuggacacucuacgcuguggccaccacaguuaucaccccuaugcuucgccauaccauugaaaauucuacagcuaacgugagccuggccgcgaucgccaaccaggcugucgugcugaugggacucgacaaaggcuggccgauuuccaagauggaucugggggucccccuucuggcccucggaugcuauucucaggugaauccucugacgcugaccgcugccguucuccuucugaucacacacuacgccaucauuggccccgggcugcaggcgaaagcuaccagagaggcccaaaagcggacagcugccggaaucaugaagaacccuaccguggacggcauuaugacgaucgaucucgaccccgucauuuaugauagcaaauucgagaagcagcugggccaggugaugcuucugguucucugugccgugcagcugcugcucaugagaacauccugggcucuuugcgaggcccugacccuggcgaccgggccuaucacaacccucugggaaggaucuccgggcaaauuuuggaauacaacgaucgccgucagcauggcuaacauuuuccgcggguccuaccuggccggagcuggccuugccuuuagcaucaugaagucuguggggaccggaaaacggggcacaggcucccaaggggagacccugggagaaaaguggaagaaaaagcucaaucagcugagcagaaaagaguucgaccuguauaagaaauccggcauuacagagguggaucgcaccgaagcgaaggaggggcucaaacggggagaaaucacgcaucacgccguuucuagaggcagcgcuaaacuucagugguuugucgagcggaacauggugauucccgaagggcgcgugaucgaccugggauguggcagaggcgggugguccuacuauugcgccggacugaagaaagucaccgagguucggggcuacacaaaagggggaccuggccaugaggaacccgugccuaugucuaccuacggguggaauauugugaaacucaugagcggaaaggaugucuucuaucugcccccggagaaaugugacacacuucugugcgauaucggcgaauccagcccuucucccaccguggaggagucccgcacaaucagaguucucaagaugguggaacccuggcugaagaacaaucaguucuguauuaaaguccugaacccuuacaugcccaccgugaucgagcaccucgaacggcuucaacgcaagcacggcgggaugcugguuagaaauccucugagccggaacucuacgcaugagauguauuggauuuccaauggaacaggcaacaucguggcuagcgucaauauggugucucgccuccugcuuaacagauuuaccaugacccaccggagaccgacaauugaaaaagacguggaucugggggccggaacgcgccaugucaacgcugagcccgagaccccuaauauggacguuaucggcgaacggaucaagagaauuaaagaggaacacaacagcacauggcacuacgacgaugagaaucccuauaagaccugggccuaccauggguccuaugaagugaaggcgacaggaucugccagcuccaugaucaacggcguggucaaacuccugaccaagccuugggacgugguucccauggugacacagauggcuaugaccgauacgaccccguucggccagcaacgcgucuuuaaagagaagguggacacacggaccccuagaagcaugcccgggacacgccgggccaugggaauuaccgcugaguggcuguggagaacgcucggccgcaauaaaaagccucggcugugcacaagagaagaguucaccaagaaaguucgcacaaacgccgccaugggggcgguguuuaccgaagagaaucagugggauuccgcuaaggccgccgucgaagacgaggauuucuggaaacuuguggaccgggagagagaacugcacaagcucggaaaauguggcucuugcguuuacaacaugauggggaagcgcgagaaaaagcugggcgaauuuggaaaggcuaaaggcagcagagccaucugguacauguggcuuggggcucgguaucuggaguucgaggcccucggauuucugaaugaagaucauugguucucccgcgagaacucuuacagcggcguggaaggggagggacugcacaagcucggcuauauucugagagacaucuccaaaauccccgggggcgcgauguacgccgaugacacggcuggaugggacacccggauuacagaagaugaccuucauaaugaggagaagaucacccagcagauggauccugaacacagacaacuggccaacgcuauuuuuaaacucacauaucagaauaaggucgugaagguccagcggcccaccccgacaggcaccgugauggacaucauuucucgcaaagaucagagagggagcggacaaguuggcacguacgggcugaacacauucaccaauauggaggcccagcuuauccggcagauggaaggagagggcgugcuguccaaggcggaccucgaaaacccucaucugcccgagaaaaagaucacccaguggcuggagacaaaaggggucgaacgccucaagagaauggccauuagcggcgaugacugcguggugaagcccaucgaugaccgguuugcuaacgcccugcuugcucugaaugauaugggaaaaguucgcaaggacauuccucaauggcagccgucuaaaggcuggcaugauuggcaacaggugcccuucuguucccaccauuuccacgagcucaucaugaaggacgggagaaaacuggucgugccuugccggccccaagacgaacuuauuggacgcgccagaaucagccagggcgcuggguggucucugcgggagaccgccugucucggaaaggcguaugcccagauguggucccugauguacuuucaccgcagagaucugcggcucgcuagcaacgccauuugcucugccguuccugugcauuggguccccacaucccgcacgaccuggagcauccacgcucaucaccaauggaugacaaccgaagacaugcugacaguguggaauagagucuggaucgaggauaacccuuggauggaggacaagacccccgugacgaccugggaaaauguuccguaccuuggcaaacgggaggaucaguggugugggucccugauuggccucacaagcagagccaccugggcgcagaacaucccuacagcuauucagcaagugcgcucucugaucggaaaugaagaguuccuugacuauaugcccagcaugaagcgguuuagaaaagaggaagaguccgaaggcgccauuugguga

SEQ ID NO: 20778 - RNA, 9873 nt, Artificial Sequence
  derived and/or modified CDS sequence (opt5) from DENV-3__FJ639777__SS-prME
accagccugugccucaugaugacgcugcccgccgcucuugccuuccaccugacgucccgggacggcgaaccucggaugaucguggggaagaaugaacgcggaaagucucuccuguuuaagaccgcgagcggcauuaauauguguacacuuaucgcuauggaucugggggaaaugugcgacgauaccgugacauacaaguguccgcacauuaccgaaguugagcccgaagacaucgauugcugguguaaccucacauccaccugggugacguauggaaccugcaaucaggccggcgagcacagacgggacaagcgcucuguggcccuggcuccucaugucgggaugggacuggauacaagaacccagacauggaugagcgccgagggcgcuuggagacagguggaaaagguugagaccugggcccuccgccaccccggcuucacgauucuggcgcuuuuucuggcccauuacaucgggacaucccucacccagaagguggucaucuucauucugcuuaugcuggugacaccuucuaugaccaugagauguguuggagugggcaaccgggacuuugucgaagggcucagcggagcuaccuggguggaugugguccuggagcacggcgggugcguuacaacgauggccaagaauaaacccacccuggacaucgagcuccagaagacagaagcuacccaacuggccacacuucgcaaacuguguauugagggaaagaucaccaacauuacgacagauuccagaugcccuacccagggcgaagcggugcucccggaggaacaggaccagaauuauguguguaaacacaccuacgucgaucggggcugggggaacggaugcggccuguucgggaagggaagccuugugacaugcgccaaguuucaaugucuggagcccaucgagggcaaaguugugcaguaugaaaaucucaaguacaccgucauuaucacagugcauacgggggaccagcaccagguuggaaacgagacccaaggcgugacagcugaaaucaccccucaggccucuacaaccgaggcuauucugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucaaaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagauguucccuguaaaaucccuuucagcacagaggacggccaagggaaggcccauaacggaagacugauuaccgcgaaucccguggucacgaaaaaggaggaacccgugaacaucgaggcugaaccuccguucggcgaguccaauauugugaucgggauuggcgauaacgcccugaaaaucaauugguauaagaagggaucuagcaucggcaaaauguuugaagccacagcuagaggggccagacgcauggcuauucuuggagacaccgccugggauuucggcuccguugggggaguccucaacagccugggcaagauggugcaccagaucuuugggucugcguacaccgcccuguucuccggcgugagcugggucaugaaaauuggaaucggcgugcuccugacauggauugggcuuaauucuaagaacaccagcauguccuuuucuugcaucgcuauuggaaucaucacacuguaucucggcgccguugugcaggcugacauggggugugucauuaauuggaaaggaaaggagcugaagugcggcagcgggaucuucgugacgaacgagguucauaccuggacagaacaguacaaauuucaagccgauucccccaagcggcuggcgaccgccauugcuggcgccugggagaauggaguguguggcaucagaagcacaacccgcauggaaaaccuucucuggaaacagauugcuaaugagcugaacuauauccugugggaaaauaacaucaagcucacggucgugguuggggacauuaucggagugcuggagcagggcaaacggacccuuacaccucagcccauggagcugaaguacucuuggaaaaccugggggaaggccaagauugucgccgcugaaacacaaaacuccagcuucaucauugauggaccuaauacccccgagugcccgucugcguccagagccuggaacgugugggaaguggaggacuauggcuuuggcgucuucacaaccaauaucuggcucaaacugcgcgaaguuuacacgcagcugugugaccaccggcuuaugagcgcugccgugaaggaugagagagccgugcacgcugacaugggguacuggaucgagucccagaaaaacggaucuuggaagcucgaaaaagccagccugauugaggucaagacaugcaccuggccuaagucccauacccuguggucuaauggcgugcucgaaagcgauaugaucauucccaaaucccuggcggggccuaucagccagcacaacuaucgccccggauaccauacacaaaccgcuggcccuuggcaccuugggaagcuggagcucgacuuuaauuauugcgagggaacgacaguugugauuaccgaaaacuguggcacacggggccccucucugagaaccacaaccgucuccgggaaacugauccacgaguggugcugucgcagcugcacgcuuccgccucuccgguacaugggagaagauggcuguugguaugggauggagaucagacccauuucugaaaaggaggagaauauggugaaaucccugguuagcgccggaucuggcgaaguggacaacuucaccauggggguccugugccucgccauccuguuugaggaagugaugcggggaaaacuuggcaagaaacauaugauugcuggcguuuucuucacauuugugcugcuccugagcgggcagaucaccuggcgcgauauggcccacacacugauuaugaucggauccaaugcgagcgacagaaugggcaugggggucaccuaccuugcucugauugccacguucaagauccagcccuuucucgcccugggauucuuucuccggaaacugacaucuagagagaaccuucugcucggcguggggcuggcuauggccaccacacugcaacuuccugaagauaucgagcagauggcuaauggaauugcccugggccucauggcgcugaagcucaucacccaguucgagaccuaucagcuguggacagcccuuauuucccugacguguagcaacaccaucuuuacacucaccguggcuuggcgcacagccacccugauucuggcuggcgucucccuucugccgguuugccaaucuagcuccaugcggaaaacggacuggcuccccaugacaguggccgccaugggggugccuccccugccucucuucaucuuuucucugaaggauacccuuaagagacgcagcuggccccugaaugaaggagucauggcugugggccugguuuccauccucgcgucuagccugcuuagaaacgacgugccuauggccgggccccuggucgcuggaggccuccugauugccuguuacgugaucaccgggacauccgccgaucucaccguugagaaagcugccgacgugacaugggaagaggaagcggagcagacgggagucagccauaaccugaugauuaccguggacgaugacggcacaaugcggaucaaggaugacgagaccgaaaauauucuuacaguccugcugaaaaccgcucuccugaucgugucuggcaucuucccguacuccauuccugccacgcuucugguuuggcacaccuggcagaagcagacacaacgcagcggggugcucugggauguccccucuccucccgagacccagaaagccgaacuggaggagggaguguauagaaucaagcagcagggcauuuuugggaaaacacaaguuggagugggcguccagaaggaagggguguuccauaccauguggcacgugacacggggagcuguucucacguacaacggcaagcgccuggagccgaauugggccuccgucaaaaaggaccuuaucagcuauggcgggggauggagacugaacgcgcaguggcaaaaaggcgaagagguccaggugauugcugucgaaccugggaagaaucccaaaaacuuucagaccaugccuggaacauuccagaccaccacaggcgagaucggggccauugcccuggauuucaagcccggaacgucuggcucccccaucaucaaucgggagggcaaggugguugggcucuacggaaacggcguggucaccaaaaaugggggauaugugagcggcauugcucaaacaaacgccgaaccugacgggccgacccccgagcuggaagaggaaauguuuaagaaacgcaaucuuacaaucauggaucugcacccuggcuccggaaagaccagaaaauaccuccccgcuauuguucgggaggccaucaagcgcagacugcggacgcucauucuggcgccuacaagaguggucgccgcugagauggaagaggcccuuaagggccugcccauccgcuaucagaccaccgcuacaaaaagcgaacauaccgggcgggagaucguggaccugaugugccacgccacauucaccaugagacuccugucuccuguucgcgugccgaacuacaaucuuauuaucauggaugaagcccauuuuacggaccccgcuagcauugcggcccggggauacaucuccacaagagucggcaugggggaggcugccgccauuuucaugaccgcuacaccucccggaaccgccgaugcguuuccucagucuaacgcucccauccaggacgaggaacgcgacaucccggagcggagcuggaacuccggcaacgaauggauuacggauuucgccgggaagaccgugugguuugugccuucuaucaaagccggcaacgacauugcuaauugucugagaaagaacggcaaaaaggucauccaacucagccgcaagacauucgauaccgaguaucagaaaacaaagcugaaugacugggauuuuguugugaccacagacauuuccgagaugggagccaacuucaaagcggaucgggugaucgaccccagacggugccugaagcccgucauucucaccgaugggccugaacgcgugauccuugccggacccaucccuguuacggcugccucugcugcccagagacggggccgcguggggagaaauccgcagaaagagaacgaccaauacauuuuuacaggacagccccugaauaacgaugaagaccacgcucauuggaccgaggccaagaugcugcucgacaauaucaacaccccugaaggcauuauccccgcgcuguucgagccugagcgggaaaagagcgccgcuauugauggggaguauagacuuaaaggcgaaucccgcaagacauucgucgagcugaugcggagaggagaccuccccguguggcuggcccacaaaguugcuagcgaaggcaucaaguacaccgaucgcaaauggugcuuugacgggcagcggaauaaccagauccuggaggagaauauggauguggaaauuuggacaaaggagggagagaagaagaagcucagaccgcgcuggcuugacgcccggacguauucugauccucuggcccugaaagaguucaaggacuuugcugcgggcagaaaauccaucgcccucgaucuggucaccgaaauugggcgcgugcccagccaccuugcucauagaacacggaacgcccuggacaaucucgucaugcugcacaccucugagcauggaggcaaggccuaccgccacgcuguggaggaacugccugagacaauggaaacccuccuucugcugggccucaugauccugcuuacagggggagccaugcuguuccucauuuccggcaaagggaucggaaagaccagcaucggccugauuuguguuaucgcguccucugggaugcuguggauggccgagauuccccuccaauggaucgcuagcgccauugugcuugaguuuuucaugauggugcugcugaucccugaacccgagaagcagagaacaccgcaggauaaccaacucgcuuaugucguuauuggaauccugacccuugccgcgaucauugccgcuaaugaaaugggccugcucgagacaaccaaacgggaccugggcauguccaaggaaccugggguggugagccccacgucuuaccuggaugucgaccuccaccccgccuccgcuuggacacuuuacgccguggcuaccacaguuaucaccccuaugcugcgccauaccauugagaacagcacagccaacgugucucuggcggccaucgcuaaucaggccgucgugcucaugggacuggacaaaggcuggccgauuagcaagauggaucuuggggucccccugcucgcucugggaugcuauucccaggugaacccucugacgcucaccgccgccguucuucugcugaucacacacuacgcgaucauuggccccgggcuccaggcuaaagccaccagagaggcucaaaagcggacagccgccggaaucaugaagaauccuaccguggacggcauuaugacgaucgaucuggaccccgucauuuaugauucuaaauuugaaaagcagcuuggccaggugaugcugcucguucugugugcugugcagcugcuccuuaugagaacaagcugggcccugugcgaggcgcugacccucgccaccgggccuaucacaacccugugggaaggauccccgggcaaauucuggaacacaacgaucgcugucucuauggccaauauuuuucgcgggagcuacaucgcuggagccggccuugcguucuccauuaugaaaagcguggggaccggaaaacggggcacaggcucucaaggggagacccugggagaaaaguggaagaaaaagcucaaccagcuguccagaaaagaguuugaccuguauaagaaaagcggcaucacagagguggaucgcaccgaagccaaggaggggcucaaacggggagaaauuacgcaucacgcuguuuccagaggcucugccaaacuucagugguucgucgagcggaauauggugacccccgaagggcgcgugaucgaccugggauguggcagaggcggguggagcuacuauugcgcuggacugaagaaagucacagagguucggggcuacaccaaagggggaccuggccaugaggaacccgugccuauguccacauacggguggaacauugugaaacucaugucuggaaaggaugucuuuuaucugcccccggagaaaugugacacccuucugugcgauaucggcgaaagcuccccuagccccacaguggaggagucucgcaccaucagaguucucaagaugguggaacccuggcugaagaauaaccaguucuguauuaaaguccugaauccuuacaugcccacggugaucgagcaccucgaacggcuucaacgcaagcacggcgggaugcugguuagauccccucugagccggaacucuacacaugagauguauuggauuuccaauggaaccggcaacaucguggccagcgucaauauggugucucgccuccugcuuaacagauucaccaugacacaccggagaccgacgauugaaaaagacguggaucugggggcuggaacccgccaugucaacgccgagcccgagacaccuaauauggacguuaucggcgaacggaucaagagaauuaaagaggaacacaacagcaccuggcacuacgacgaugagaaucccuauaagacaugggcguaccauggguccuaugaagugaaggccaccggaucugcuagcuccaugaucaacggcguggucaaacuccugacaaagccuugggacgugguucccauggugacccagauggccaugacggauaccacaccguuuggccagcaacgcgucuucaaagagaagguggacacccggacaccuagaagcaugcccgggacccgccggguuaugggaauuacggcugaguggcuguggagaacacucggccgcaauaaaaagccucggcugugcaccagagaagaguuuacaaagaaagugcgcaccaacgccgccaugggggcggucuucacggaagagaaucagugggauuccgcuaaggccgccguggaagacgaggauuuuuggaaacuuguugaccgggagagagaacugcaccgccucggaaaguguggcucuugcguguacaacaugauggggaaaagagagaagaaacugggcgaguucggaaaggcuaagggcagccgggccaucugguacauguggcuuggggcucgcuaucuggaguuugaggcccucggauuccugaaugaagaucauugguuuuccagagagaacucuuacagcggcgucgaaggggagggacugcacaaacucggcuauauucugcgggacaucuccaagauccccgggggcgcgauguacgccgaugacaccgcuggaugggacacaagaauuaccgaagaugaccuucauaaugaggagaaaaucacacagcagauggauccugaacaccggcaacuggccaacgcuauuuucaagcucaccuaucagaauaaaguggucaaggugcagcgccccacaccgaccggcacgguuauggacaucauuucuagaaaggaucagcgggggagcggacaagugggcacauacgggcugaacaccuuuaccaauauggaggcccagcuuauccgccagauggaaggagagggcguccuguccaaagcggaccucgaaaacccucaucugcccgagaagaaaaucacacaguggcuggagaccaaggggguggaaagacucaaacggauggccauuagcggcgaugacugcgugguuaagcccaucgaugaccgcuucgcuaacgcccugcuugcucugaaugauaugggaaaggugagaaaagacauuccucaauggcagccgucuaagggcuggcaugauuggcagcagguccccuuuuguucccaccauuuccacgagcucaucaugaaagacgggcggaagcuggugguuccuugccgcccccaagacgaacuuauuggacgggcccggaucagccagggcgcuggguggucucugcgcgagacagccugucucggaaaagcguaugcccagauguggucccugauguacuuccacagacgggaucugcgccucgcuagcaacgccauuugcucugccgugccuguccauugggugcccacguccagaaccacauggagcauccacgcucaucaccaauggaugaccacagaagacaugcugaccgucuggaaucggguguggaucgaggauaacccuuggauggaggacaagacgcccguuaccacaugggaaaaugugccguaccuuggcaagagagaggaucaguggugugggucccugauuggccucaccagccgcgccacaugggcgcagaacaucccuaccgcuauucagcaaguccggucucugaucggaaaugaagaguuucuugacuauaugcccagcaugaaaagauuccgcaaggaggaagaguccgaaggcgccauuugguga

SEQ ID NO: 20779 - RNA, 9873 nt, Artificial Sequence
  derived and/or modified CDS sequence (opt5) from DENV-3__FJ639778__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaagaauuacaaacaucaccacggauucccggugcccuacacagggcgaagcggugcucccggaggaacaggaccagaauuauguguguaagcacaccuacgucgaucgcggcugggggaacggaugcggccuguucgggaaaggaagccuugugaccugcgccaaguuucaaugucuggagcccauugagggcaagguugugcaguaugaaaaucucaaauacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccuagaacgggacuggacuucaaugagaugauucuucugaccaugaagaacaaagccuggaugguccaucggcagugguuuuucgaucucccccugccguggacaagcggcgccaccacagaaaccccuacguggaaucgcaaggagcuucuggugacauuuaaaaacgcucacgcgaagaaacaagaagucgugguucucgggucucaggagggagccaugcacaccgcucugacaggcgccaccgaaauccagaauuccgggggcaccagcauuuucgccggacaucugaaguguagacucaagauggacaaacuggagcuuaagggcaugucuuacgcuaugugcacaaacacguuugugcugaaaaaggaggucuccgaaacccagcacgggacaauccucaucaaaguggaguacaagggagaagauguucccuguaagauuccuuucagcaccgaggacggccaagggaaagcccauaacggacggcugaucacagcgaaucccguggucaccaagaaagaggaacccgugaacauugaggcugaaccuccguucggcgaguccaauauggugaucgggauuggcgauaacgcccugaagaucaauugguauaaaaagggaucuagcaucggcaagauguuugaagccacggcuagaggggcccgccggauggcuauucuuggagacacagccugggauuucggcuccguugggggaguccucaacagccugggcaaaauggugcaccagaucuuugggucugcguacaccgcccuguucuccggcgugagcugggucaugaagauuggaaucggcgugcuccugaccuggauugggcuuaauucuaaaaacacaagcauguccuuuucuugcaucgcuauuggaaucaucacccuguaucucggcgccguugugcaggcugacauggggugugucauuaauuggaagggaaaagagcugaagugcggcagcgggaucuucgugacaaacgagguucauacguggaccgaacaguacaaguuucaagccgauucccccaaaagacuggcgacagccauugcuggcgccugggagaauggaguguguggcauccgcagcaccacacggauggaaaaccuucucuggaagcagauugcuaaugagcugaacuauauccugugggaaaauaacaucaaacucaccgucgugguuggggacauuaucggagugcuggagcagggcaagagaacgcuuaccccucagcccauggagcugaaauacucuuggaagacaugggggaaagccaagauugucaccgccgaaacacaaaacuccagcuucaucauugauggaccuaauacccccgagugcccgucugcuucccgcgcguggaacgugugggaaguggaggacuauggcuuuggcgucuucacaaccaauaucuggcucaagcugcgggaaguuuacacgcagcugugugaccacagacuuaugagcgccgcugugaaagaugagcgcgccgugcacgccgacaugggguacuggaucgagucccagaagaacggaucuuggaaacucgaaaaggcuagccugauugaggucaaaacaugcaccuggccuaagucccauacccuguggucuaauggcgugcucgaaagcgauaugaucauucccaagucccuggccgggccuaucagccagcacaacuaucggcccggauaccauacacaaaccgcgggcccuuggcaccuugggaaacuggagcucgacuuuaauuauugcgagggaacgacaguugugauuaccgaaaacuguggcacaagaggccccucucugcgcaccacaaccgucuccgggaagcugauccacgaguggugcugucggagcugcacgcuuccgccucucagauacaugggagaagauggcuguugguaugggauggagauccggcccauuucugaaaaagaggagaauauggugaagucccugguuagcgcuggaucuggcgaaguggacaacuucaccauggggguccugugccucgccauccuguuugaggaagugaugcgcggaaaauucggcaagaagcauaugauugccggcguuuucuuuacauucgugcuucugcucagcgggcagaucaccuggagagauauggcucacacacugauuaugaucggauccaaugccagcgaccggaugggcaugggggucaccuaccuggcgcuuauugcuacguuuaaaauccagcccuuccuggcccucggauuuuuccugagaaagcucacaucucgcgagaaccugcuucugggcguggggcucgccauggcuaccacacugcaacugccugaagauaucgagcagauggccaauggaauugcucuuggccugauggcccucaaacugaucacccaguuugagaccuaucagcucuggacagcgcugauuucccuuacguguagcaacaccaucuucacacugaccguggccuggcggacagcuacccucauucuggccggcgucucccugcuuccgguuugccaaucuagcuccaugagaaagacggacuggcugcccaugacaguggcugccaugggggugccuccccucccucuguuuaucuucucucucaaagauacccugaagcgcagaagcuggccccuuaaugaaggagucauggccgugggccugguuuccauccuggcuucuagccuccugaagaacgacgugccuauggcggggccccuugucgccggaggccugcucauugcuuguuacgugaucaccgggacauccgccgaucugaccguugagaaagccgcugacgugacaugggaagaggaagccgagcagacgggagucagccauaaccucaugauuaccguggacgaugacggcacaaugcggaucaaggaugacgagaccgaaaauauucugacaguccuucugaaaaccgcgcugcucaucgugucuggcaucuuuccguacuccauuccugcuacgcugcuuguuuggcacaccuggcagaagcagacacaacgcagcggggugcugugggauguccccucuccucccgagacccagaaagccgaacucgaggagggaguguauagaaucaagcagcagggcauuuucgggaaaacacaaguuggagugggcguccagaaggaagggguguuucauaccauguggcacgugacacggggagccguucugacguacaacggcaagcgccucgagccgaauugggcuuccgucaaaaaggaccugaucagcuauggcgggggauggagacuuucugcccaguggcaaaaaggcgaagaggugcaggugauugcggucgaaccugggaagaaccccaaaaauuuccagaccaugccuggaacauuccagaccaccacaggcgagaucggggcuauugcccuggauuuuaagcccggaacguccggcagccccaucaucaaccgggagggcaaggugguugggcuguacggaaauggcguggucaccaaaaacgggggauauguguccggcauugcccaaacaaaugcugaaccugacgggccgacccccgagcucgaagaggaaauguucaagaaacgcaaccugacaaucauggaucuucacccuggcagcggaaagaccagaaaauaccugcccgccauuguucgggaggcuaucaagcgcagacuccggacgcugauucucgccccuacaagaguggucgcggccgagauggaagaggcucugaagggccuucccauccgcuaucagaccaccgccacaaaaucugaacauaccgggcgggagaucguggaccugaugugccacgcuacauuuaccaugagacugcucagcccuguucgcgugccgaauuacaaccugauuaucauggaugaagcccauuucacggaccccgccuccauugcugcgcggggauacaucucuacaagagucggcaugggggaggccgcugccauuuuuaugaccgccacaccucccggaaccgcugaugccuucccucagagcaaugcgcccauccaggacgaggaacgcgacaucccggagcgguccuggaacucuggcaaugaauggauuacggauuuugcugggaagaccgugugguucgugccuagcaucaaagccggcaacgacauugccaacugucuuagaaagaauggaaaaaaggucauccaacugucccgcaagacauuugauaccgaguaucagaaaacaaagcucaacgacugggauuucguugugaccacagacauuucugagaugggcgcuaauuuuaaagccgaucgggugaucgaccccagacggugccugaagcccgucauucugaccgaugggccugaacgcgugauccucgcgggacccaugccuguuacggccgcuagcgccgcucagagacggggccgcguggggagaaacccgcagaaagagaaugaccaauacaucuucacaggacagccccuuaacaaugaugaagaccacgcccauuggaccgaggcuaagaugcugcuggacaacauuaauaccccugaaggcaucauucccgcccucuucgagccugagcgggaaaaguccgcggccaucgauggggaguauagacugaaaggcgaaagccgcaagacauuugucgagcuuaugcggagaggagaccugcccguguggcucgcucacaaaguugccucugaaggcauuaaguacaccgaucgcaaauggugcuucgacgggcagcggaacaaucagauccuggaggagaacauggauguggaaaucuggacaaaggagggagaaaaaaagaagcugagaccgcgcuggcucgacgcucggacguauuccgauccucuugcccugaaagaguuuaaggacuucgccgcuggcagaaaaagcauugcgcuggaucucgucaccgaaaucgggcgcgugcccacacaccuggcccauagaacccggaaugcucuugacaaccuggucaugcuccacacaucugagcauggaggcaaggccuaccgccacgccguggaggaacugccugagaccauggaaacgcugcuccuucugggccugaugauucuccugaccgggggagcuaugcuuuuucugaucuccggcaaagggauuggaaagacaagcaucggccucaucuguguuauugccuccucugggaugcuguggauggcggagaucccccugcaauggauugccagcgcuaucgugcucgaguucuuuaugauggugcuucugauuccugaacccgagaagcagagaaccccgcaggauaaucaacuggccuaugucguuaucggaauucucacacuggcugccaucaucgcggccaacgaaaugggccuucuggagaccacgaaacgggaccucggcauguccaaggaaccugggguggugagccccacaucuuaccuggaugucgaccugcaccccgcuuccgccuggacccucuacgcuguggccacaaccguuauuaccccuaugcuucgccauacaaucgagaauagcacggcuaacgugucucuggccgcgauugccaaccaggcugucgugcugaugggacucgacaaaggcuggccgaucagcaagauggaucugggggucccccuucuggcccucggaugcuauucccaggugaauccucugacccugacagcugccguucuccuucugauuacccacuacgccaucaucggccccgggcugcaggcgaaagcuacaagagaggcccaaaagcggaccgcugccggaauuaugaagaacccuacgguggacggcaucaugacaauugaucucgaccccgucaucuaugauucuaaauucgaaaagcagcugggccaggugaugcuucugguucucugugccgugcagcugcugcucaugagaaccagcugggcucuuugcgaggcccugacccuggcgacagggccuauuaccacacucugggaaggauccccgggcaaauuuuggaauacgaccaucgccgucucuauggcuaacaucuuccgcgggagcuaccuggccggagcuggccuugccuuuuccauuaugaagagcguggggacaggaaaacggggcaccggcucucaaggggagacacugggagaaaaguggaagaaaaagcucaaucagcuguccagaaaagaguucgaccuguauaagaaaagcggcaucaccgagguggaucgcacggaagcgaaggaggggcuccggagaggagaaauuacccaucacgccguuucccggggcucugcuaaacuucagugguuugucgagcgcaacauggugauccccgaagggagagugauugaccugggauguggccggggcggguggagcuacuauugcgccggacugaagaaggucacagagguucgcggcuacaccaaagggggaccuggccaugaggaacccgugccuauguccacauacggguggaauaucgugaagcucaugucuggaaaagaugucuucuaucugcccccggagaagugugacacccuucugugcgauauuggcgaaagcuccccuagccccacaguggaggagucuagaaccauccggguucucaaaaugguggaacccuggcugaagaacaaucaguucuguaucaagguccugaacccuuacaugcccacggugauugagcaccucgaacgccuucaaagaaaacacggcgggaugcugguucggaauccucugucccgcaacagcacacaugagauguauuggaucucuaauggaaccggcaacauuguggcuuccgucaauauggugagcagacuccugcuuaaccgguuuaccaugacacacagacgcccgacgaucgaaaaggacguggaucugggggccggaacccggcaugucaacgcugagcccgagacaccuaauauggacguuauuggcgaaagaaucaaacgcaucaaggaggaacacaacucuaccuggcacuacgacgaugagaaucccuauaaaacaugggccuaccaugggagcuaugaagugaaggcgaccggauccgccucuagcaugauuaacggcguggucaagcuccugacaaaaccuugggacgugguucccauggugacccagauggcuaugacggauaccacaccguucggccagcaacgggucuuuaaggagaaaguggacaccagaacaccucgcuccaugcccgggacccggagaguuaugggaaucacggccgaguggcuguggcgcacacucggccggaauaagaaaccuagacugugcacccgcgaagaguucacaaagaaggugcggaccaacgcugccaugggggccgucuuuacggaagagaaucagugggauagcgcgaaagcugccguggaagacgaggauuucuggaagcuuguugacagagagcgcgaacugcacaaacucggaaaguguggcuccugcguguacaacaugauggggaaaagagagaagaaacugggcgaauuuggaaaggccaagggcucucgggcuauuugguacauguggcuuggggcccgcuaucuggaguucgaggcucucggauuucugaaugaagaucauugguucagcagagagaacuccuacucuggcgucgaaggggagggacugcacaaacucggcuauauccugcgggacauuagcaagauccccgggggcgccauguacgcggaugacaccgccggaugggacacaagaaucaccgaagaugaccuucauaaugaggagaaaauuacacagcagauggauccugaacaccggcaacuggcuaacgccaucuuuaagcucaccuaucagaauaaaguggucaaggugcagcgccccacaccgaccggcacgguuauggacauuaucuccagaaaggaucagcgggggucuggacaagugggcacauacgggcugaacaccuucaccaauauggaggcucagcuuauucgccagauggaaggagagggcguccugagcaaagccgaccucgaaaacccucaccugcccgagaagaaaaucacacaguggcuggagaccaaggggguggaaagacucaaacggauggcgaucuccggcgaugacugcgugguuaagcccauugaugaccgcuuugccaacgcucugcuugcccugaaugauaugggaaaggugagaaaagacaucccucaauggcagccgagcaagggcuggcaugauuggcagcagguccccuucuguucucaccauuuccacgagcucauuaugaaagacgggcggaagcuggugguuccuugccgcccccaagacgaacuuaucggaagagcucggauuucccagggcgccggguggagccugcgcgagacagcuugucucggaaaagccuaugcgcagauguggucucugauguacuuucacagacgggaucugcgccucgccuccaacgcuaucugcagcgccgugccuguccauugggugcccacgucuagaaccacaugguccauucacgcccaucaccaauggaugaccacagaagacaugcugaccgucuggaaucggguguggaucgaggauaacccuuggauggaggacaagacgcccguuaccacaugggaaaaugugccguaccuuggcaagagagaggaucaguggugugggagccugaucggccucaccucccgcgcuacaugggcccagaacauuccuaccgcgauccagcaaguccggagccugauuggaaaugaagaguuccuugacuauaugcccucuaugaaaagauuucgcaaggaggaagagagcgaaggcgcuaucugguga

SEQ ID NO: 20780 - RNA, 9873 nt, Artificial Sequence
  derived and/or modified CDS sequence (opt5) from DENV-3__FJ639779__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaaagaaaggcccauaacgggcggcugaucacagcgaaucccguggucaccaaaaaggaggaacccgugaacauugaggcugaaccuccguucggagaguccaauaucgugauuggcaucggggauaacgcccugaaaaucaauugguauaagaagggcucuagcauuggaaaaauguuugaagccacggcuagaggcgcccgccggauggcuauccuuggggacacagccugggauuucggauccguuggcgggguccucaacagccugggaaagauggugcaccagauuuuuggcucugcguacaccgcccuguucuccggggugagcugggucaugaaaaucggcauuggagugcuccugaccuggaucggccuuaauucuaagaacacaagcauguccuuuucuugcauugcuaucgggaucauuacccuguaucucggagccguugugcaggcugacaugggcugugucaucaauuggaaagggaaggagcugaagugcggaagcggcauuuucgugacaaacgagguucauacguggaccgaacaguacaaauuucaagccgauucccccaagagacuggcgacagccaucgcuggggccugggagaauggcguguguggaauucgcagcaccacacggauggaaaaccuucucuggaaacagaucgcuaaugagcugaacuauauccugugggaaaauaacauuaagcucaccgucgugguuggcgacaucauuggggugcuggagcagggaaaaagaacgcuuaccccucagcccauggagcugaaguacucuuggaaaacauggggcaaggccaagaucgucaccgccgaaacacaaaacuccagcuucauuaucgaugggccuaauacccccgagugcccgucugcuucccgcgcguggaacgugugggaaguggaggacuauggauuuggcgucuucacaaccaauaucuggcucaaacugcgggaaguuuacacgcagcugugugaccacagacuuaugagcgccgcugugaaggaugagcgcgccgugcacgccgacaugggcuacuggauugagucccagaaaaacgggucuuggaagcucgaaaaagcuagccugaucgaggucaagacaugcaccuggccuaagucccauacccuguggucuaauggagugcucgaaagcgauaugauuauccccaaaucccuggccggcccuauuagccagcacaacuaucggcccggguaccauacacaaaccgcgggaccuuggcaccuuggcaagcuggagcucgacuuuaauuauugcgaggggacgacaguugugaucaccgaaaacuguggaacaagaggccccucucugcgcaccacaaccgucuccggcaaacugauccacgaguggugcugucggagcugcacgcuuccgccucucagauacaugggggaagauggauguugguauggcauggagauucggcccaucucugaaaaggaggagaauauggugaaaucccugguuagcgcugggucuggagaaguggacaacuucaccaugggcguccugugccucgccauucuguuugaggaagugaugcgcgggaaguucggaaagaaacauaugaucgccggcguuuucuuuacauucgugcuucugcucagcggccagauuaccuggagagauauggcucacacacugaucaugauuggguccaaugccagcgaccggaugggaaugggcgucaccuaccuggcgcuuaucgcuacguuuaagauccagcccuuccuggcccucggguuuuuccugagaaaacucacaucucgcgagaaccugcuucugggagugggccucgccauggcuaccacacugcaacugccugaagauuuugagcagauggccaaugggauugcucuuggacugauggcccucaagcugaucacccaguucgagaccuaucagcucuggacagcgcugauuucccuuacguguagcaacaccaucuuuacacugaccguggccuggcggacagcuacccucauucuggccggcgucucccugcuuccgguuugccaaucuagcuccaugagaaaaacggacuggcugcccaugacaguggcugccaugggcgugccuccccucccucuguucaucuuuucucucaaggauacccugaagcgcagaagcuggccccuuaaugaaggggucauggccgugggacugguuuccauccuggcuucuagccuccugcggaacgacgugccuauggcgggcccccuugucgccgggggacugcucauugcuuguuacgugaucaccggcacauccgccgaucugaccguugagaaagccgcugacgugacaugggaagaggaagccgagcagacgggggucagccauaaccucaugauuaccguggacgaugacggaacaaugcgcaucaaggaugacgagaccgaaaauauucugacaguccuucugaaaaccgcgcugcucaucgugucuggcaucuucccguacuccauuccugcuacgcugcuuguuuggcacaccuggcagaagcagacacaaagaagcggcgugcugugggauguccccucuccucccgagacccagaaagccgaacucgaggaggggguguaucggaucaagcagcagggaauuuuuggcaaaacacaaguuggggugggaguccagaaggaaggcguguuccauaccauguggcacgugacacgcggggccguucugacguacaacggaaagagacucgagccgaauugggcuuccgucaaaaaggaccugaucagcuauggcggcggguggcggcuuucugcccaguggcaaaaaggagaagaggugcaggugauugcggucgaaccuggcaagaaccccaaaaauuuccagaccaugccugggacauuucagaccaccacaggagagaucggcgcuauugcccuggauuucaagcccgggacguccggaagccccaucaucaaccgcgagggcaaggugguuggccuguacgggaauggaguggucaccaaaaacggcggguauguguccggaauugcccaaacaaaugcugaaccugacggcccggcccccgagcucgaagaggaaauguuuaagaaaagaaaccugaccaucauggaucuucacccugggagcggcaagacacggaaauaccugcccgcuauuguucgcgaggccaucaagagacggcucagaacccugauucucgcgccuacgcgcguggucgccgcugagauggaagaggcccugaagggacuucccauccgguaucagacaaccgcuaccaaaucugaacauacaggcagagagaucguggaccugaugugccacgccaccuucacaaugcgccugcucagcccuguucgggugccgaauuacaaccugauuaucauggaugaagcccauuuuaccgaccccgcuuccauugcggccagaggguacaucucuacgcgcgucggaaugggcgaggcugccgccauuuucaugacagcuaccccucccgggacagccgaugcguuuccucagagcaaugcucccauccaggacgaggaacgggacaucccggagagauccuggaacucuggaaaugaauggauuaccgauuucgccggcaagacggugugguuugugccuagcaucaaagccgggaacgacauugcuaacugucuucgcaagaauggcaaaaaggucauccaacugucccggaagaccuucgauacagaguaucagaaaaccaagcucaacgacugggauuuuguugugacaaccgacauuucugagaugggagccaauuucaaagcggauagagugaucgacccccggcgcugccugaagcccgucauucugacagauggcccugaaagagugauccucgccgggcccaugccuguuaccgcugccagcgcugcccagcggcgcggaagagugggccggaacccgcagaaagagaaugaccaauacaucuucacggggcagccccuuaacaaugaugaagaccacgcucauuggacagaggccaagaugcugcuggacaacauuaauaccccugaaggaaucauucccgcgcucuuugagccugagagagaaaaguccgccgcuaucgauggcgaguaucgccugaaaggggaaagccggaagaccuucgucgagcuuaugagacgcggcgaccugcccguguggcucgcccacaaaguugcuucugaaggaauuaaguacacagaucggaaauggugcuuugacggccagagaaacaaucagauccuggaggagaacauggauguggaaaucuggaccaaggagggggaaaaaaagaagcugcgcccgcgguggcucgacgccagaacauauuccgauccucuugcccugaaagaguucaaggacuuugcugcgggacgcaaaagcauugcccuggaucucgucacggaaaucggcagagugcccacccaccuggcucaucggacacgcaaugcccuugacaaccuggucaugcuccacaccucugagcaugggggaaaggccuacagacacgcuguggaggaacugccugagacaauggaaacccugcuccuucugggccugaugauucuccugacgggcggggccaugcuuuuccugaucuccggaaaaggcauugggaagaccagcaucggacucaucuguguuauugcguccucuggcaugcuguggauggccgagaucccccugcaauggauugcuagcgccaucgugcucgaguuuuucaugauggugcuucugauuccugaacccgagaagcagcggacaccgcaggauaaucaacuggcuuaugucguuaucgggauucucacccuggccgcgaucaucgccgcuaacgaaaugggacuucuggagacaaccaaacgcgaccucggcauguccaaggaaccuggcguggugagccccacgucuuaccuggaugucgaccugcaccccgccuccgcuuggacacucuacgccguggcuaccacaguuauuaccccuaugcuuagacauaccaucgagaauagcacagccaacgugucucuggcggccauugcuaaccaggccgucgugcugauggggcucgacaaaggauggccgaucagcaagauggaucugggcgucccccuucuggcucucgggugcuauucccaggugaauccucugacgcugaccgccgccguucuccuucugauuacacacuacgcgaucaucggacccggccugcaggcuaaagccacccgggaggcucaaaagagaacagccgccgggauuaugaagaacccuaccguggacggaaucaugacgauugaucucgaccccgucaucuaugauucuaaauuugaaaagcagcugggccaggugaugcuucugguucucugugcugugcagcugcugcucaugcgcacaagcugggcccuuugcgaggcgcugacccuggccaccggcccuauuacaacccucugggaaggguccccgggaaaauucuggaauacaacgaucgcugucucuauggccaacaucuuucggggcagcuaccuggcuggggccggacuugcguucuccauuaugaagagcgugggcaccgggaaaagaggaacaggcucucaaggcgagacccugggggaaaaguggaagaaaaagcucaaucagcugucccgcaaagaguuugaccuguauaagaaaagcggaaucacagagguggaucggaccgaagccaaggagggccucaaaagaggggaaauuacgcaucacgcuguuucccggggaucugccaagcuucagugguucgucgagcgcaacauggugauccccgaaggcagagugauugaccugggguguggacggggcggcuggagcuacuauugcgcugggcugaagaaagucaccgagguucgcggauacacaaagggcgggccuggacaugaggaacccgugccuauguccaccuacggcuggaauaucgugaaacucaugucugggaaggaugucuucuaucugcccccggagaaaugugacacacuucugugcgauauuggagaaagcuccccuagccccaccguggaggagucuagaacaauccggguucucaagaugguggaacccuggcugaagaacaaucaguuuuguaucaaaguccugaacccuuacaugcccaccgugauugagcaccucgaacgccuucaaagaaagcacggcggcaugcugguucggaauccucugucccgcaacagcacgcaugagauguauuggaucucuaaugggacaggaaacauuguggccuccgucaauauggugagcagacuccugcuuaaccgguucaccaugacccacagacgcccgacaaucgaaaaagacguggaucugggcgcugggacgcggcaugucaacgccgagcccgagaccccuaauauggacguuauuggagaaagaaucaagcgcaucaaagaggaacacaacucuacauggcacuacgacgaugagaaucccuauaagaccugggcguaccauggcagcuaugaagugaaggccacaggguccgcuucuagcaugauuaacggaguggucaaacuccugaccaagccuugggacgugguucccauggugacacagauggccaugaccgauacgaccccguuuggccagcaacgggucuucaaagagaagguggacacaagaaccccucgcuccaugcccggcacacggagaguuauggggaucaccgcugaguggcuguggcgcacgcucggacggaauaaaaagccuagacugugcacacgcgaagaguuuaccaagaaagugcggacaaacgccgccaugggcgcggucuucaccgaagagaaucagugggauagcgcuaaggccgccguggaagacgaggauuuuuggaaacuuguugacagagagcgcgaacugcacaagcucgggaaauguggauccugcguguacaacaugaugggcaagagagagaaaaagcugggggaauucggcaaggcuaaaggaucucgggccauuugguacauguggcuuggcgcucgcuaucuggaguuugaggcccucggguuccugaaugaagaucauugguuuagcagagagaacuccuacucuggagucgaaggcgaggggcugcacaagcucggauauauccugcgggacauuagcaaaauccccggcggggcgauguacgccgaugacacggcuggcugggacaccagaaucacagaagaugaccuucauaaugaggagaagauuacccagcagauggauccugaacaccggcaacuggccaacgcuaucuucaaacucacauaucagaauaagguggucaaggugcagcgccccaccccgacaggaaccguuauggacauuaucuccagaaaagaucagcggggcucugggcaagugggaacguacggccugaacacauuuaccaauauggaggcccagcuuauucgccagauggaaggggagggaguccugagcaaggcggaccucgaaaacccucaccugcccgagaaaaagaucacccaguggcuggagacaaaaggcguggaaagacucaagcggauggccaucuccggggaugacugcgugguuaagcccauugaugaccgcuucgcuaacgcccugcuugcucugaaugauaugggcaaagugagaaaggacaucccucaauggcagccgagcaaaggauggcaugauuggcagcagguccccuucuguucucaccauuuucacgagcucauuaugaaggacggccggaaacuggugguuccuugccgcccccaagacgaacuuaucgggagagcccggauuucccagggagcuggcuggagccugcgcgagaccgccugucucgggaaggcguaugcccagauguggucucugauguacuuccacagacgggaucugcgccucgcuuccaacgccaucugcagcgccgugccuguccauugggugcccacaucuagaacgaccugguccauucacgcucaucaccaauggaugacaaccgaagacaugcugacagucuggaaucggguguggaucgaggauaacccuuggauggaggacaagacccccguuacgaccugggaaaaugugccguaccuuggaaaaagagaggaucagugguguggcagccugaucgggcucacaucccgcgccaccugggcgcagaacauuccuacagcuauccagcaaguccggagccugauuggcaaugaagaguuucuugacuauaugcccgccaugaagagauuccgcaaagaggaagagucugaaggagccaucugguga

SEQ ID NO: 20781 - RNA, 9873 nt, Artificial Sequence
  derived and/or modified CDS sequence (opt5) from DENV-3__FJ639780__SS-prME
acaagccugugccucaugaugauccugcccgccgcucuugccuuccaccugacauccagagacggagagccucggaugauuguggggaagaaugaaagaggaaaaucucuccuguuuaagacggcgagcggcaucaauauguguacccuuauugcuauggaucugggggagaugugcgacgauacagucaccuacaaauguccgcacaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggcggcaaguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcaccacaaccgaaacgccuacauggaaucggaaagagcuucuggugaccuuuaagaacgcccacgcuaaaaagcaagaagucgugguucucgggucucaggagggagcgaugcacacagcccugaccggcgcuaccgaaauccaaaauuccgggggcacaagcauuuucgccggacaucugaagugucgccucaaaauggacaagcuggagcuuaaaggcaugucuuacgccaugugcacgaacaccuuugugcugaagaaagaggucuccgaaacacagcacgggaccauccucaucaagguggaguacaagggagaagauguucccuguaaaauuccuuucagcacagaggacggccaagggaaggcucauaacggaagacugaucaccgccaaucccguggucacgaaaaaggaggaacccgugaacauugaggcggaaccuccguucggcgaguccaauaucgugauugggaucggcgauaacgcucugaaaaucaauugguauaagaagggaucuagcauuggcaaaauguuugaagccacagccagaggggcuagacgcauggccauccuuggagacaccgcuugggauuucggcuccguugggggaguccucaacagccugggcaagauggugcaccagauuuuugggucugccuacaccgcgcuguucuccggcgugagcugggucaugaaaaucggaauuggcgugcuccugacauggaucgggcuuaauucuaagaacaccagcauguccuuuucuugcauugccaucggaaucauuacacuguaucucggcgcuguugugcaggccgacauggggugugucaucaauuggaaaggaaaggagcugaagugcggcagcgggauuuucgugacgaacgagguucauaccuggacagaacaguacaaauuucaagcugauucccccaagcggcuggccaccgcgaucgccggcgcuugggagaauggaguguguggcauuagaagcacaacccgcauggaaaaccuucucuggaaacagaucgccaaugagcugaacuauauccugugggaaaauaacauuaagcucacggucgugguuggggacaucauuggagugcuggagcagggcaaacggacccuuacaccucagcccauggagcugaaguacucuuggaaaaccugggggaaggcuaagaucgucacagccgaaacccaaaacuccagcuucauuaucgauggaccuaauacacccgagugcccgaacgccucuagagcuuggaaugugugggaaguggaggacuauggcuuuggcgucuucaccacgaacaucuggcucaaacugcgcgaaguuuacacacagcugugugaccaccggcuuauguccgcggccgugaaggaugagagagcugugcacgccgacaugggguacuggauugagagccagaaaaauggauccuggaagcucgaaaaagccucucugaucgaggucaagaccugcaccuggccuaagagccauacacugugguccaacggcgugcucgaaucugauaugauuauccccaaaagccuggcugggccuauuucccagcacaauuaucgccccggauaccauacccaaacggccggcccuuggcaccuugggaagcuggagcucgacuuuaacuauugcgagggaacaaccguugugaucacagaaaauuguggcacccggggccccagccugagaacaaccacggucucugggaaacugauccacgaguggugcugucgcuccugcacccuuccgccucuccgguacaugggagaagauggcuguugguaugggauggagauuagacccaucagcgaaaaggaggagaacauggugaaaucucugguuuccgcgggaagcggcgaaguggacaauuucacaauggggguccugugccucgcuauucuguuugaggaagugaugcggggaaaguucggcaagaaacauaugaucgccggcguuuucuuuaccuucgugcuucugcucucugggcagauuacauggcgcgauauggcccacacccugaucaugauuggaagcaacgcuuccgacagaaugggcaugggggucacguaccuggcccuuaucgcgacauuuaagauccagcccuuccuggcucucggauuuuuccugcggaaacucaccagcagagagaaucugcuucugggcguggggcucgccauggccacaacccugcaacugccugaagauauugagcagauggcuaacggaaucgcccuuggccugauggcucucaagcugauuacccaguuugagacauaucagcucuggacggcccugaucucucuuaccuguuccaauacaauuuucacccugacaguggcguggcgcaccgccacgcucauccuggcuggcgucagccugcuuccgguuugccaauccucuagcaugcggaaaacagacuggcugcccaugaccguggccgcuauggggaucccuccccucccucuguuuauuuucucccucaaggauacccugaagagacgcucuuggccccuuaacgaaggagugauggccgucggccuggugagcauccuggccuccucucuccugagaaacgacguuccuauggcugggccccuuguggcgggaggccugcucauugccuguuacgucaucacagggaccagcgcugaucugacaguggagaaagccgccgacguuacgugggaagaggaagcugagcagaccggagugucccauaaucucaugauuacagucgacgaugacggcaccaugcggaucaaggaugacgagacagaaaacauccugaccgugcuucugaaaacggcccugcucauugucagcggcaucuuuccguacucuauuccugcgacccugcuuguguggcacacauggcagaagcagacccaacgcuccgggguucugugggaugugcccagcccucccgagacacagaaagcugaacucgaggagggagucuauagaaucaagcagcagggcauuuucgggaaaacccaagugggaguuggcgugcagaaggaaggggucuuucauacaauguggcacgugacgcggggagccgugcugaccuacaauggcaagcgccucgagccgaacugggccucuguuaaaaaggaccugaucuccuauggcgggggauggagacuuagcgcucaguggcaaaaaggcgaagagguccaggugauugccguggaaccugggaagaaucccaaaaacuuccagacaaugccuggaaccuuccagaccacaacgggcgagaucggggcgaucgcucuggauuuuaagcccggaaccucuggcucccccauuaucaaucgggagggcaaggucguggggcuguacggaaacggcguugugaccaagaaugggggauaugucagcggcauugcccaaaccaacgccgaaccugacgggccgacacccgagcucgaagaggaaauguucaagaaacgcaaucugaccaucauggaucuucacccuggcuccggaaagacgagaaaauaccugcccgcuauugugcgggaggccaucaagcgcagacuccggacacugauccucgcuccuaccagaguuguggccgcggagauggaagaggcccugaagggccuucccauucgcuaucagaccacagcuaccaaaagcgaacauacagggcgggagaucgucgaccugaugugccacgccaccuuuacgaugagacugcucucuccugugcgcguuccgaacuacaaucugauuaucauggaugaagcucauuucacagaccccgccagcauugccgcucggggauacaucuccaccagagugggcaugggggaggcggccgcuaucuuuaugacagccaccccucccggaacggccgaugcuuucccucagucuaacgcccccauucaggacgaggaacgcgacaucccggagcggagcuggaacuccggcaacgaauggauuaccgauuuugcggggaagacagucugguucgugccuucuaucaaagcuggcaacgacauugccaauugucuuagaaagaacggcaaaaaggugauccaacugagccgcaagaccuuugauacagaguaucagaaaaccaagcucaaugacugggauuucgucguuacaaccgacauuuccgagaugggagccaacuuuaaagcugaucgggugaucgaccccagacggugccugaagcccgugauccugacggaugggccugaacgcgucauucucgccggacccaugccugugacagcggccucugcugcccagagacggggccgcguugggagaaauccgcagaaagagaacgaccaauacaucuucaccggacagccccuuaauaacgaugaagaccacgcucauuggaccgaggccaagaugcugcuggacaauauuaacacaccugaaggcaucauucccgcucucuucgagccugagcgggaaaagagcgccgcgaucgauggggaguauagacugaaaggcgaaucccgcaagaccuuuguggagcuuaugcggagaggagaccugcccgucuggcucgcccacaaaguggcuagcgaaggcaucaaguacacagaucgcaaauggugcuucgacgggcagcggaauaaccagauucuggaggagaauauggauguugaaaucuggacgaaggagggagaacgcaagaaacugcgcccgcgguggcucgacgccagaaccuauucugauccucuugcucugaaagaguuuaaagacuucgccgccggccgcaaguccauugcucuggaucucgugacagaaaucgggagaguccccacccaccuggcgcaucggacacgcaacgcccuugacaaucuggugaugcuccacaccagcgagcauggaggcaaggcuuacagacacgccgucgaggaacugccugagacgauggaaacccugcuccuucugggccugaugauucuccugacagggggagccaugcuuuuucugaucucuggcaaggggaucggaaaaaccuccauuggccucaucugugugauugcuagcuccgggaugcuguggauggccgagaucccccugcaauggauugcgucugccaucguucucgaguucuuuaugauggugcuucugauuccugaacccgagaagcagcggacaccgcaggauaaccaacuggcuuauguggucaucggaauccucacccuggccgcuauuaucgccgcgaaugaaaugggccuucuggagacgacaaagcgcgaccucggcaugagcaaagaaccugggguugugucccccaccagcuaccuggauguggaccugcaccccgccucugcuuggacacucuacgccgucgcuaccaccgugauuacaccuaugcuuagacauacgaucgagaacuccaccgccaacguuagccuggcugccauugcgaaucaggccgugguccugaugggacucgacaagggcuggccgaucucuaaaauggaucugggggugccccuucuggcucucggaugcuauagccaggucaacccucugacacugaccgccgcugugcuccuucugaucacacacuacgccauuaucggccccgggcugcaggccaaggcgacccgggaggcucagaaacggacggccgcuggaauuaugaagaauccuacaguugacggcaucaugaccauugaucucgaccccgugaucuaugauuccaaguucgaaaaacagcugggccaggucaugcuucuggugcucugugccguucagcugcugcucaugcgcaccucuugggcccuuugcgaggcucugacacuggccaccgggccuaucacaacgcucugggaaggaagcccgggcaaguuuuggaacaccacaauugcgguguccauggccaauaucuuccgggggucuuaccuggcuggagccggccuugcuuuuagcauuaugaaauccgucgggaccggaaagagaggcacaggcagccaaggggagacccugggagaaaaauggaagaagaaacucaaccagcugucucgcaaggaguucgaccuguauaaaaaguccggcaucacggagguggaucggaccgaagccaaagaggggcucaagagaggagaaauuacacaucacgcggugagccggggcuccgccaaacuucagugguuuguugagcgcaauauggucauccccgaagggagagugauugaccugggauguggccggggcggguggucuuacuauugcgcuggacugaagaaggugaccgagguccgcggcuacacaaaagggggaccuggccaugaggaacccguuccuaugagcaccuacggguggaacaucgugaagcucauguccggaaaagauguguucuaucugcccccggagaagugugacacacuucugugcgauaucggcgaaucuagcccuucccccaccgucgaggagagcagaacgauucgggugcucaaaaugguugaacccuggcugaagaauaaccaguucuguaucaaggugcugaauccuuacaugcccgccgucauugagcaccucgaacgccuucaaagaaaacacggcgggaugcuggugcggaacccucugucucgcaauuccacacaugagauguauuggaucagcaacggaaccggcaauauuguugcuucugugaacauggucuccagacuccugcuuaaccgguuuaccaugacacacagacgcccgacgaucgaaaaggacguggaucugggggccggaacccggcaugugaaugcugagcccgagacaccuaacauggacgucaucggcgaaagaauuaaacgcaucaaggaggaacacaauagcaccuggcacuacgacgaugagaaccccuauaaaacaugggccuaccaugggucuuaugaaguuaaggcgaccggaagcgccuccucuaugauuaauggcguggugaagcuccugacaaaaccuugggacgucgugcccaugguuacccagauggcuaugacggauaccacaccguucggccagcaacggguguuuaaggagaaagucgacaccagaacaccucgcagcaugcccgggacccggagagugaugggaaucacggccgaguggcuguggcgcacacucggccggaacaagaaaccuagacugugcacccgcgaagaguucacaaagaagguucggaccaaugcugccaugggggccguguuuacggaagagaaccagugggauuccgcgaaagcugccgucgaagacgaggauuucuggaaacuuguggacagagagcgcgaacugcacaaacucggaaaguguggcagcugcguuuacaauaugauggggaaaagagagaagaaacugggcgaauuuggaaaggccaagggcucccgggcuauuugguacauguggcuuggggcccgcuaucuggaguucgaggcucucggauuucugaacgaagaucauugguucucuagagagaauagcuacuccggcguggaaggggagggacugcacaaacucggcuauauccugcgggacaucucuaagauucccgggggcgccauguacgcggaugacaccgccggaugggacacaagaaucaccgaagaugaccuucauaacgaggagaaaauuacacagcagauggauccugaacaccggcaacuggcuaaugccaucuuuaagcucaccuaucagaacaaagucgugaagguccagcgccccacaccgaccggcacggugauggacauuaucagcagaaaggaucagcggggguccggacaaguuggcacauacgggcugaauaccuucaccaacauggaggcucagcuuauccgccagauggaaggagagggcgugcugucuaaagccgaccucgaaaacccucaucugcccgagaagaaaauuacacaguggcuggagaccaagggggucgaaagacucaaacggauggcgaucagcggcgaugacugcguggugaagcccauugaugaccgcuuugccaaugcucugcuugcccugaacgauaugggaaagguuagaaaagacaucccucaauggcagccguccaagggcuggcaugauuggcaacaggugcccuucuguagccaccauuuccacgagcucauuaugaaagacgggcggaagcuggucgugccuugccgcccccaagacgaacuuaucggcagagcucggauuucucagggcgccggguggucccugcgcgagacagcuugucucggaaaagccuaugcgcagauguggagccugauguacuuucacagacgggaucugcgccucgccucuaaugcuaucugcuccgccguuccugugcauuggguccccacgagcagaaccacauggucuauccacgcccaucaccaauggaugaccacagaagacaugcugaccguguggaaccgggucuggauugaggauaauccuuggauggaggacaagacgcccgugaccacaugggaaaacguuccguaccuuggcaagagagaggaucaguggugugggucccugaucggccucaccagccgcgcuacaugggcccagaauauuccuaccgcgauccagcaagugcggucccugauuggaaacgaagaguuccuugacuauaugcccagcaugaaaagauuucgcaaggaggaagagucugaaggcgcuaucugguga

SEQ ID NO: 20782 - RNA, 9873 nt, Artificial Sequence
  derived and/or modified CDS sequence (opt5) from DENV-3__FJ639781__SS-prME
accagccugugccucaugaugauccugcccgcggcucuugccuuccaccugacaucccgggacggcgagccucggaugauuguggggaagaacgaacgcggaaagucucuccuguuuaagacggcgagcggcaucaauauguguacccuuauugcuauggaucugggggaaaugugcgacgauacagucaccuacaaguguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccaguacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcauggcgggugcguuaccacaauggccaagaauaaacccacgcuggacauugagcuccaaaagaccgaagcuacacagcuggccacccuucgcaaacuguguaucgagggaaagauuacaaacaucaccacggauuccagaugcccuacacagggcgaagcggugcucccggaggaacaggaccaaaauuauguguguaaacacaccuacgucgaucggggcugggggaacggaugcggccuguucgggaagggaagccuugugaccugcgccaaguuucagugucuggagcccauugagggcaaaguugugcaguaugaaaaucucaaguacacagucaucaucaccgugcacacaggggaccagcaucaaguuggaaacgagacgcagggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccacagacaaugguuuuucgaucucccccugccguggacaagcggcgccaccacagaaaccccuacguggaaucggaaagagcuucuggugacauuuaagaacgcucaugcgaaaaagcaggaagucgugguucucgggucucaggagggagccaugcacaccgcucugacaggcgccaccgaaauccaaaauuccgggggcaccagcauuuucgccggacaccugaagugucgccucaaaauggacaagcuggagcuuaaaggcaugucuuacgcuaugugcacaaacacguuugugcugaagaaagaggucuccgaaacccaacaugggacaauccucaucaagguggaguacaagggagaagauguucccuguaaaauuccuuucagcaccgaggacggccaggggaaggcccacaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggcuagacgcauggcuauccuuggagacacagccugggauuucggcuccguugggggaguccucaacagccugggcaagauggugcaucagauuuuugggucugcguacaccgcccuguucuccggcgugagcugggucaugaaaaucggaauuggcgugcuccugaccuggaucgggcuuaauucuaagaacauuagcauguccuuuucuugcaucgcuaucggaauuaucacacuguaucucggcgccguugugcaggcugacauggggugugucauuaauuggaaaggaaaggagcugaagugcggcagcgggaucuucgugaccaacgagguucacacauggacggaacaauacaaauuucaggccgauucccccaagcggcuggcgaccgccauugcuggcgccugggagaauggaguguguggcaucagaagcacaacccgcauggaaaaccuucucuggaaacagaucgcuaaugagcugaacuauauucugugggaaaauaacaucaagcucacagucgugguuggggacaccauuggagugcuggagcagggcaaacggacgcuuaccccucaacccauggagcugaaguacucuuggaaaacaugggggaaggccaagaucgucaccgccgaaacacagaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaucggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccacacccuguggucuaauggcgugcucgaaagcgauaugauuauccccaaaucccuggccgggccuauuagccaacauaacuaucgccccggauaccacacacagaccgcgggcccuuggcaucuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacacaugaucgccggcguuuucuuuacauucgcccuucugcucagcgggcagauuaccuggcgcgauauggcccauacacugaucaugauuggauccaaugcgagcgacagaaugggcaugggggugaccuaccuggcucuuaucgccacguuuaagauccaacccuuccuggcccucggauuuuuccugcggaaacucacaucuagagagaaccugcuucugggcgucgggcucgcuauggccaccacacugcagcugccugaagauauugagcagauggcuaauggaaucgcccuuggccugauggcgcucaagcugauuacccaguuugagaccuaucaacucuggacagcccugaucucccuuacguguagcaacaccauuuucacacugaccguggcuuggcgcacagccacccucauccuggcuggcgugucccugcuuccggucugccagucuagcuccaugcggaaaacggacuggcugcccaugacaguugccgccaugggggugccuccccucccucuguuuaucuucucucucaaggauacccugaagagacgcagcuggccccuuaaugaaggagugauggcugucggccugguguccauucuggcgucuagccuccugagaaacgacguuccuauggccgggccccuuguggcuggaggccugcucaucgccuguuacgucauuaccgggacauccgccgaucugaccguggagaaagcugccgacguuacaugggaagaggaagcggagcagacgggagugagccacaaccucaugaucaccgucgacgaugacggcacaaugcggauuaaggaugacgagaccgaaaauauccugacagugcuucugaaaaccgcucugcucaucgucucuggcauuuuuccguacuccaucccugccacgcugcuuguguggcauaccuggcagaagcaaacacagcgcagcgggguucugugggaugugcccucuccucccgagacccagaaagccgaacucgaggagggagucuauagaauuaagcagcaaggcaucuucgggaaaacacaggugggaguuggcgugcagaaggaaggggucuuucacaccauguggcaugugacacggggagcugugcugacguacaacggcaagcgccucgagccgaauugggccuccguuaaaaaggaccugauuagcuauggcgggggauggagacuuucugcgcaauggcagaaaggcgaagagguccaggugaucgcuguggaaccugggaagaaccccaaaaauuuccagaccaugccuggaacauuccaaaccaccacaggcgagauuggggccaucgcccuggauuuuaagcccggaacguccggcagccccaucauuaaccgggagggcaaggucguggggcuguacggaaauggcguugugaccaaaaacgggggauaugucuccggcaucgcucagacaaaugccgaaccugacgggccgacccccgagcucgaagaggaaauguucaagaaacgcaaccugacaauuauggaucuucacccuggcagcggaaagaccagaaaauaccugcccgcuaucgugcgggaggccauuaagcgcagacuccggacgcugauccucgcgccuacaagaguuguggccgcugagauggaagaggcccugaagggccuucccauccgcuaucagaccaccgcuacaaaaucugaacacaccgggcgggagauugucgaccugaugugccaugccacauuuaccaugagacugcucagcccugugcgcguuccgaauuacaaccugaucauuauggaugaagcccacuucacggaccccgcuuccaucgcggcccggggauacauuucuacaagagugggcaugggggaggcugccgccaucuuuaugaccgcuacaccucccggaaccgccgaugcguucccucagagcaaugcucccauccaagacgaggaacgcgacauuccggagcgguccuggaacucuggcaaugaauggaucacggauuuugccgggaagaccgucugguucgugccuagcauuaaagccggcaacgacaucgcuaacugucuuagaaagaauggcaaaaaggugauucagcugucccgcaagacauuugauaccgaguaucagaaaacaaagcucaacgacugggauuucgucguuaccacagacaucucugagaugggagccaauuuuaaagcggaucgggugauugaccccagacggugccugaagcccgugauccugaccgaugggccugaacgcgucauccucgccggacccaugccugugacggcugccagcgcugcccagagacggggccgcguugggagaaacccgcaaaaagagaaugaccaguacauuuucacaggacagccccuuaacaaugaugaagaccaugcucacuggaccgaggccaagaugcugcuggacaacaucaauaccccugaaggcauuauccccgcccucuucgagccugagcgggaaaaguccgccgcuauugauggggaguauagacugaaaggcgaaagccgcaagacauuuguggagcuuaugcggagaggagaccugcccgucuggcucgcccauaaaguggcuucugaaggcaucaaguacaccgaucgcaaauggugcuucgacgggcagcggaacaaucaaauccuggaggagaacauggauguugaaauuuggacaaaggagggagagaagaagaagcugagaccgcgcuggcucgacgcccggacguauuccgauccucuugcccugaaagaguuuaaggacuucgcugcgggcagaaaaagcaucgcccuggaucucgugaccgaaauugggcgcguccccacacaccuggcucacagaacccggaaugcccuugacaaccuggugaugcuccauacaucugagcacggaggcaaggccuaccgccaugcugucgaggaacugccugagaccauggaaacgcugcuccuucugggccugaugauccuccugaccgggggagccaugcuuuuucugauuuccggcaaagggaucggaaagacaagcaucggccucauuugugugaucgcguccucugggaugcuguggauggccgagauuccccugcaguggaucgcuagcgccauuguucucgaguucuuuaugauggugcuucugaucccugaacccgagaagcagagaaccccgcaagauaaucagcuggcuuauguggucauuggaauccucacacuggccgcgaccaucgccgcuaacgaaaugggccuucuggagacgacaaaacgggaccucggcauguccaaggaaccugggguugugagccccaccucuuaccuggauguggaccugcaccccgccuccgcuuggacacucuacgccgucgcuaccaccgugauuacaccuaugcuucgccacacgaucgagaauagcaccgccaacguuucucuggcggccauugcuaaccaggccgugguccugaugggacucgacaaaggcuggccgaucagcaagauggaucugggggugccccuucuggcucucggaugcuauucccaggucaauccucugacacugaccgccgccgugcuccuucugauuacacauuacgcgaucaucggccccgggcugcaagcuaaagccaccagagaggcucagaagcggacggccgccggaauuaugaagaacccuacaguugacggcaucaugaccauugaucucgaccccgugaucuaugauucuaaauucgaaaagcagcugggccaggucaugcuucuggugcucugugcuguucaacugcugcucaugagaaccagcugggcccuuugcgaggcgcugacacuggccaccgggccuauuacaacgcucugggaaggauccccgggcaaauuuuggaauaccacaaucgcugugucuauggccaacaucuuccgcgggagcuaccuggcuggagccggccuugcguuuuccauuaugaaaagcgucgggaccggaaaacggggcacaggcucucagggggagacccugggagaaaaguggaagaaaaagcucaaucagcuguccagaaaagaguucgaccuguauaagaaaagcggcaucacggagguggaucgcaccgaagccaaggaggggcucaaacggggagaaauuacacaccaugcuguguccagaggcucugccaaacuucagugguuuguugagcggaacauggucauccccgaagggcgcgugauugaccugggauguggcagaggcggguggagcuacuauugcgcuggacugaagaaagugaccgagguccggggcuacacaaaagggggaccuggccacgaggaacccguuccuauguccaccuacggguggaauaucgugaaacucaugucuggaaaggauguguucuaucugcccccggagaaaugugacacacuucugugcgauauuggcgaaagcuccccuagccccaccgucgaggagucucgcacgaucagagugcucaagaugguugaacccuggcugaagaacaaucaauucuguaucaaagugcugaacccuuacaugcccacagucauugagcaucucgaacggcuucagcgcaagcacggcgggaugcuggugagaaauccucugucccggaacagcacccacgagauguauuggaucucuaauggaaccggcaacauuguugccuccgugaauauggucagccgccuccugcuuaacagauuuacaaugacgcaucggagaccgaccaucgaaaaagacguggaucugggggcuggaacacgccacgugaacgccgagcccgagaccccuaauauggacgucauuggcgaacggaucaagagaaucaaagaggaacauaacucuacauggcacuacgacgaugagaaucccuauaagaccugggcguaccacgggagcuaugaaguuaaggccacaggauccgcuucuagcaugauuaacggcguggugaaacuccugaccaagccuugggacgucgugcccaugguuacgcagauggccaugaccgauacaaccccguucggccaacagcgcguguuuaaagagaaggucgacacacggaccccuagauccaugcccgggacgcgccgggugaugggaaucacagcugaguggcuguggagaacccucggccgcaauaaaaagccucggcugugcacaagagaagaguucaccaagaaaguucgcacgaacgccgccaugggggcgguguuuaccgaagagaaucagugggauagcgcuaaggccgccgucgaagacgaggauuucuggaaacuuguggaccgggagagagaacugcauaagcucggaaaauguggcuccugcguuuacaacaugauggggaagcgcgagaaaaagcugggcgaauuuggaaaggcuaaaggcucuagagccauuugguacauguggcuuggggcucgguaucuggaguucgaggcccucggauuucugaaugaagaucacugguucagccgcgagaacuccuacucuggcguggaaggggagggacugcauaagcucggcuauauccugagagacauuagcaaaauccccgggggcgcgauguacgccgaugacacagcuggaugggacacccggaucacagaagaugaccuucacaaugaggagaagauuacccagcaaauggauccugaacauagacagcuggccaacgcuaucuuuaaacucacauaucagaauaaggucgugaagguccagcggcccaccccgacgggcacagugauggacauuaucucccgcaaagaucaaagagggucuggacagguuggcaccuacgggcugaacaccuucacaaauauggaggcccagcuuauucggcagauggaaggagagggcgugcugagcaaggcggaccucgaaaacccucaucugcccgagaaaaagaucacccaauggcuggagacaaaaggggucgaacgccucaagagaauggccaucuccggcgaugacugcguggugaagcccauugaugaccgguuugcuaacgcccugcuugcucugaaugauaugggaaaaguucgcaaggacaucccucaguggcagccgagcaaaggcuggcacgauuggcagcaagugcccuucuguucucaucacuuccaugagcucauuaugaaggacgggagaaaacuggucgugccuugccggccccaggacgaacuuaucggacgcgccagaauuucccagggcgcuggguggagccugcgggagacggccugucucggaaaggcguaugcccaaauguggucucugauguacuuucaccgcagagaucugcggcucgcuuccaacgccaucugcagcgccguuccugugcacuggguccccaccucucgcacaaccugguccauucaugcucaccaucaguggaugacaaccgaagacaugcugacgguguggaauagagucuggaucgaggauaacccuuggauggaggacaagacccccgugacaaccugggaaaauguuccguaccuuggcaaacgggaggaucaguggugugggagccugaucggccucacauccagagccaccugggcgcagaacauuccuacggcuauccaacaggugcgcagccugauuggaaaugaagaguuccuugacuauaugcccucuaugaagcgguuuagaaaagaggaagagagcgaaggcgccaucugguga

SEQ ID NO: 20783 - RNA, 9873 nt, Artificial Sequence
  derived and/or modified CDS sequence (opt5) from DENV-3__FJ639782__SS-prME
accagccugugccucaugaugauccugcccgccgcucuugccuuccaccugacaucccgggacggcgagccucggaugauuguggggaagaacgaacgcggaaagucucuccuguuuaagacggcgagcggcaucaauauguguacccuuauugcuauggaucugggggaaaugugcgacgauacagugaccuacaaguguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaacggcaagcgccucgagccgaauugggcuuccgucaaaaaggaccugauuagcuauggcgggggauggagacuuucugcccaguggcaaaaaggcgaagagguccaggugaucgcggucgaaccugggaagaaccccaaaaauuuccagaccaugccuggaacauuccagaccaccacaggcgagauuggggcuaucgcccuggauuuuaagcccggaacguccggcagccccaucauuaaccgggagggcaagaucguggggcuguacggaaauggcguugugaccaaaaacgggggauaugucuccggcauugcccaaacaaaugcugaaccugacgggccgacccccgagcucgaagaggaaauguucaagaaacgcaaccugacaaucauggaucuucacccuggcagcggaaagaccagaaaauaccugcccgccauugugcgggaggcuaucaagcgcagacuccggacgcugauccucgccccuacaagaguuguggcggccgagauggaagaggcucugaagggccuucccauucgcuaucagaccaccgccacaaaaucugaacauaccgggcgggagaucgucgaccugaugugccacgcuacauuuaccaugagacugcucagcccugugcgcguuccgaauuacaaccugauuaucauggaugaagcccauuucacggaccccgccuccauugcugcgcggggauacaucucuacaagagugggcaugggggaggccgcugccaucuuuaugaccgccacaccucccggaaccgcugaugccuucccucagagcaaugcgcccauucaggacgaggaacgcgacaucccggagcgguccuggaacucuggcaaugaauggauuacggauuuugcugggaagaccgucugguucgugccuagcaucaaagccggcaacgacauugccaacugucuuagaaagaauggcaaaaaggugauccaacugucccgcaagacauuugauaccgaguaucagaaaacaaagcucaacgacugggauuucgucguuaccacagacauuucugagaugggagcuaauuuuaaagccgaucgggugaucgaccccagacggugccugaagcccgugauccugaccgaugggccugaacgcgucauucucgcgggacccaugccugugacggccgcuagcgccgcucagagacggggccgcguugggagaaacccgcagaaagagaaugaccaauacaucuucacaggacagccccuuaacaaugaugaagaccacgcccauuggaccgaggcuaagaugcugcuggacaacauuaauaccccugaaggcaucauucccgcccucuucgagccugagcgggaaaaguccgcggccaucgauggggaguauagacugaaaggcgaaagccgcaagacauuuguggagcuuaugcggagaggagaccugcccgucuggcucgcucacaaaguggccucugaaggcaucaaguacaccgaucgcaaauggugcuucgacgggcagcggaacaaucagauucuggaggagaacauggauguugaaaucuggacaaaggagggagagaagaagaagcugagaccgcgcuggcucgacgcucggacguauuccgauccucuugcccugaaagaguuuaaggacuucgccgcuggcagaaaaagcauugcgcuggaucucgugaccgaaaucgggcgcguccccacacaccuggcccauagaacccggaaugcucuugacaaccuggugaugcuccacacaucugagcauggaggcaaggccuaccgccacgccgucgaggaacugccugagaccauggaaacgcugcuccuucugggccugaugauucuccugaccgggggagcuaugcuuuuucugaucuccggcaaagggaucggaaagacaagcauuggccucaucugugugauugccuccucugggaugcuguggauggcggagaucccccugcaauggauugccagcgcuaucguucucgaguucuuuaugauggugcuucugauuccugaacccgagaagcagagaaccccgcaggauaaucaacuggccuauguggucaucggaauccucacacuggcugccaccauugcggccaacgaaaugggccuucuggagacgacaaaacgggaccucggcauguccaaggaaccugggguugugagccccaccucuuaccuggauguggaccugcaccccgcuuccgccuggacacucuacgcugucgccaccaccgugaucacaccuaugcuucgccauacgauugagaauagcaccgcuaacguuucucuggccgcgaucgccaaccaggcugugguccugaugggacucgacaaaggcuggccgauuagcaagauggaucugggggugccccuucuggcccucggaugcuauucccaggucaauccucugacacugaccgcugccgugcuccuucugaucacacacuacgccaucauuggccccgggcugcaggcgaaagcuaccagagaggcccaaaagcggacggcugccggaaucaugaagaacccuacaguugacggcauuaugaccaucgaucucgaccccgugauuuaugauucuaaauucgaaaagcagcugggccaggucaugcuucuggugcucugugccguucagcugcugcucaugagaaccagcugggcucuuugcgaggcccugacacuggcgaccgggccuaucacaacgcucugggaaggauccccgggcaaauuuuggaauaccacaaucgccgugucuauggcuaacauuuuccgcgggagcuaccuggccggagcuggccuugccuuuuccaucaugaaaagcgucgggaccggaaaacggggcacaggcucucaaggggagacccugggagaaaaguggaagaaaaagcucaaucagcuguccagaaaagaguucgaccuguauaagaaaagcggcauuacggagguggaucgcaccgaagcgaaggaggggcucaaacggggagaaaucacacaucacgccguguccagaggcucugcuaaacuucagugguuuguugagcggaacauggucauucccgaagggcgcgugaucgaccugggauguggcagaggcggguggagcuacuauugcgccggacugaagaaagugaccgagguccggggcuacacaaaagggggaccuggccaugaggaacccguuccuauguccaccuacggguggaauauugugaaacucaugucuggaaaggauguguucuaucugcccccggagaaaugugacacacuucugugcgauaucggcgaaagcuccccuagccccaccgucgaggagucucgcacgaucagagugcucaagaugguugaacccuggcugaagaacaaucaguucuguauuaaagugcugaacccuuacaugcccacagucaucgagcaccucgaacggcuucaacgcaagcacggcgggaugcuggugagaaauccucugucccggaacagcacccaugagauguauuggauuucuaauggaaccggcaacaucguugcuuccgugaauauggucagccgccuccugcuuaacagauuuacaaugacguaccggagaccgaccauugaaaaagacguggaucugggggccggaacacgccacgugaacgcugagcccgagaccccuaauauggacgucaucggcgaacggaucaagagaauuaaagaggaacauaacucuacauggcacuaugacgaugagaaucccuacaagaccugggccuaucacgggagcuacgaaguuaaggcgacaggauccgccucuagcaugaucaacggcguggugaaacuccugaccaagccuugggacgucgugcccaugguuacgcagauggcuaugaccgauacaaccccguucggccagcaacgcguguuuaaagagaaggucgacacacggaccccuagauccaugcccgggacgcgccgggugaugggaauuacagccgaguggcuguggagaacccucggccgcaauaaaaagccucggcugugcacaagagaagaguucaccaagaaaguucgcacgaacgcugccaugggggccguguuuaccgaagagaaucagugggauagcgcgaaggcugccgucgaagacgaggauuucuggaaacuuguggaccgggagagagaacugcauaagcucggaaaauguggcuccugcguuuacaacaugauggggaagcgcgagaaaaagcugggcgaauuuggaaaggccaaaggcucuagagcuaucugguauauguggcuuggggcccgguaccuggaguucgaggcucucggauuucugaaugaagaucacugguucagccgcgagaacuccuauucuggcguggaaggggagggacugcauaagcucggcuacauucugagagacaucagcaaaauccccgggggcgccauguaugcggaugacacagccggaugggacacccggauuacagaagaugaccuucacaaugaggagaagaucacccagcagauggauccugaacauagacaacuggcuaacgccauuuuuaaacucacauaccagaauaaggucgugaagguccagcggcccaccccgacgggcacagugauggacaucauuucccgcaaagaucagagagggucuggacaaguuggcaccuaugggcugaacaccuucacaaauauggaggcucagcuuauccggcagauggaaggagagggcgugcugagcaaggccgaccucgaaaacccucaucugcccgagaaaaagaucacccaguggcuggagacaaaaggggucgaacgccucaagagaauggcgauuuccggcgaugacugcguggugaagcccaucgaugaccgguuugccaacgcucugcuugcccugaaugauaugggaaaaguucgcaaggacauuccucaauggcagccgagcaaaggcuggcacgauuggcaacaggugcccuucuguucucaucacuuccaugagcucaucaugaaggacgggagaaaacuggucgugccuugccggccccaagacgaacuuauuggacgcgcuagaaucucccagggcgccggguggagccugcgggagacggcuugucucggaaaggccuacgcgcagauguggucucugauguacuuucaccgcagagaucugcggcucgccuccaacgcuauuugcagcgccguuccugugcacuggguccccaccucucgcacaaccugguccauccaugcccaccaucaauggaugacaaccgaagacaugcugacgguguggaauagagucuggaucgaggauaacccuuggauggaggacaagacccccgugacaaccugggaaaauguuccguaucuuggcaaacgggaggaucaguggugugggagccugauuggccucacauccagagcuaccugggcccagaacaucccuacggcgauucagcaagugcgcagccugaucggaaaugaagaguuccuugacuacaugcccucuaugaagcgguuuagaaaagaggaagagagcgaaggcgcuauuugguga

SEQ ID NO: 20784 - RNA, 9873 nt, Artificial Sequence
  derived and/or modified CDS sequence (opt5) from DENV-3__FJ639785__SS-prME
acaagccugugccucaugaugauccugcccgccgcucuugccuuccaccugacaucccgggacggagagccucggaugauuguggggaagaacgaacgcggaaagucucuccuguuuaagacggcgagcggcaucaauauguguacccuuauugcuauggaucugggggaaaugugcgacgauacagugaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacacgaucggagugcuggagcagggcaaacggacccuuacaccucagcccauggagcugaaguacucuuggaaaaccugggggaaggccaagauugucacagccgaaacccaaaacuccagcuucaucauugauggaccuaauacacccgagugcccgucugcuuccagagcguggaacgugugggaaguggaggacuauggcuuuggcgucuucaccacgaauaucuggcucaaacugcgcgaaguuuacacacagcugugugaccaccggcuuaugagcgccgcugugaaggaugagagagccgugcacgccgacaugggguacuggaucgagucccagaaaaacggaucuuggaagcucgaaaaagcuagccugauugaggucaagaccugcaccuggccuaagucccauacacuguggucuaauggcgugcucgaaagcgauaugaucauucccaaaucccuggccgggccuaucagccagcacaacuaucgccccggauaccauacccaaacggcgggcccuuggcaccuugggaagcuggagcucgacuuuaauuauugcgagggaacaaccguugugauuacagaaaacuguggcacccggggccccucucugagaacaaccacggucuccgggaaacugauccacgaguggugcugucgcagcugcacccuuccgccucuccgguacaugggagaagauggcuguugguaugggauggagaucagacccauuucugaaaaggaggagaauauggugaaaucccugguuagcgcuggaucuggcgaaguggacaacuucacaauggggguccugugccucgccauccuguuugaggaagugaugcggggaaaguucggcaagaaacauaugauugccggcguuuucuuuaccuucgugcuucugcucagcgggcagaucacauggcgcgauauggcucacacccugauuaugaucggauccaaugccagcgacagaaugggcaugggggucacguaccuggcgcuuauugcuacauuuaagauccagcccuuccuggcccucggauuuuuccugcggaaacucaccucuagagagaaccugcuucugggcguggggcucgccauggcuacaacccugcaacugccugaagauaucgagcagauggccaauggaauugcucuuggccugauggcccucaagcugaucacccaguuugagacauaucagcucuggacggcgcugauuucccuuaccuguagcaacacaaucuucacccugacaguggccuggcgcaccgcuacgcucauucuggccggcgucucccugcuuccgguuugccaaucuagcuccaugcggaaaacagacuggcugcccaugaccguggcugccaugggggugccuccccucccucuguuuaucuucucucucaaggauacccugaagagacgcagcuggccccuuaaugaaggagucauggccgugggccugguuuccauccuggcuucuagccuccugagaaacgacgugccuauggcggggccccuugucgccggaggccugcucauugcuuguuacgugaucacagggaccuccgccgaucugacaguugagaaagccgcugacgugacgugggaagaggaagccgagcagaccggagucagccauaaccucaugauuacaguggacgaugacggcaccaugcggaucaaggaugacgagacagaaaauauucugaccguccuucugaaaacggcgcugcucaucgugucuggcaucuuuccguacuccauuccugcuacccugcuuguuuggcacacauggcagaagcagacccaacgcagcggggugcugugggauguccccucuccucccgagacacagaaagccgaacucgaggagggaguguauagaaucaagcagcagggcauuuucgggaaaacccaaguuggagugggcguccagaaggaagggguguuucauacaauguggcacgugacgcggggagccguucugaccuacaacggcaagcgccucgagccgaauugggcuuccgucaaaaaggaccugaucagcuauggcgggggauggagacuuucugcccaguggcaaaaaggcgaagagguccaggugauugcggucgaaccugggaagaaccccaaaaauuuccagacaaugccuggaaccuuccagaccacaacgggcgagaucggggcuauugcccuggauuuuaagcccggaaccuccggcagccccaucaucaaccgggagggcaaggugguugggcuguacggaaauggcguggucaccaagaacgggggauauguguccggcauugcccaaaccaaugcugaaccugacgggccgacacccgagcucgaagaggaaauguucaagaaacgcaaccugaccaucauggaucuucacccuggcagcggaaagacgagaaaauaccugcccgccauuguucgggaggcuaucaagcgcagacuccggacacugauucucgccccuaccagaguggucgcggccgagauggaagaggcucugaagggccuucccauccgcuaucagaccacagccaccaaaucugaacauacagggcgggagaucguggaccugaugugccacgcuaccuuuacgaugagacugcucagcccuguucgcgugccgaauuacaaccugauuaucauggaugaagcccauuucacagaccccgccuccauugcugcgcggggauacaucucuaccagagucggcaugggggaggccgcugccauuuuuaugacagccaccccucccggaacggcugaugccuucccucagagcaaugcgcccauccaggacgaggaacgcgacaucccggagcgguccuggaacucuggcaaugaauggauuaccgauuuugcugggaagacagugugguucgugccuagcaucaaagccggcaacgacauugccaacugucuuagaaagaauggcaaaaaggucauccaacugucccgcaagaccuuugauacagaguaucagaaaaccaagcucaacgacugggauuucguugugacaaccgacauuucugagaugggagcuaauuuuaaagccgaucgggugaucgaccccagacggugccugaagcccgucauucugacggaugggccugaacgcgugauccucgcgggacccaugccuguuacagccgcuagcgccgcucagagacggggccgcguggggagaaacccgcagaaagagaaugaccaauacaucuucaccggacagccccuuaacaaugaugaagaccacgcccauuggaccgaggcuaagaugcugcuggacaacauuaauacaccugaaggcaucauucccgcccucuucgagccugagcgggaaaaguccgcggccaucgauggggaguauagacugaaaggcgaaagccgcaagaccuuugucgagcuuaugcggagaggagaccugcccguguggcucgcucacaaaguugccucugaaggcauuaaguacacagaucgcaaauggugcuucgacgggcagcggaacaaucagauccuggaggagaacauggauguggaaaucuggacgaaggagggagagaagaagaagcugagaccgcgcuggcucgacgcucggaccuauuccgauccucuugcccugaaagaguuuaaggacuucgccgcuggcagaaaaagcauugcgcuggaucucgucacagaaaucgggcgcgugcccacccaccuggcccauagaacacggaaugcucuugacaaccuggucaugcuccacaccucugagcauggaggcaaggccuaccgccacgccguggaggaacugccugagacgauggaaacccugcuccuucugggccugaugauucuccugacagggggagcuaugcuuuuucugaucuccggcaaagggauuggaaagaccagcaucggccucaucuguguuauugccuccucugggaugcuguggauggcggagaucccccugcaauggauugccagcgcuaucgugcucgaguucuuuaugauggugcuucugauuccugaacccgagaagcagagaacaccgcaggauaaucaacuggccuaugucguuaucggcauucucacccuggcugccacgaucgcggccaacgaaaugggccuucuggagacaaccaaacgggaccucggcauguccaaggaaccugggguggugagccccacaucuuaccuggaugucgaccugcaccccgcuuccgccuggacccucuacgcuguggccaccacaguuaucacgccuaugcuucgccauaccauugagaauagcacagcuaacgugucucuggccgcgaucgccaaccaggcugucgugcugaugggacucgacaaaggcuggccgauuagcaagauggaucugggggucccccuucuggcccucggaugcuauucccaggugaauccucugacccugacagcugccguucuccuucugaucacccacuacgccauuaucggccccgggcugcaggcgaaagcuacgagagaggcccaaaagcggacagcugccggaaucaugaagaacccuaccguggacggcauuaugaccaucgaucucgaccccgucauuuaugauucuaaauucgaaaagcagcugggccaggugaugcuucugguucucugugccgugcagcugcugcucaugagaacaagcugggcucuuugcgaggcccugacccuggcgacagggccuaucacgacccucugggaaggauccccgggcaaauuuuggaauacaaccauugccgucucuauggcuaacaucuuccgcgggagcuaccuggccggagcuggccuugccuuuuccaucaugaaaagcguggggacaggaaaacggggcaccggcucucaaggggagacgcugggagaaaaguggaagaaaaagcucaaucagcuguccagaaaagaguucgaccuguauaagaaaagcggcauuaccgagguggaucgcacagaagcgaaggaggggcucaaacggggagaaaucacccaucacgccguuuccagaggcucugcuaaacuucagugguuugucgagcggaacauggugauucccgaagggcgcgugaucgaccugggauguggcagaggcggguggagcuacuauugcgccggacugaagaaagucacagagguucggggcuacaccaaagggggaccuggccaugaggaacccgugccuauguccacauacggguggaauauugugaaacucaugucuggaaaggaugucuucuaucugcccccggagaaaugugacacccuucugugcgauaucggcgaaagcuccccuagccccacgguggaggagucucgcacaauuagaguucucaagaugguggaacccuggcugaagaacaaucaguucuguaucaaaguccugaacccuuacaugcccaccgugaucgagcaccucgaacggcuucaacgcaagcacggcgggaugcugguuagaaauccucugucccggaacagcacccaugagauguauuggauuucuaauggaacaggcaacaucguggcuuccgucaauauggugagccgccuccugcuuaacagauuuacgaugacccaccggagaccgacaauugaaaaagacguggaucugggggccggaacccgccaugucaacgcugagcccgagacaccuaauauggacguuaucggcgaacggauuaagagaaucaaagaggaacacaacucuaccuggcacuacgacgaugagaaucccuauaagacaugggccuaccaugggagcuaugaagugaaggcgaccggauccgccucuagcaugaucaacggcguggucaaacuccugacgaagccuugggacgugguucccauggugacccagauggcuaugacagauaccacaccguucggccagcaacgcgucuuuaaagagaagguggacacccggacgccuagauccaugcccgggacacgccggguuaugggaauuaccgccgaguggcuguggagaacacucggccgcaauaaaaagccucggcugugcaccagagaagaguucacgaagaaagugcgcaccaacgcugccaugggggccgucuuuacagaagagaaucagugggauagcgcgaaggcugccguggaagacgaggauuucuggaaacuuguugaccgggagagagaacugcacaagcucggaaaauguggcuccugcguguacaacaugauggggaagcgcgagaaaaagcugggcgaauuuggaaaggccaaaggcucuagagcuaucugguacauguggcuuggggcccgguaucuggaguucgaggcucucggauuucugaaugaagaucauugguucagccgcgagaacuccuacucuggcgucgaaggggagggacugcacaagcucggcuauauucugagagacaucagcaaaauucccgggggcgccauguacgcggaugacaccgccggaugggacacacggaucaccgaagaugaccuucauaaugaggagaagaucacacagcagauggauccugaacacagacaacuggcuaacgccauuuuuaaacucaccuaucagaauaagguggucaaggugcagcggcccacgccgacaggcaccguuauggacaucauuucccgcaaagaucagagagggucuggacaagugggcaccuacgggcugaacacauucaccaauauggaggcucagcuuauccggcagauggaaggagagggcguccugagcaaggccgaccucgaaaacccucaucugcccgagaaaaagauuacacaguggcuggagacgaaagggguggaacgccucaagagaauggcgaucuccggcgaugacugcgugguuaagcccaucgaugaccgguuugccaacgcucugcuugcccugaaugauaugggaaaagugcgcaaggacauuccucaauggcagccgagcaaaggcuggcaugauuggcagcagguccccuucuguucucaccauuuccacgagcucaucaugaaggacgggagaaaacuggugguuccuugccggccccaagacgaacuuauuggacgcgcuagaaucucccagggcgccggguggagccugcgggagaccgcuugucucggaaaggccuaugcgcagauguggucucugauguacuuucaccgcagagaucugcggcucgccuccaacgcuauuugcagcgccgugccuguccauugggugcccacaucucgcaccacaugguccauccacgcccaucaccaauggaugaccacggaagacaugcugaccgucuggaauagaguguggauugaggauaacccuuggauggaggacaagacacccguuaccacaugggaaaaugugccguaccuuggcaaacgggaggaucaguggugugggagccugaucggccucaccuccagagcuacgugggcccagaacaucccuacagcgauucagcaaguccgcagccugaucggaaaugaagaguuccuugacuauaugcccucuaugaagcgguuuagaaaagaggaagagagcgaaggcgcuauuugguga

SEQ ID NO: 20785 - RNA, 9873 nt, Artificial Sequence
  derived and/or modified CDS sequence (opt5) from DENV-3__FJ639786__SS-prME
acaagccugugccucaugaugauccugcccgccgcucuugccuuccaccugacaucccgggacggcgagccucggaugauuguggggaagaacgaacgcggaaaaucucuccuguuuaagacggcgagcggcaucaauauguguacccuuauugcuauggaucugggggaaaugugcgacgauacagugaccuacaaauguccgcacaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccgugggccagcggcgcuacaaccgaaacaccuaccuggaaucggaaagagcuucuggugacguuuaagaacgcgcacgccaaaaagcaagaagucgugguucucgggucucaggagggagcuaugcacacagcccugaccggcgccacagaaauccaaaauuccgggggcaccagcauuuucgcuggacaucugaagugucgccucaaaauggacaagcuggagcuuaaaggcaugucuuacgccaugugcaccaacacauuugugcugaagaaagaggucuccgaaacgcagcacgggaccauccucaucaagguggaguacaagggagaagauguucccuguaaaauuccuuucagcacagaggacggccaagggaaggcgcauaacggaagacugaucaccgcuaaucccguggucaccaagaaggaggaacccgugaacauugaggccgaaccuccguucggcgaguccaauaucgugauugggaucggcgauaacgcccugaaaaucaauugguauaagaagggaucuagcauuggcaaaauguuugaagcuaccgccagaggggcuagacgcauggccauccuuggagacacggcgugggauuucggcuccguugggggaguccucaacagccugggcaagauggugcaccagauuuuugggucugccuacacagcucuguucuccggcgugagcugggucaugaaaaucggaauuggcgugcuccugaccuggaucgggcuuaauucuaagaacaccagcauguccuuuucuugcauugccaucggaaucauuacacuguaucucggcgcuguugugcaggccgacauggggugugucaucaauuggaaaggaaaggagcugaagugcggcagcgggauuuucgugaccaacgagguucauacauggacggaacaguacaaauuucaagcggauucccccaagcggcuggccaccgcuaucgccggcgcuugggagaauggaguguguggcauuagaagcacaacccgcauggaaaaccuucucuggaaacagaucgccaaugagcugaacuauauccugugggaaaauaacauuaagcucacagucgugguuggggacaucauuggagugcuggagcagggcaaacggacccuuacgccucagcccauggagcugaaguacucuuggaaaaccugggggaaggccaagaucgucacagcugaaacccaaaacuccagcuucauuaucgauggaccuaauacacccgagugcccgucugcguccagagccuggaacgugugggaaguggaggacuauggcuuuggcgucuucaccacaaauaucuggcucaaacugcgcgaaguuuacacccagcugugugaccaccggcuuaugagcgcugccgugaaggaugagagagccgugcacgcugacaugggguacuggauugagucccagaaaaacggaucuuggaagcucgaaaaagccagccugaucgaggucaagacgugcacauggccuaagucccauacccuguggucuaauggcgugcucgaaagcgauaugauuauccccaaaucccuggcggggccuauuagccagcacaacuaucgccccggauaccauacccaaacagcuggcccuuggcaccuugggaagcuggagcucgacuuuaauuauugcgagggaaccacgguugugaucacagaaaacuguggcacccggggccccucucugagaacaaccacagucuccgggaaacugauccacgaguggugcugucgcagcugcacccuuccgccucuccgguacaugggagaagauggcuguugguaugggauggagauuagacccaucucugaaaaggaggagaauauggugaaaucccugguuagcgccggaucuggcgaaguggacaacuucacgauggggguccugugccucgccauucuguuugaggaagugaugcggggaaaguucggcaagaaacauaugaucgcuggcguuuucuuuaccuucgugcuucugcucagcgggcagauuacauggcgcgauauggcccacacccugaucaugauuggauccaaugcgagcgacagaaugggcaugggggucacauaccuggcucuuaucgccaccuuuaagauccagcccuuccuggcccucggauuuuuccugcggaaacucacgucuagagagaaccugcuucugggcguggggcucgcuauggccacaacccugcaacugccugaagauauugagcagauggcuaauggaaucgcccuuggccugauggcgcucaagcugauuacacaguuugagaccuaucagcucuggaccgcccugaucucccuuacauguagcaacacgauuuucacccugacaguggcuuggcgcaccgccacacucauccuggcuggcgucucccugcuuccgguuugccaaucuagcuccaugcggaaaaccgacuggcugcccaugacgguggccgccaugggggugccuccccucccucuguuuaucuucucucucaaggauacacugaagagacgcagcuggccccuuaaugaaggagucauggcugugggccugguuuccauucuggcgucuagccuccugagaaacgacgugccuauggccgggccccuugucgcuggaggccugcucaucgccuguuacgugauuaccgggaccuccgccgaucugacaguugagaaagcugccgacgugaccugggaagaggaagcggagcagacaggagucagccauaaccucaugaucacgguggacgaugacggcaccaugcggauuaaggaugacgagacagaaaauauccugaccguccuucugaaaacagcucugcucaucgugucuggcauuuuuccguacuccaucccugccacccugcuuguuuggcacacguggcagaagcagacccaacgcagcggggugcugugggauguccccucuccucccgagacacagaaagccgaacucgaggagggaguguauagaauuaagcagcagggcaucuucgggaaaacccaaguuggagugggcguccagaaggaagggguguuucauacaauguggcacgugacccggggagcuguucugacauacaacggcaagcgccucgagccgaauugggccuccgucaaaaaggaccugauuagcuauggcgggggauggagacuuucugcgcaguggcaaaaaggcgaagagguccaggugaucgcugucgaaccugggaagaaccccaaaaauuuccagacgaugccuggaaccuuccagacaaccaccggcgagauuggggccaucgcccuggauuuuaagcccggaacauccggcagccccaucauuaaccgggagggcaaggugguugggcuguacggaaauggcguggucacgaaaaacgggggauauguguccggcaucgcucaaaccaaugccgaaccugacgggccgacacccgagcucgaagaggaaauguucaagaaacgcaaccugaccauuauggaucuucacccuggcagcggaaagacaagaaaauaccugcccgcuaucguucgggaggccauuaagcgcagacuccggacccugauccucgcgccuacgagaguggucgccgcugagauggaagaggcccugaagggccuucccauccgcuaucagacaaccgcuaccaaaucugaacauacagggcgggagauuguggaccugaugugccacgccaccuuuacaaugagacugcucagcccuguucgcgugccgaauuacaaccugaucauuauggaugaagcccauuucaccgaccccgcuuccaucgcggcccggggauacauuucuacgagagucggcaugggggaggcugccgccaucuuuaugacagcuaccccucccggaacagccgaugcguucccucagagcaaugcucccauccaggacgaggaacgcgacauuccggagcgguccuggaacucuggcaaugaauggaucaccgauuuugccgggaagacggugugguucgugccuagcauuaaagccggcaacgacaucgcuaacugucuuagaaagaauggcaaaaaggucauucaacugucccgcaagaccuuugauacagaguaucagaaaaccaagcucaacgacugggauuucguugugacaaccgacaucucugagaugggagccaauuuuaaaacagaucgggugauugaccccagacggugccugaagcccgucauccugaccgaugggccugaacgcgugauccucgcgggacccaugccuguuacggccgcuagcgccgcucagagacggggccgcguggggagaaacccgcagaaagagaaugaccaauacauuuucacaggacagccccuuaacaaugaugaagaccacgcccauuggaccgaggcuaagaugcugcuggacaacaucaauaccccugaaggcauuauccccgcccucuucgagccugagcgggaaaaguccgcggccauugauggggaguauagacugaaaggcgaaagccgcaagacauuugucgagcuuaugcggagaggagaccugcccguguggcucgcucacaaaguugccucugaaggcaucaaguacaccgaucgcaaauggugcuucgacgggcagcggaacaaucagauccuggaggagaacauggauguggaaauuuggacaaaggagggagagaagaagaagcugagaccgcgcuggcucgacgcucggacguauuccgauccucuugcccugaaagaguuuaaggacuucgccgcuggcagaaaaagcaucgcgcuggaucucgucaccgaaauugggcgcgugcccacacaccuggcccauagaacccggaaugcucuugacaaccuggucaugcuccacacaucugagcauggaggcaaggccuaccgccacgccguggaggaacugccugagaccauggaaacgcugcuccuucugggccugaugauccuccugaccgggggagcuaugcuuuuucugauuuccggcaaagggaucggaaagacaagcaucggccucauuuguguuaucgccuccucugggaugcuguggauggcggagauuccccugcaauggaucgccagcgcuauugugcucgaguucuuuaugauggugcuucugaucccugaacccgagaagcagagaaccccgcaggauaaucaacuggccuaugucguuauuggaauccucacacuggcugccaucauugcggccaacgaaaugggccuucuggagaccacgaaacgggaccucggcauguccaaggaaccugggguggugagccccacaucuuaccuggaugucgaccugcaccccgcuuccgccuggacccucuacgcuguggccacaaccguuaucaccccuaugcuucgccauacaauugagaauagcacggcuaacgugucucuggccgcgaucgccaaccaggcugucgugcugaugggacucgacaaaggcuggccgauuagcaagauggaucugggggucccccuucuggcccucggaugcuauucccaggugaauccucugacccugacagcugccguucuccuucugaucacccacuacgccaucauuggccccgggcugcaggcgaaagcuacaagagaggcccaaaagcggaccgcugccggaaucaugaagaacccuacgguggacggcauuaugacaaucgaucucgaccccgucauuuaugauucuaaauucgaaaagcagcugggccaggugaugcuucugguucucugugccgugcagcugcugcucaugagaaccagcugggcucuuugcgaggcccugacccuggcgacagggccuaucaccacacucugggaaggauccccgggcaaauuuuggaauacgaccaucgccgucucuauggcuaacauuuuccgcgggagcuaccuggccggagcuggccuugccuuuuccaucaugaaaagcguggggacaggaaaacggggcaccggcucucaaggggagacacugggagaaaaguggaagaaaaagcucaaucagcuguccagacgcgaguucgaccuguauaaaaagagcggcauuaccgagguggaucggacggaagcgaaagaggggcucaagagaggagaaaucacccaucacgccguuucccggggcucugcuaaacuucagugguuugucgagcgcaacauggugauucccgaagggagagugaucgaccugggauguggccggggcggguggagcuacuauugcgccggacugaagaaggucacagagguucgcggcuacaccaaagggggaccuggccaugaggaacccgugccuauguccacauacggguggaauauugugaagcucaugucuggaaaagaugucuucuaucugcccccggagaagugugacacccuucugugcgauaucggcgaaagcuccccuagccccacaguggaggagucuagaaccauccggguucucaaaaugguggaacccuggcugaagaacaaucaguucuguauuaagguccugaacccuuacaugcccacggugaucgagcaccucgaacgccuucaaagaaaacacggcgggaugcugguucggaauccucugucccgcaacagcacacaugagauguauuggauuucuaauggaaccggcaacaucguggcuuccgucaauauggugagcagacuccugcuuaaccgguuuaccaugacacacagacgcccgacgauugaaaaggacguggaucugggggccggaacccggcaugucaacgcugagcccgagacaccuaauauggacguuaucggcgaaagaaucaaacgcauuaaggaggaacacaacucuaccuggcacuacgacgaugagaaucccuauaaaacaugggccuaccaugggagcuaugaagugaaggcgaccggauccgccucuagcaugaucaacggcguggucaagcuccugacaaaaccuugggacgugguucccauggugacccagauggcuaugacggauaccacaccguucggccagcaacgggucuuuaaggagaaaguggacaccagaacaccucgccccaugccugggacccggagaguuaugggaauuacggccgaguggcuguggcgcacacucggccggaauaagaaacccagacugugcacccgcgaagaguucacaaagaaggugcggaccaacgcugccaugggggccgucuuuacggaagagaaucagugggauuccgcgaaagcugccguggaagacgaggauuucuggaaacuuguugacagagagcgcgaacugcacaaacucggaaaguguggcagcugcguguacaacaugauggggaaaagagagaagaaacugggcgaauuuggaaaggccaagggcucccgggcuaucugguacauguggcuuggggcccgcuaucuggaguucgaggcucucggauuucugaaugaagaucauugguucucuagagagaacagcuacuccggcgucgaaggggagggacugcacaaacucggcuauauucugcgggacaucucuaagaucccugggggcgccauguacgcggaugacaccgccggaugggacacaagaauuaccgaagaugaccuucauaaugaggagaaaaucacacagcagauggaucccgaacaccggcaacuggcuaacgccauuuuuaagcucaccuaucagaauaaaguggucaaggugcagcgcccgacaccuaccggcacgguuauggacaucauuagcagaaaggaucagcggggguccggacaagugggcacauacgggcugaacaccuucaccaauauggaggcucagcuuauccgccagauggaaggagagggcguccugucuaaagccgaccucgaaaacccccaucugcccgagaagaaaaucacacaguggcuggagaccaaggggguggaaagacucaaacggauggcgauuagcggcgaugacugcgugguuaagccuaucgaugaccgcuuugccaacgcucugcuugcccugaaugauaugggaaaggugagaaaagacauuccgcaauggcagcccuccaagggcuggcaugauuggcagcaggucccuuucuguagccaccauuuccacgagcucaucaugaaagacgggcggaagcuggugguucccugccgcccucaagacgaacuuauuggacgggcucggaucucucagggcgccggguggucccugcgcgagacagcuugucucggaaaagccuaugcgcagauguggagccugauguacuuucacagacgggaucugcgccucgccucuaacgcuauuugcuccgccgugcccguccauugggugccuacgagcagaaccacauggucuauccacgcccaucaccaauggaugaccacagaagacaugcugaccgucuggaaucggguguggaucgaggauaaccccuggauggaggacaagacgccgguuaccacaugggaaaaugugccuuaccuuggcaagagagaggaucaguggugugggucccugauuggccucaccagccgcgcuacaugggcccagaacaucuccaccgcgauucagcaaguccggagccugaucggaaaugaagaguuccuugacuauaugcccucuaugaaaagauuucgcaaggaggaagagagcgaaggcgcuauuugguga

SEQ ID NO: 20786 - RNA, 9873 nt, Artificial Sequence
  derived and/or modified CDS sequence (opt5) from DENV-3__FJ639787__SS-prME
acaagccugugccugaugaugauccugcccgccgcucuugccuuccaccugacaucccgggacggagagccucggaugauuguggggaagaacgaacgcggaaagucucuccuguuuaagacggcgagcggcaucaauauguguacccuuauugcuauggaucugggggaaaugugcgacgauacagugaccuacaaguguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggcucagcgccgagggcgcuuggagacagguggaaaaaguugagacaugggcccugcgccaccccggcuucaccauccuugcgcuguuucucgcccauuacaucgggacgucccugacacagaagguggucauuuucauccuucugaugcucgugaccccuucuaugacaaugagauguguuggagugggcaaccgggacuuugucgaagggcugagcggagcuaccuggguggaugugguccuggagcacggcgggugcguuaccacaauggccaagaauaaacccacgcucgacauugagcugcagaagaccgaagcuacacaacuugccacccugcgcaaacucuguaucgagggaaagauuacaaacaucaccacggauuccagaugcccuacacagggcgaagcggugcugccggaggaacaggaccagaauuauguguguaaacacaccuacgucgaucggggcugggggaacggaugcggccuuuucgggaagggaagccuggugaccugcgccaaguuucaaugucucgagcccauugagggcaaaguugugcaguaugaaaaucugaaguacacagucaucaucaccgugcauacaggggaccagcaccagguuggaaacgagacgcaaggcgugaccgcugaaauuacaccucaggccucuaccacagaggcuauccugcccgaauauggcacccucgggcuggagugcuccccucgcacgggacuugacuucaaugagaugauucugcucaccaugaaaaacaaggccuggaugguccauagacagugguuuuucgaucugccccuuccguggacaagcggcgccaccacagaaaccccuacguggaaucggaaagagcugcucgugacauuuaagaacgcucacgcgaaaaagcaagaagucgugguucuggggucucaggagggagccaugcacaccgcucugacaggcgccaccgaaauccaaaauuccgggggcaccagcauuuucgccggacaucucaagugucgccugaaaauggacaaacuugagcugaaaggcaugucuuacgcuaugugcacaaacacguuugugcucaagaaagaggucuccgaaacccagcacgggacaauccugaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccuuaaaaucaauugguauaagaagggaucuagcauuggcaaaauguuugaagccacggcuagaggggcuagacgcauggcuauccucggagacacagccugggauuucggcuccguugggggaguccugaacagccugggcaagauggugcaccagauuuuugggucugcguacaccgcccucuucuccggcgugagcugggucaugaaaaucggaauuggcgugcugcuuaccuggaucgggcucaauucuaagaacacaagcauguccuuuucuugcauugcuaucggaaucauuacccucuaucugggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuugcgacagccaucgcuggcgccugggagaauggaguguguggcauuagaagcaccacacgcauggaaaaccuccuguggaaacagaucgcuaaugagcugaacuauauccucugggaaaauaacauuaagcugaccgucgugguuggggacacgaucggagugcuugagcagggcaaacggacccugacaccucagcccauggagcucaaguacucuuggaaaaccugggggaaggccaagauugucacagccgaaacccaaaacuccagcuucaucauugauggaccuaauacacccgagugcccgucugcuuccagagcguggaacgugugggaaguggaggacuauggcuuuggcgucuucaccacgaauaucuggcugaaacugcgcgaaguuuacacacagcuuugugaccaccggcucaugagcgccgcugugaaggaugagagagccgugcacgccgacaugggguacuggaucgagucccagaaaaacggaucuuggaagcuggaaaaagcuagccugauugaggucaagaccugcaccuggccuaagucccauacacucuggucuaauggcgugcuggaaagcgauaugaucauucccaaaucccuugccgggccuaucagccagcacaacuaucgccccggauaccauacccaaacggcgggcccuuggcaccuggggaagcucgagcuggacuuuaauuauugcgagggaacaaccguugugauuacagaaaacuguggcacccggggccccucucugagaacaaccacggucuccgggaaacuuauccacgaguggugcugucgcagcugcacccucccgccucugcgguacaugggagaagauggcuguugguaugggauggagaucagacccauuucugaaaaggaggagaauauggugaaaucccugguuagcgcuggaucuggcgaaguggacaacuucacaauggggguccucugccuggccauccuuuuugaggaagugaugcggggaaaguucggcaagaaacauaugauugccggcguuuucuuuaccuucgugcugcuccugagcgggcagaucacauggcgcgauauggcucacacccugauuaugaucggauccaaugccagcgacagaaugggcaugggggucacguaccuugcgcugauugcuacauuuaagauccagcccuuccucgcccugggauuuuuccuccggaaacugaccucuagagagaaccuucugcucggcguggggcuggccauggcuacaacccugcaacuuccugaagauaucgagcagauggccaauggaauugcucugggccucauggcccugaagcucaucacccaguuugagacauaucagcuguggacggcgcuuauuucccugaccuguagcaacacaaucuucacccucacaguggccuggcgcaccgcuacgcugauucuggccggcgucucccuucugccgguuugccaaucuagcuccaugcggaaaacagacuggcuccccaugaccguggcugccaugggggugccuccccugccucucuuuaucuucucucugaaggauacccuuaagagacgcagcuggccccugaaugaaggagucauggccgugggccugguuuccauccucgcuucuagccugcuuagaaacgacgugccuauggcggggccccuggucgccggaggccuccugauugcuuguuacgugaucacagggaccuccgccgaucucacaguugagaaagccgcugacgugacgugggaagaggaagccgagcagaccggagucagccauaaccugaugauuacaguggacgaugacggcaccaugcggaucaaggaugacgagacagaaaauauucuuaccguccugcugaaaacggcgcuccugaucgugucuggcaucuuuccguacuccauuccugcuacccuucugguuuggcacacauggcagaagcagacccaacgcagcggggugcucugggauguccccucuccucccgagacacagaaagccgaacuggaggagggaguguauagaaucaagcagcagggcauuuucgggaaaacccaaguuggagugggcguccagaaggaagggguguuucauacaauguggcacgugacgcggggagccguucucaccuacaacggcaagcgccuggagccgaauugggcuuccgucaaaaaggaccuuaucagcuauggcgggggauggagacugucugcccaguggcaaaaaggcgaagagguccaggugauugcggucgaaccugggaagaaccccaaaaauuuccagacaaugccuggaaccuuccagaccacaacgggcgagaucggggcuauugcccuggauuuuaagcccggaaccuccggcagccccaucaucaaccgggagggcaaggugguugggcucuacggaaauggcguggucaccaagaacgggggauauguguccggcauugcccaaaccaaugcugaaccugacgggccgacacccgagcuggaagaggaaauguucaagaaacgcaaccuuaccaucauggaucugcacccuggcagcggaaagacgagaaaauaccuccccgccauuguucgggaggcuaucaagcgcagacugcggacacucauucuggccccuaccagaguggucgcggccgagauggaagaggcucuuaagggccugcccauccgcuaucagaccacagccaccaaaucugaacauacagggcgggagaucguggaccugaugugccacgcuaccuuuacgaugagacuccugagcccuguucgcgugccgaauuacaaccuuauuaucauggaugaagcccauuucacagaccccgccuccauugcugcgcggggauacaucucuaccagagucggcaugggggaggccgcugccauuuuuaugacagccaccccucccggaacggcugaugccuucccucagagcaaugcgcccauccaggacgaggaacgcgacaucccggagcgguccuggaacucuggcaaugaauggauuaccgauuuugcugggaagacagugugguucgugccuagcaucaaagccggcaacgacauugccaacugucugagaaagaauggcaaaaaggucauccaacucucccgcaagaccuuugauacagaguaucagaaaaccaagcugaacgacugggauuucguugugacaaccgacauuucugagaugggagcuaauuuuaaagccgaucgggugaucgaccccagacggugccugaagcccgucauucucacggaugggccugaacgcgugauccuugcgggacccaugccuguuacagccgcuagcgccgcucagagacggggccgcguggggagaaacccgcagaaagagaaugaccaauacaucuucaccggacagccccugaacaaugaugaagaccacgcccauuggaccgaggcuaagaugcugcucgacaacauuaauacaccugaaggcaucauucccgcccuguucgagccugagcgggaaaaguccgcggccaucgauggggaguauagacuuaaaggcgaaagccgcaagaccuuugucgagcugaugcggagaggagaccuccccguguggcuggcucacaaaguugccucugaaggcauuaaguacacagaucgcaaauggugcuucgacgggcagcggaacaaucagauccuggaggagaacauggauguggaaaucuggacgaaggagggagagaagaagaagcucagaccgcgcuggcuugacgcucggaccuauuccgauccucuggcccugaaagaguuuaaggacuucgccgcuggcagaaaaagcauugcgcucgaucuggucacagaaaucgggcgcgugcccacccaccuugcccauagaacacggaaugcucuggacaaccucgucaugcugcacaccucugagcauggaggcaaggccuaccgccacgccguggaggaacugccugagacgauggaaacccuccuucugcugggccucaugauucugcuuacagggggagcuaugcuguuucucaucuccggcaaagggauuggaaagaccagcaucggccugaucuguguuauugccuccucugggaugcuguggauggcggagaucccccuccaauggauugccagcgcuaucgugcuugaguucuuuaugauggugcugcugauuccugaacccgagaagcagagaacaccgcaggauaaucaacucgccuaugucguuaucggcauucugacccuugcugccacgaucgcggccaacgaaaugggccugcucgagacaaccaaacgggaccugggcauguccaaggaaccugggguggugagccccacaucuuaccuggaugucgaccuccaccccgcuuccgccuggacccuuuacgcuguggccaccacaguuaucacgccuaugcugcgccauaccauugagaauagcacagcuaacgugucucuggccgcgaucgccaaccaggcugucgugcucaugggacuggacaaaggcuggccgauuagcaagauggaucuuggggucccccugcucgcccugggaugcuauucccaggugaauccucugacccucacagcugccguucuucugcugaucacccacuacgccauuaucggccccgggcuccaggcgaaagcuacgagagaggcccaaaagcggacagcugccggaaucaugaagaacccuaccguggacggcauuaugaccaucgaucuggaccccgucauuuaugauucuaaauucgaaaagcagcuuggccaggugaugcugcucguucugugugccgugcagcugcuccuuaugagaacaagcugggcucugugcgaggcccugacccucgcgacagggccuaucacgacccugugggaaggauccccgggcaaauuuuggaauacaaccauugccgucucuauggcuaacaucuuccgcgggagcuaccuugccggagcuggccuggccuuuuccaucaugaaaagcguggggacaggaaaacggggcaccggcucucaaggggagacgcucggagaaaaguggaagaaaaagcugaaucagcuguccagaaaagaguucgaccucuauaagaaaagcggcauuaccgagguggaucgcacagaagcgaaggaggggcuuaaacggggagaaaucacccaucacgccguuuccagaggcucugcuaagcugcagugguuugucgagcggaacauggugauucccgaagggcgcgugaucgaccugggauguggcagaggcggguggagcuacuauugcgccggacucaagaaagucacagagguucggggcuacaccaaagggggaccuggccaugaggaacccgugccuauguccacauacggguggaauauugugaaacugaugucuggaaaggaugucuucuaucuucccccggagaaaugugacacccugcucugcgauaucggcgaaagcuccccuagccccacgguggaggagucucgcacaauuagaguucugaagaugguggaacccuggcugaagaacaaucaguucuguaucaaaguccucaacccuuacaugcccaccgugaucgagcaccuugaacggcugcaacgcaagcacggcgggaugcugguuagaaauccucucucccggaacagcacccaugagauguauuggauuucuaauggaacaggcaacaucguggcuuccgucaauauggugagccgccugcuucugaacagauuuacgaugacccaccggagaccgacaauugaaaaagacguggaucucggggccggaacccgccaugucaacgcugagcccgagacaccuaauauggacguuaucggcgaacggauuaagagaaucaaagaggaacacaacucuaccuggcacuacgacgaugagaaucccuauaagacaugggccuaccaugggagcuaugaagugaaggcgaccggauccgccucuagcaugaucaacggcguggucaaacugcugacgaagccuugggacgugguucccauggugacccagauggcuaugacagauaccacaccguucggccagcaacgcgucuuuaaagagaagguggacacccggacgccuagauccaugcccgggacacgccggguuaugggaauuaccgccgaguggcucuggagaacacugggccgcaauaaaaagccucggcuuugcaccagagaagaguucacgaagaaagugcgcaccaacgcugccaugggggccgucuuuacagaagagaaucagugggauagcgcgaaggcugccguggaagacgaggauuucuggaaacugguugaccgggagagagaacuccacaagcugggaaaauguggcuccugcguguacaacaugauggggaagcgcgagaagaaacuuggcgaauuuggaaaagccaaaggcucuagagcuaucugguacauguggcugggggcccgguaucucgaguucgaggcucugggauuucugaaugaagaucauugguucagccgcgagaacuccuacucuggcgucgaaggggagggacuccacaagcugggcuauauucuuagagacaucagcaaaauucccgggggcgccauguacgcggaugacaccgccggaugggacacacggaucaccgaagaugaccugcauaaugaggagaagaucacacagcagauggauccugaacacagacaacucgcuaacgccauuuuuaaacugaccuaucagaauaagguggucaaggugcagcggcccacgccgacaggcaccguuauggacaucauuucccgcaaagaucagagagggucuggacaagugggcaccuacgggcuuaacacauucaccaauauggaggcucagcugauccggcagauggaaggagagggcguccucagcaaggccgaccuggaaaacccucaucugcccgagaaaaagauuacacaguggcucgagacgaaagggguggaacgccugaagagaauggcgaucuccggcgaugacugcgugguuaagcccaucgaugaccgguuugccaacgcccuucuggcccucaaugauaugggaaaagugcgcaaggacauuccucaauggcagccgagcaaaggcuggcaugauuggcagcagguccccuucuguucucaccauuuccacgagcugaucaugaaggacgggagaaaacuugugguuccuugccggccccaagacgaacugauuggacgcgcuagaaucucccagggcgccggguggagccuccgggagaccgcuugucugggaaaggccuaugcgcagauguggucucugauguacuuucaccgcagagaucuccggcuggccuccaacgcuauuugcagcgccgugccuguccauugggugcccacaucucgcaccacaugguccauccacgcccaucaccaauggaugaccacggaagacaugcuuaccgucuggaauagaguguggauugaggauaacccuuggauggaggacaagacacccguuaccacaugggaaaaugugccguaccugggcaaacgggaggaucaguggugugggagccucaucggccugaccuccagagcuacgugggcccagaacaucccuacagcgauucagcaaguccgcagccuuaucggaaaugaagaguuccuggacuauaugcccucuaugaagcgguuuagaaaagaggaagagagcgaaggcgcuauuugguga

SEQ ID NO: 20787 - RNA, 9873 nt, Artificial Sequence
  derived and/or modified CDS sequence (opt5) from DENV-3__FJ639790__SS-prME
accagccugugccucaugaugauccugcccgccgcucuugccuuccaccugacaucccgggacggcgaaccucggaugauuguggggaagaaugaacgcggaaagucucuccuguuuaagacggcgagcggcaucaauauguguacccuuauugcuauggaucugggggaaaugugcgacgauacagugaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuuccuuacauuugugcugcuccugagcgggcagauuaccuggcgcgauauggcucacacacugaucaugauuggauccaaugccagcgacagaaugggcaugggggucaccuaccuugcgcugaucgcuacguucaagauccagcccuuucucgcccugggauucuuucuccggaaacugacaucuagagagaaccuucugcucggcguggggcuggccauggcuaccacacugcaacuuccugaagauauugagcagauggccaauggaaucgcucugggccucauggcccugaagcucauuacccaguucgagaccuaucagcuguggacagcgcuuaucucccugacguguagcaacaccauuuuuacacucaccguggccuggcgcacagcuacccugauccuggccggcgucucccuucugccgguuugccaaucuagcuccaugcggaaaacggacuggcuccccaugacaguggcugccaugggggugccuccccugccucucuucaucuuuaaucugaaggauacccuuaagagacgcucuuggccccugaacgaaggagucauggccgugggccugguuagcauucucgcuuccucucugcuuagaaacgacgugccuauggcggggccccuggucgccggaggccuccugaucgcuuguuacgugauuaccgggacaagcgccgaucucaccguugagaaagccgcugacgugacaugggaagaggaagccgagcagacgggagucucccauaaucugaugaucaccguggacgaugacggcacaaugcggauuaaggaugacgagaccgaaaacauccuuacaguccugcugaaaaccgcgcuccugaucgugagcggcauuuucccguacucuaucccugcuacgcuucugguuuggcacaccuggcagaagcagacacaacgcuccggggugcucugggauguccccagcccucccgagacccagaaagccgaacuggaggagggaguguauagaauuaagcagcagggcaucuuugggaaaacacaaguuggagugggcguccagaaggaagggguguuccauaccauguggcacgugacacggggagccguucucacguacaauggcaagcgccuggagccgaacugggcuucugucaaaaaggaccuuauuuccuauggcgggggauggagacugagcgcccaguggcaaaaaggcgaagagguccaggugaucgcggucgaaccugggaagaaucccaaaaacuuucagaccaugccuggaacauuccagaccaccacaggcgagauuggggcuaucgcccuggauuucaagcccggaacgucuggcucccccaucauuaaucgggagggcaaggugguugggcucuacggaaacggcguggucaccaaaaaugggggauaugugagcggcaucgcccaaacaaacgcugaaccugacgggccgacccccgagcuggaagaggaaauguuuaagaaacgcaaucuuacaauuauggaucugcacccuggcuccggaaagaccagaaaauaccuccccgccaucguucgggaggcuauuaagcgcagacugcggacgcucauccuggccccuacaagaguggucgcggccgagauggaagaggcucuuaagggccugcccauccgcuaucagaccaccgccacaaaaagcgaacauaccgggcgggagauuguggaccugaugugccacgcuacauucaccaugagacuccugucuccuguucgcgugccgaacuacaaucuuaucauuauggaugaagcccauuuuacggaccccgccagcaucgcugcgcggggauacauuuccacaagagucggcaugggggaggccgcugccaucuucaugaccgccacaccucccggaaccgcugaugccuuuccucagucuaacgcgcccauccaggacgaggaacgcgacauuccggagcggagcuggaacuccggcaacgaauggaucacggauuucgcugggaagaccgugugguuugugccuucuauuaaagccggcaacgacaucgccaauugucugagaaagaacggcaaaaaggucauucaacucagccgcaagacauucgauaccgaguaucagaaaacaaagcugaaugacugggauuuuguugugaccacagacaucuccgagaugggagcuaacuucaaagccgaucgggugauugaccccagacggugccugaagcccgucauccucaccgaugggccugaacgcgugauccuugcgggacccaugccuguuacggccgcuucugccgcucagagacggggccgcguggggagaaauccgcagaaagagaacgaccaauacauuuuuacaggacagccccugaauaacgaugaagaccacgcccauuggaccgaggcuaagaugcugcucgacaauaucaacaccccugaaggcauuauccccgcccuguucgagccugagcgggaaaagagcgcggccauugauggggaguauagacuuaaaggcgaaucccgcaagacauucgucgagcugaugcggagaggagaccuccccguguggcuggcucacaaaguugccagcgaaggcaucaaguacaccgaucgcaaauggugcuuugacgggcagcggaauaaccagauccuggaggagaauauggauguggaaauuuggacaaaggagggagagaagaagaagcucagaccgcgcuggcuugacgcucggacguauucugauccucuggcccugaaagaguucaaggacuuugccgcuggcagaaaauccaucgcgcucgaucuggucaccgaaauugggcgcgugcccacacaccuugcccauagaacccggaacgcucuggacaaucucgucaugcugcacacaagcgagcauggaggcaaggccuaccgccacgccguggaggaacugccugagaccauggaaacgcuccuucugcugggccucaugauccugcuuaccgggggagcuaugcuguuccucauuucuggcaaagggaucggaaagacauccaucggccugauuuguguuaucgccagcuccgggaugcuguggauggcggagauuccccuccaauggaucgccucugcuauugugcuugaguuuuucaugauggugcugcugaucccugaacccgagaagcagagaaccccgcaggauaaccaacucgccuaugucguuauuggaauccugacacuugcugccaucauugcggccaaugaaaugggccugcucgagaccacgaaacgggaccugggcaugagcaaggaaccugggguggugucccccacaagcuaccuggaugucgaccuccaccccgcuucugccuggacccuuuacgcuguggccacaaccguuaucaccccuaugcugcgccauacaauugagaacuccacggcuaacgugagccuggccgcgaucgccaaucaggcugucgugcucaugggacuggacaaaggcuggccgauuucuaagauggaucuuggggucccccugcucgcccugggaugcuauagccaggugaacccucugacccucacagcugccguucuucugcugaucacccacuacgccaucauuggccccgggcuccaggcgaaagcuacaagagaggcccaaaagcggaccgcugccggaaucaugaagaauccuacgguggacggcauuaugacaaucgaucuggaccccgucauuuaugauuccaaauuugaaaagcagcuuggccaggugaugcugcucguucugugugccgugcagcugcuccuuaugagaaccucuugggcucugugcgaggcccugacccucgcgacagggccuaucaccacacugugggaaggaagcccgggcaaauucuggaacacgaccaucgccgucuccauggcuaauauuuuucgcgggucuuaccuugccggagcuggccuggccuucagcaucaugaaguccguggggacaggaaaacggggcaccggcagccaaggggagacacucggagaaaaguggaagaaaaagcugaaccagcugucuagaaaagaguuugaccucuauaagaaauccggcauuaccgagguggaucgcacggaagcgaaggaggggcuuaaacggggagaaaucacccaucacgccguuagcagaggcuccgcuaagcugcagugguucgucgagcggaauauggugauucccgaagggcgcgugaucgaccugggauguggcagaggcggguggucuuacuauugcgccggacucaagaaagucacagagguucggggcuacaccaaagggggaccuggccaugaggaacccgugccuaugagcacauacggguggaacauugugaaacugauguccggaaaggaugucuuuuaucuucccccggagaaaugugacacccugcucugcgauaucggcgaaucuagcccuucccccacaguggaggagagccgcaccaucagaguucugaagaugguggaacccuggcugaagaauaaccaguucuguauuaaaguccucaauccuuacaugcccacggugaucgagcaccuugaacggcugcaacgcaagcacggcgggaugcugguuagaaacccucucucuagaaauuccacacaugagauguauuggauuagcaacggaaccggcaauaucguggcuucugucaacauggugucccgccugcuucugaacagauucaccaugacacaccggagaccgacgauugaaaaagacguggaucucggggccggaacccgccaugucaaugcugagcccgagacaccuaacauggacguuaucggcgaacggaucaagagaauuaaagaggaacacaauagcaccuggcacuacgacgaugagaaccccuauaagacaugggccuaccaugggucuuaugaagugaaggcgaccggaagcgccuccucuaugaucaauggcguggucaaacugcugacaaagccuugggacgugguucccauggugacccagauggcuaugacggauaccacaccguuuggccagcaacgcgucuucaaagagaagguggacacccggacaccuagaagcaugcccgggacccgccggguuaugggaauuacggccgaguggcucuggagaacacugggccgcaacaaaaagccucggcuuugcaccagagaagaguuuacaaagaaagugcgcaccaaugcugccaugggggccgucuucacggaagagaaccagugggauuccgcgaaggcugccguggaagacgaggauuuuuggaaacugguugaccgggagagagaacuccacaagcugggaaaauguggcagcugcguguacaauaugauggggaagcgcgagaagaaacuuggcgaguucggaaaagccaaaggcuccagagcuaucugguacauguggcugggggcccgguaucucgaguuugaggcucugggauuccugaacgaagaucauugguuuucucgcgagaauagcuacuccggcgucgaaggggagggacuccacaagcugggcuauauucuuagagacaucucuaaaauccccgggggcgccauguacgcggaugacaccgccggaugggacacacggauuaccgaagaugaccugcauaacgaggagaagaucacacagcagauggauccugaacacagacaacucgcuaaugccauuuucaaacugaccuaucagaacaagguggucaaggugcagcggcccacaccggcuggcaccguuauggacaucauuagccgcaaagaucagagaggguccggacaagugggcacguacgggcuuaauacauuuaccaacauggaggcccagcugauccggcagauggaaggagagggcguccucucuaaggcggaccuggaaaacccucaucugcccgagaaaaagaucacccaguggcucgagacaaaagggguggaacgccugaagagaauggccauuagcggcgaugacugcgugguuaagcccaucgaugaccgguucgcuaaugcccuucuggcucucaacgauaugggaaaagugcgcaaggacauuccucaauggcagccguccaaaggcuggcaugauuggcagcagguccccuuuuguagccaccauuuccacgagcugaucaugaaggacgggagaaaacuugugguuccuugccggccccaagacgaacugauuggacgcgccagaaucucucagggcgcuggguggucccuccgggagaccgccugucugggaaaggcguaugcccagauguggagccugauguacuuccaccgcagagaucuccggcuggcuucuaaugccauuugcuccgccgugccuguccauugggugcccacaagccgcacgaccuggucuauccacgcucaucaccaauggaugacaaccgaagacaugcuuacagucuggaacagaguguggaucgaggauaauccuuggauggaggacaagacccccguuacgaccugggaaaacgugccguaccugggcaaacgggaggaucaguggugugggucccucauuggccugacaagcagagccaccugggcgcagaauaucccuacagcuauucagcaaguccgcucccuuaucggaaacgaagaguuucuggacuauaugcccagcaugaagcgguucagaaaagaggaagagucugaaggcgccauuugguga

SEQ ID NO: 20788 - RNA, 9873 nt, Artificial Sequence
  derived and/or modified CDS sequence (opt5) from DENV-3__FJ639791__SS-prME
accagccugugccucaugaugauccugcccgccgcucuugccuuccaccugacgucccgggacggcgaaccucggaugauuguggggaagaaugaacgcggaaagucucuccuguuuaagacggcgagcggcaucaauauguguacccuuauugcuauggaucugggggagaugugcgacgauacagucaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccguugagggcaaagugguccaguaugaaaaucucaaguacacagugauuaucaccguucauacaggggaccagcaccaggugggaaacgagacgcaaggcgucaccgcugaaaucacaccucaggccucuaccacagaggcuauucugcccgaauauggcacccuggggcucgagugcuccccucgcacgggacuggacuucaaugagaugauccuucugaccaugaaaaacaaggccuggauggugcauagacagugguuuuucgaucucccccugccguggacaagcggcgccaccacagaaaccccuacguggaaucggaaagagcuucuggucacauuuaagaacgcucacgcgaaaaagcaagaagugguugugcucgggucucaggagggagccaugcacaccgcucugacaggcgccaccgaaauucaaaauuccgggggcaccagcaucuucgccggacaucugaagugucgccucaaaauggacaagcuggagcuuaaaggcaugucuuacgcuaugugcacaaacacguuuguccugaagaaagagguguccgaaacccagcacgggacaauucucaucaagguugaguacaagggagaagaugugcccuguaaaaucccuuucagcaccgaggacggccaagggaaggcccauaacggaagacugauuacagcgaaucccgucgugaccaaaaaggaggaacccgugaacaucgaggcugaaccuccguucggcgaguccaauauuguuaucgggauuggcgauaacgcccugaaaaucaauugguauaagaagggaucuagcaucggcaaaauguuugaagccacggcuagaggggccagacgcauggcuauucuuggagacacagccugggauuucggcuccgucgggggagugcucaacagccugggcaagauggugcaccagaucuuugggucugcguacaccgcccuguucuccggcgucagcugggugaugaaaauuggaaucggcguucuccugaccuggauugggcuuaauucuaagaacacaagcauguccuuuucuugcaucgcuauuggaaucaucacccuguaucucggcgccgugguccaggcugacauggggugugugauuaauuggaaaggaaaggagcugaagugcggcagcgggaucuucguuacaaacgaggugcauacguggaccgaacaguacaaauuucaagccgauucccccaagcggcuggcgacagccauugcuggcgccugggagaauggagucuguggcaucagaagcaccacacgcauggaaaaccuucucuggaaacagauugcuaaugagcugaacuauauccugugggaaaauaacaucaagcucaccgugguugugggggacauuaucggaguccuggagcagggcaaacggacgcuuaccccucagcccauggagcugaaguacucuuggaaaacaugggggaaggccaagauugugaccgccgaaacacaaaacuccagcuucaucauugauggaccuaauacccccgagugcccgucugcuuccagagcguggaacgugugggaagucgaggacuauggcuuuggcguuuucacaaccaauaucuggcucaaacugcgcgaaguguacacgcagcugugugaccaccggcuuaugagcgccgcugugaaggaugagagagccguccacgccgacaugggguacuggaucgagucccagaaaaacggaucuuggaagcucgaaaaagcuagccugauugaggugaagacaugcaccuggccuaagucccauacccuguggucuaauggcguucucgaaagcgauaugaucauucccaaaucccuggccgggccuaucagccagcacaacuaucgccccggauaccauacacaaaccgcgggcccuuggcaccuugggaagcuggagcucgacuuuaauuauugcgagggaacgacaguggucauuaccgaaaacuguggcacacggggccccucucugagaaccacaaccguguccgggaaacugauccacgaguggugcugucgcagcugcacgcuuccgccucuccgguacaugggagaagauggcuguugguaugggauggagaucagacccauuucugaaaaggaggagaauaugguuaaaucccuggugagcgcuggaucuggcgaagucgacaacuucaccaugggggugcugugccucgccauccuguuugaggaaguuaugcggggaaaguucggcaagaaacauaugauugccggcguguucuuuacauucguccuucugcucagcgggcagaucaccuggcgcgauauggcucacacacugauuaugaucggauccaaugccagcgacagaaugggcaugggggugaccuaccuggcgcuuauugcuacguuuaagauccagcccuuccuggcccucggauuuuuccugcggaaacucacaucuagagagaaccugcuucugggcguggggcucgccauggcuaccacacugcaacugccugaagauaucgagcagauggccaauggaauugcucuuggccugauggcccucaagcugaucacccaguuugagauuuaucagcucuggaccgcgcugaucucccuuacauguagcaacacgauuuucacccugacagucgccuggcgcaccgcuacacucauccuggccggcguuucccugcuuccggugugccaaucuagcuccaugcggaaaaccgacuggcugcccaugacgguggcugccaugggggucccuccccucccucuguuuaucuucaaucucaaggauacacugaagagacgcucuuggccccuuaacgaaggagugauggccguuggccuggugagcauucuggcuuccucucuccugagaaacgacgucccuauggcggggccccuuguggccggaggccugcucaucgcuuguuacguuauuaccgggaccagcgccgaucugacaguggagaaagccgcugacgucaccugggaagaggaagccgagcagacaggagugucccauaaucucaugaucacggucgacgaugacggcaccaugcggauuaaggaugacgagacagaaaacauccugaccgugcuucugaaaacagcgcugcucaucguuagcggcauuuuuccguacucuaucccugcuacccugcuuguguggcacacguggcagaagcagacccaacgcuccgggguccugugggaugugcccagcccucccgagacacagaaagccgaacucgaggagggaguuuauagaauuaagcagcagggcaucuucgggaaaacccaagugggagucggcgugcagaaggaagggguguuucauacaauguggcacguuacccggggagccguccugacauacaauggcaagcgccucgagccgaacugggcuucugugaaaaaggaccugauuuccuauggcgggggauggagacuuagcgcccaguggcaaaaaggcgaagaggugcaggucaucgcgguggaaccugggaagaaucccaaaaacuuccagacgaugccuggaaccuuccagacaaccaccggcgagauuggggcuaucgcccuggauuuuaagcccggaacaucuggcucccccaucauuaaucgggagggcaagguuguggggcuguacggaaacggcgucgugacgaaaaaugggggauauguuagcggcaucgcccaaaccaacgcugaaccugacgggccgacacccgagcucgaagaggaaauguucaagaaacgcaaucugaccauuauggaucuucacccuggcuccggaaagacaagaaaauaccugcccgccaucgugcgggaggcuauuaagcgcagacuccggacccugauccucgccccuacgagagucguggcggccgagauggaagaggcucugaagggccuucccauccgcuaucagacaaccgccaccaaaagcgaacauacagggcgggagauuguugaccugaugugccacgcuaccuuuacaaugagacugcucucuccugugcgcgucccgaacuacaaucugaucauuauggaugaagcccauuucaccgaccccgccagcaucgcugcgcggggauacauuuccacgagagugggcaugggggaggccgcugccaucuuuaugacagccaccccucccggaacagcugaugccuucccucagucuaacgcgcccauccaggacgaggaacgcgacauuccggagcggagcuggaacuccggcaacgaauggaucaccgauuuugcugggaagacggugugguucgucccuucuauuaaagccggcaacgacaucgccaauugucuuagaaagaacggcaaaaagguuauucaacugagccgcaagaccuuugauacagaguaucagaaaaccaagcucaaugacugggauuucguggugacaaccgacaucuccgagaugggagcuaacuuuaaagccgaucgggucauugaccccagacggugccugaagcccgugauccugacagaugggccugaacgcguuauccucgcgggacccaugccugugaccgccgcuucugccgcucagagacggggccgcgucgggagaaauccgcagaaagagaacgaccaauacauuuucacgggacagccccuuaauaacgaugaagaccacgcccauuggacagaggcuaagaugcugcuggacaauaucaacaccccugaaggcauuauccccgcccucuucgagccugagcgggaaaagagcgcggccauugauggggaguauagacugaaaggcgaaucccgcaagaccuuuguggagcuuaugcggagaggagaccugcccguuuggcucgcucacaaaguggccagcgaaggcaucaaguacacagaucgcaaauggugcuucgacgggcagcggaauaaccagauccuggaggagaauauggaugucgaaauuuggaccaaggagggagagaagaagaagcugagaccgcgcuggcucgacgcucggacauauucugauccucuugcccugaaagaguuuaaggacuucgccgcuggcagaaaauccaucgcgcuggaucucgugacggaaauugggcgcguccccacccaccuggcccauagaacacggaacgcucuugacaaucuggugaugcuccacaccagcgagcauggaggcaaggccuaccgccacgccguugaggaacugccugagacaauggaaacccugcuccuucugggccugaugauccuccugacagggggagcuaugcuuuuucugauuucuggcaaagggaucggaaagaccuccaucggccucauuugugugaucgccagcuccgggaugcuguggauggcggagauuccccugcaauggaucgccucugcuauugugcucgaguucuuuaugaugguccuucugaucccugaacccgagaagcagagaacaccgcaggauaaccaacuggccuauguugugauuggaauccucacccuggcugccaucauugcggccaaugaaaugggccuucuggagacaaccaaacgggaccucggcaugagcaaggaaccugggguggucucccccacgagcuaccuggauguggaccugcaccccgcuucugccuggacacucuacgcuguugccaccacagugaucaccccuaugcuucgccauaccauugagaacuccacagcuaacgucagccuggccgcgaucgccaaucaggcugugguccugaugggacucgacaaaggcuggccgauuucuaagauggaucugggggugccccuucuggcccucggaugcuauagccagguuaacccucugacgcugaccgcugccgugcuccuucugaucacacacuacgccaucauuggccccgggcugcaggcgaaagcuaccagagaggcccaaaagcggacagcugccggaaucaugaagaauccuaccgucgacggcauuaugacgaucgaucucgaccccgugauuuaugauuccaaauucgaaaagcagcugggccagguuaugcuucuggugcucugugccguccagcugcugcucaugagaacaucuugggcucuuugcgaggcccugacccuggcgaccgggccuaucacaacccucugggaaggaagcccgggcaaauuuuggaacacaacgaucgccguguccauggcuaauauuuuccgcgggucuuaccuggccggagcuggccuugccuuuagcaucaugaaguccguggggaccggaaaacggggcacaggcagccaaggggagacccugggagaaaaguggaagaaaaagcucaaccagcugucuagaaaagaguucgaccuguauaagaaauccggcauuacagagguugaucgcaccgaagcgaaggaggggcucaaacggggagaaaucacgcaucacgccgucagcagaggcuccgcuaaacuucagugguuuguggagcggaauauggugauucccgaagggcgcgucaucgaccugggauguggcagaggcggguggucuuacuauugcgccggacugaagaaaguuaccgaggugcggggcuacacaaaagggggaccuggccaugaggaacccgugccuaugagcaccuacggguggaacauugucaaacucaucuccggaaaggauguguucuaucugcccccggagaaaugugacacacuucugugcgauaucggcgaaucuagcccuucccccaccguugaggagagccgcacaauuagagugcucaagauggucgaacccuggcugaagaauaaccaguucuguaucaaagugcugaauccuuacaugcccaccguuauugagcaccucgaacggcuucaacgcaagcacggcgggaugcuggugagaaacccucugucuagaaauuccacgcaugagauguauuggaucagcaacggaucuggcaauauugucgcuuccgugaacauggugagccgccuccugcuuaacagauuuacaaugacccaccggagaccgaccaucgaaaaagacgucgaucugggggccggaacacgccauguuaaugcugagcccgagacgccuaacauggacgugaucggcgaacggauuaagagaaucaaagaggaacacaauucuaccuggcacuacgacgaugagaaccccuauaagacaugggccuaccaugggagcuaugaagugaaggcgaccggauccgccucuagcaugauuaauggcgucgugaaacuccugacaaagccuugggacguugugcccauggucacccagauggcuaugacagauaccacgccguucggccagcaacgcguguuuaaagagaagguugacacccggacaccuagauccaugcccgggacccgccgggugaugggaaucacagccgaguggcuguggagaacccucggccgcaacaaaaagccucggcugugcacgagagaagaguucacaaagaaaguccgcaccaaugcugccaugggggccguguuuacagaagagaaccagugggauagcgcgaaggcugccguugaagacgaggauuucuggaaacuuguggaccgggagagagaacugcacaagcucggaaaauguggcuccugcgucuacaauaugauggggaagcgcgagaaaaagcugggcgaauuuggaaaggccaaaggcucuagagcuauuugguacauguggcuuggggcccgguaucuggaguucgaggcucucggauuucugaacgaagaucauugguucagccgcgaaaauuccuacucuggcguggagggggagggacugcacaagcucggcuauauccugagagacaucagcaaaauucccgggggcgccauguacgcggaugacaccgccggaugggacacgcggaucaccgaagaugaccuucauaacgaggagaagauuacacagcagauggauccugaacacagacaacuggcuaaugccaucuuuaaacucaccuaucagaacaaggucgugaagguucagcggcccacaccgaccggcacagugauggacauuaucucccgcaaagaucagagagggucuggacaagucggcaccuacgggcugaauacguucacaaacauggaggcucagcuuauccggcagauggaaggagagggcgugcugagcaaggccgaccucgaaaacccucaucugcccgagaaaaagauuacccaguggcuggagaccaaagggguggaacgccucaagagaauggcgaucuccggcgaugacugcguugugaagcccauugaugaccgguuugccaaugcucugcuugcccugaacgauaugggaaaaguccgcaaggacaucccucaauggcagccgagcaaaggcuggcaugauuggcaacaggugcccuucuguucucaccauuuccacgagcucauuaugaaggacgggagaaaacugguugugccuugccggccccaagacgaacuuaucggacgcgcuagaauuucccagggcgccggguggagccugcgggagacagcuugucucggaaaggccuaugcgcagauguggucucugauguacuuucaccgcagagaucugcggcucgccuccaaugcuaucugcagcgccgucccugugcauuggguccccaccucucgcacaacgugguccauccacgcccaucaccaauggaugaccacagaagacaugcugaccguguggaacagaguuuggauugaggauaauccuuggauggaggacaagacacccgugaccacgugggaaaacgucccguaccuuggcaaacgggaggaucaguggugugggagccugaucggccucaccuccagagcuacaugggcccagaauauuccuaccgcgauccagcaagugcgcagccugauuggaaacgaagaguuccuugacuauaugcccucuaugaagcgguuuagaaaagaggaagagagcgaaggcgcuaucugguga

SEQ ID NO: 20789 - RNA, 9873 nt, Artificial Sequence
  derived and/or modified CDS sequence (opt5) from DENV-3__FJ639792__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcucggggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacgcacaacggcaagcgccucgagccgaauugggcuuccgucaaaagagaccugauuagcuacggcgggggauggcggcuuucugcccaguggcaaaagggcgaagaggugcaggugaucgcggucgaaccugggaaaaaccccaagaauuuccagaccaugccuggaacauuccagaccaccacaggcgagauuggggcuaucgcccuggauuuuaaacccggaacguccggcagccccaucauuaaccgcgagggcaaggugguugggcuguauggaaauggcguggucaccaagaacgggggauacguguccggcaucgcccaaacaaaugcugaaccugacgggccgacccccgagcucgaagaggaaauguucaaaaagagaaaccugacaauuauggaucuucauccuggcagcggaaaaacccggaaguaucugcccgccaucguucgcgaggcuauuaaaagacggcucagaacgcugauccucgccccuacacgcguggucgcggccgagauggaagaggcucugaagggccuucccauccgguaccagaccaccgccacaaagucugaacacaccgggagagagauuguggaccugaugugccaugcuacauuuaccaugcgccugcucagcccuguucgggugccgaauuauaaccugaucauuauggaugaagcccacuucacggaccccgccuccaucgcugcgagaggauacauuucuacacgcgucggcaugggggaggccgcugccaucuuuaugaccgccacaccucccggaaccgcugaugccuucccucagagcaaugcgcccauccaggacgaggaacgggacauuccggagagauccuggaacucuggcaaugaauggaucacggauuuugcugggaaaaccgugugguucgugccuagcauuaaggccggcaacgacaucgccaacugucuucgcaaaaauggaaagaaagucauucaacugucccggaagacauuugauaccgaguaccagaagacaaaacucaacgacugggauuucguugugaccacagacaucucugagaugggcgcuaauuuuaaggccgauagagugauugacccccggcgcugccugaaacccgucauccugaccgaugggccugaaagagugauccucgcgggacccaugccuguuacggccgcuagcgccgcucagcggcgcggcagaguggggcggaacccgcagaaggagaaugaccaauauauuuucacaggacagccccuuaacaaugaugaagaccaugcccacuggaccgaggcuaaaaugcugcuggacaacaucaauaccccugaaggcauuauccccgcccucuucgagccugagagagaaaaguccgcggccauugauggggaguaccgccugaagggcgaaagccggaaaacauuugucgagcuuaugagacgcggagaccugcccguguggcucgcuuauaagguugccucugaaggcaucaaauacaccgaucggaaguggugcuucgacgggcagagaaacaaucagauccuggaggagaacauggauguggaaauuuggacaaaagagggagaaaagaaaaagcugcgcccgcgguggcucgacgcuagaacguauuccgauccucuugcccugaaggaguuuaaagacuucgccgcuggccgcaagagcaucgcgcuggaucucgucaccgaaauugggagagugcccacacaccuggcccaucggacccgcaaugcucuugacaaccuggucaugcuccacacaucugagcauggaggcaaagccuacagacacgccguggaggaacugccugagaccauggaaacgcugcuccuucugggccugaugauccuccugaccgggggagcuaugcuuuuucugauuuccggcaaggggaucggaaaaacaagcaucggccucauuuguguuaucgccuccucugggaugcuguggauggcggagauuccccugcaauggaucgccagcgcuauugugcucgaguucuuuaugauggugcuucugaucccugaacccgagaagcagcggaccccgcaggauaaucaacuggccuaugucguuauuggaauccucacacuggcugccaucauugcggccaacgaaaugggccuucuggagaccacgaagcgcgaccucggcauguccaaagaaccugggguggugagccccacaucuuaccuggaugucgaccugcaccccgcuuccgccuggacccucuacgcuguggccacaaccguuaucaccccuaugcuuagacauacaauugagaauagcacggcuaacgugucucuggccgcgaucgccaaccaggcugucgugcugaugggacucgacaagggcuggccgauuagcaaaauggaucugggggucccccuucuggcccucggaugcuauucccaggugaauccucugacccugacagcugccguucuccuucugaucacccacuacgccaucauuggccccgggcugcaggcgaaggcuacacgggaggcccaaaaaagaaccgcugccggaaucaugaagaacccuacgguggacggcauuaugacaaucgaucucgaccccgucauuuaugauucuaaguucgaaaaacagcugggccaggugaugcuucugguucucugugccgugcagcugcugcucaugcgcaccagcugggcucuuugcgaggcccugacccuggcgacagggccuaucaccacacucugggaaggauccccgggcaaguuuuggaauacgaccaucgccgucucuauggcuaacauuuuccgggggagcuaccuggccggagcuggccuugccuuuuccaucaugaaaagcguggggacaggaaagagaggcaccggcucucaaggggagacacugggagaaaaauggaagaagaaacucaaucagcugucccgcaaggaguucgaccuguauaaaaagagcggcauuaccgagguggaucggacggaagcgaaagaggggcucaagagaggagaaaucacccaucacgccguuucccggggcucugcuaaacuucagugguuugucgagcgcaacauggugauucccgaagggagagugaucgaccugggauguggccggggcggguggagcuacuauugcgccggacugaagaaggucacagagguucgcggcuacaccaaagggggaccuggccaugaggaacccgugccuauguccacauacggguggaauauugugaagcucaugucuggaaaagaugucuucuaucugcccccggagaagugugacacccuucugugcgauaucggcgaaagcuccccuagccccacaguggaggagucuagaaccauccggguucucaaaaugguggaacccuggcugaagaacaaucaguucuguauuaagguccugaacccuuacaugcccacggugaucgagcaccucgaacgccuucaaagaaaacacggcgggaugcugguucggaauccucugucccgcaacagcacacaugagauguauuggauuucuaauggaaccggcaacaucguggcuuccgucaauauggugagcagacuccugcuuaaccgguuuaccaugacacacagacgcccgacgauugaaaaggacguggaucugggggccggaacccggcaugucaacgcugagcccgagacaccuaauauggacguuaucggcgaaagaaucaaacgcauuaaggaggaacacaacucuaccuggcacuacgacgaugagaaucccuauaaaacaugggccuaccaugggagcuaugaagugaaggcgaccggauccgccucuagcaugaucaacggcguggucaagcuccugacaaaaccuugggacgugguucccauggugacccagauggcuaugacggauaccacaccguucggccagcaacgggucuuuaaggagaaaguggacaccagaacaccucgcuccaugcccgggacccggagaguuaugggaauuacggccgaguggcuguggcgcacacucggccggaauaagaaaccuagacugugcacccgcgaagaguucacaaagaaggugcggaccaacgcugccaugggggccgucuuuacggaagagaaucagugggauagcgcgaaagcugccguggaagacgaggauuucuggaagcuuguugacagagagcgcgaacugcacaaacucggaaaguguggcuccugcguguacaacaugauggggaaaagagagaagaaacugggcgaauuuggaaaggccaagggcucucgggcuaucugguacauguggcuuggggcccgcuaucuggaguucgaggcucucggauuucugaaugaagaucauugguucagcagagagaacuccuacucuggcgucgaaggggagggacugcacaaacucggcuauauucugcgggacaucagcaagauccccgggggcgccauguacgcggaugacaccgccggaugggacacaagaauuaccgaagaugaccuucauaaugaggagaaaaucacacagcagauggauccugaacaccggcaacuggcuaacgccauuuuuaagcucaccuaucagaauaaaguggucaaggugcagcgccccacaccgaccggcacgguuauggacaucauuuccagaaaggaucagcgggggucuggacaagugggcacauacgggcugaacaccuucaccaauauggaggcucagcuuauccgccagauggaaggagagggcguccugagcaaagccgaccucgaaaacccucaccugcccgagaagaaaaucacacaguggcuggagaccaaggggguggaaagacucaaacggauggcgauuuccggcgaugacugcgugguuaagcccaucgaugaccgcuuugccaacgcucugcuugcccugaaugauaugggaaaggugagaaaagacauuccucaauggcagccgagcaagggcuggcaugauuggcagcagguccccuucuguucucaccauuuccacgagcucaucaugaaagacgggcggaagcuggugguuccuugccgcccccaagacgaacuuauuggaagagcucggaucucccagggcgccggguggagccugcgcgagacagcuugucucggaaaagccuaugcgcagauguggucucugauguacuuucacagacgggaucugcgccucgccuccaacgcuauuugcagcgccgugccuguccauugggugcccacgucuagaaccacaugguccauccacgcccaucaccaauggaugaccacagaagacaugcugaccgucuggaaucggguguggaucgaggauaacccuuggauggaggacaagacgcccguuaccacaugggaaaaugugccguaccuuggcaagagagaggaucaguggugugggagccugauuggccucaccucccgcgcuacaugggcccagaacaucccuaccgcgauucagcaaguccggagccugaucggaaaugaagaguuccuugacuauaugcccucuaugaaaagauuucgcaaggaggaagagagcgaaggcgcuauuugguga

SEQ ID NO: 20790 - RNA, 9873 nt, Artificial Sequence
  derived and/or modified CDS sequence (opt5) from DENV-3__FJ639793__SS-prME
accagccugugccucaugaugauccugcccgccacacuugcuuuccaccugacgucccgggacggcgagccucggaugauuguggggaagaacgaacgcggaaagucucuccuguuuaagaccgccagcggcaucaauauguguacacuuauugcgauggaucugggggaaaugugcgacgauaccgugacauacaaguguccgcacaucaccgaaguugagcccgaagacauugauugcugguguaaccucacauccaccugggugacguauggaaccugcaaucaggcuggcgagcaccggcgggacaagcgcucuguggcccuggccccucaugucgggaugggacuggauacaagaacccagacauggaugagcgcugagggcgccuggagacagguggaaaaaguugagaccugggcucuccgccaccccggcuucacgauccuggcccuuuuucuggcgcauuacaucgggacaucccucacccagaagguggucauuuucauccugcuuaugcuggugacaccuucuaugaccaugagauguguuggagugggcaaccgggacuuugucgaagggcucagcggagccaccuggguggaugugguccuggagcacggcgggugcguuacaacgauggcuaagaauaaacccacccuggacauugagcuccagaagacagaagccacccaacuggcuacacuucgcaaacuguguaucgagggaaagauuaccaacaucacgacagauuccagaugcccuacccagggcgaagccgugcucccggaggaacaggaccagaauuauguguguaaacacaccuacgucgaucggggcugggggaacggaugcggccuguucgggaagggaagccuugugacaugcgcgaaguuucaaugucuggagcccauugagggcaaaguugugcaguaugaaaaucucaaguacaccgucaucaucacagugcauacgggggaccagcaccagguuggaaacgagacccaaggcgugacagccgaaauuaccccucaggcuucuacaaccgaggccauccugcccgaauauggcacgcuggggcucgagugcuccccucgcaccggacuggacuucaaugagaugauucuucugacaaugaaaaacaaggcuuggaugguccauagacagugguuuuucgaucucccccugccguggaccagcggcgccacaaccgaaacgccuacauggaaucggaaagagcuucuggugaccuuuaagaacgcccacgcuaaaaagcaagaagucgugguucucgggucucaggagggagcgaugcacacagcccugaccggcgcuaccgaaauccaaaauuccgggggcacaagcauuuucgccggacaucugaagugucgccucaaaauggacaagcuggagcuuaaaggcaugucuuacgccaugugcacgaacaccuuugugcugaagaaagaggucuccgaaacacagcacgggaccauccucaucaagguggaguacaagggagaagauguucccuguaaaauuccuuucagcacagaggacggccaagggaaggcucauaacggaagacugaucaccgccaaucccguggucacgaaaaaggaggaacccgugaacauugaggcggaaccuccguucggcgaguccaauaucgugauugggaucggcgauaacgcucugaaaaucaauugguauaagaagggaucuagcauuggcaaaauguuugaagccacagccagaggggcuagacgcauggccauccuuggagacaccgcuugggauuucggcuccguugggggaguccucaacagccugggcaagauggugcaccagauuuuugggucugccuacaccgcgcuguucuccggcgugagcugggucaugaaaaucggaauuggcgugcuccugacauggaucgggcuuaauucuaagaacaccagcauguccuuuucuugcauugccaucggaaucauuacacuguaucucggcgcuguugugcaggccgacauggggugugucaucaauuggaaaggaaaggagcugaagugcggcagcgggauuuucgugacgaacgagguucauaccuggacagaacaguacaaauuucaagcugauucccccaagcggcuggccaccgcgaucgccggcgcuugggagaauggaguguguggcauuagaagcacaacccgcauggaaaaccuucucuggaaacagaucgccaaugagcugaacuauauccugugggaaaauaacauuaagcucacggucgugguuggggacaucauuggagugcuggagcagggcaaacggacccuuacaccucagcccauggagcugaaguacucuuggaaaaccugggggaaggcuaagaucgucacagccgaaacccaaaacuccagcuucauuaucgauggaccuaauacacccgagugcccgucugccuccagagcuuggaacgugugggaaguggaggacuauggcuuuggcgucuucaccacgaauaucuggcucaaacugcgcgaaguuuacacacagcugugugaccaccggcuuaugagcgcggccgugaaggaugagagagcugugcacgccgacaugggguacuggauugagucccagaaaaacggaucuuggaagcucgaaaaagccagccugaucgaggucaagaccugcaccuggccuaagucccauacacuguggucuaauggcgugcucgaaagcgauaugauuauccccaaaucccuggcugggccuauuagccagcacaacuaucgccccggauaccauacccaaacggccggcccuuggcaccuugggaagcuggagcucgacuuuaauuauugcgagggaacaaccguugugaucacagaaaacuguggcacccggggccccucucugagaacaaccacggucuccgggaaacugauccacgaguggugcugucgcagcugcacccuuccgccucuccgguacaugggagaagauggcuguugguaugggauggagauuagacccacaucugaaaaggaggagaauauggugaaaucccugguuagcgcgggaucuggcgaaguggacaacuucaccauggggguccugugccucgcuauccuguuugaggaagugaugcggggaaaguucggcaagaaacauaugauugccggcguuuucuuuacauucgugcuucugcucagcgggcagaucaccuggcgcgauauggcccacacgcugauuaugaucggauccaaugcuagcgacagaaugggcaugggggucacauaccuggcccuuauugcgaccuuuaagauccagcccuuccuggcucucggauuuuuccugcggaaacucacaucuagagagaaccugcuucugggcguggggcucgccauggccaccacccugcaacugccugaagauaucgagcagauggcuaauggaauugcccuuggccugauggcucucaagcugaucacacaguuugagacguaucagcucuggaccgcccugauuucccuuacauguagcaacaccaucuucacacugaccguggcguggcgcacggccacacucauucuggcuggcgucucccugcuuccgguuugccaaucuagcuccaugcggaaaaccgacuggcugcccaugaccguggccgcuaugggggugccuccccucccucuguuuaucuucucucucaaggauacacugaagagacgcagcuggccccuuaaugaaggagucauggccgugggccugguuuccauccuggccucuagccuccugagaaacgacgugccuauggcugggccccuugucgcgggaggccugcucauugccuguuacgugaucaccgggacauccgcugaucugacgguugagaaagccgccgacgugaccugggaagaggaagcugagcagacaggagucagccauaaccucaugauuaccguggacgaugacggcacaaugcggaucaaggaugacgagaccgaaaauauucugacgguccuucugaaaaccgcccugcucaucgugucuggcaucuuuccguacuccauuccugcgacacugcuuguuuggcacaccuggcagaagcagacacaacgcagcggggugcugugggauguccccucuccucccgagacccagaaagcugaacucgaggagggaguguauagaaucaagcagcagggcauuuucgggaaaacacaaguuggagugggcguccagaaggaagggguguuucauacgauguggcacgugacccggggagccguucugacauacaacggcaagcgccucgagccgaauugggccuccgucaaaaaggaccugaucagcuauggcgggggauggagacuuucugcucaguggcaaaaaggcgaagagguccaggugauugccgucgaaccugggaagaaccccaaaaauuuccagaccaugccuggaaccuuccagacaacgaccggcgagaucggggcgauugcucuggauuuuaagcccggaacauccggcagccccaucaucaaccgggagggcaagauuguggggcuguacggaaauggcguugugaccaaaaacgggggauaugucuccggcaucgcccaaacaaaugccgaaccugacgggccgacccccgagcucgaagaggaaauguucaagaaacgcaaccugacgauuauggaucuucacccuggcagcggaaagacaagaaaauaccugcccgcuaucgugcgggaggccauuaagcgcagacuccggacccugauccucgcuccuaccagaguuguggccgcggagauggaagaggcccugaagggccuucccauccgcuaucagacaaccgcuacaaaaucugaacauaccgggcgggagauugucgaccugaugugccacgccacguuuacaaugagacugcucagcccugugcgcguuccgaauuacaaccugaucauuauggaugaagcucauuucaccgaccccgccuccaucgccgcucggggauacauuucuacaagagugggcaugggggaggcggccgcuaucuuuaugaccgccacgccucccggaaccgccgaugcuuucccucagagcaaugcccccauccaggacgaggaacgcgacauuccggagcgguccuggaacucuggcaaugaauggaucacagauuuugcggggaagaccgucugguucgugccuagcauuaaagcuggcaacgacaucgccaacugucuuagaaagaauggcaaaaaggugauucaacugucccgcaagacauuugauaccgaguaucagaaaacaaagcucaacgacugggauuucgucguuaccacggacaucucugagaugggagccaauuuuaaagcugaucgggugauugaccccagacggugccugaagcccgugauccugacagaugggccugaacgcgucauccucgccggacccaugccugugaccgcggccagcgcugcccagagacggggccgcguugggagaaacccgcagaaagagaaugaccaauacauuuucaccggacagccccuuaacaaugaugaagaccacgcucauuggacagaggccaagaugcugcuggacaacaucaauaccccugaaggcauuauccccgcucucuucgagccugagcgggaaaaguccgccgcgauugauggggaguauagacugaaaggcgaaagccgcaagacauuuguggagcuuaugcggagaggagaccugcccgucuggcucgcccacaaaguggcuucugaaggcaucaaguacacggaucgcaaauggugcuucgacgggcagcggaacaaucagauccuggaggagaacauggauguugaaauuuggaccaaggagggagagaagaagaagcugagaccgcgcuggcucgacgcccggacauauuccgauccucuugcucugaaagaguuuaaggacuucgccgccggcagaaaaagcaucgcucuggaucucgugaccgaaauugggcgcguccccacacaccuggcgcauagaacccggaaugcccuugacaaccuggugaugcuccacacgucugagcauggaggcaaggcuuaccgccacgccgucgaggaacugccugagaccauggaaacacugcuccuucugggccugaugauccuccugaccgggggagccaugcuuuuucugauuuccggcaaagggaucggaaagacaagcaucggccucauuugugugaucgcuuccucugggaugcuguggauggccgagauuccccugcaauggaucgcgagcgccauuguucucgaguucuuuaugauggugcuucugaucccugaacccgagaagcagagaaccccgcaggauaaucaacuggcuuauguggucauuggaauccucacgcuggccgcuaucauugccgcgaacgaaaugggccuucuggagacaaccaaacgggaccucggcauguccaaggaaccugggguugugagccccacaucuuaccuggauguggaccugcaccccgccuccgcuuggacccucuacgccgucgcuaccacagugaucacgccuaugcuucgccauaccauugagaauagcacagccaacguuucucuggcugccaucgcgaaccaggccgugguccugaugggacucgacaaaggcuggccgauuagcaagauggaucugggggugccccuucuggcucucggaugcuauucccaggucaauccucugacccugacagccgcugugcuccuucugaucacccacuacgccaucauuggccccgggcugcaggccaaagcgacgagagaggcucaaaagcggacagccgcuggaaucaugaagaacccuaccguugacggcauuaugaccaucgaucucgaccccgugauuuaugauucuaaauucgaaaagcagcugggccaggucaugcuucuggugcucugugccguucagcugcugcucaugagaacaagcugggcccuuugcgaggcucugacccuggccacagggccuaucacgacccucugggaaggauccccgggcaaauuuuggaauacaaccaucgcggugucuauggccaacauuuuccgcgggagcuaccuggcuggagccggccuugcuuuuuccgucaugaaaagcguggggacaggaaaacggggcaccggcucucaaggggagacgcugggagaaaaguggaagaaaaagcucaaucagcuguccagaaaagaguucgaccuguauaagaaaagcggcaucaccgagguggaucgcacagaagccaaggaggggcucaaacggggagaaauuacccaucacgcgguuuccagaggcucugccaaacuucagugguuugucgagcggaacauggugauccccgaagggcgcgugauugaccugggauguggcagaggcggguggagcuacuauugcgcuggacugaagaaagucacagagguucggggcuacaccaaagggggaccuggccaugaggaacccgugccuauguccacauacggguggaauaucgugaaacucaugucuggaaaggaugucuucuaucugcccccggagaaaugugacacccuucugugcgauauuggcgaaagcuccccuagccccacgguggaggagucucgcacaaucagaguucucaagaugguggaacccuggcugaagaacaaucaguucuguaucaaaguccugaacccuuacaugcccaccgugauugagcaccucgaacggcuucaacgcaagcacggcgggaugcugguuagaaauccucugucccggaacagcacccaugagauguauuggaucucuaauggaacaggcaacauuguggccuccgucaauauggugagccgccuccugcuuaacagauuuacgaugacccaccggagaccgacaaucgaaaaagacguggaucugggggcuggaacccgccaugucaacgccgagcccgagacaccuaauauggacguuauuggcgaacggaucaagagaaucaaagaggaacacaacucuaccuggcacuacgacgaugagaaucccuauaagacaugggcuuaccaugggagcuaugaagugaaggccaccggauccgcgucuagcaugauuaacggcguggucaaacuccugacgaagccuugggacgugguucccauggugacccagauggccaugacagauaccacaccguucggccagcaacgcgucuuuaaagagaagguggacacccggacgccuagauccaugcccgggacacgccggguuaugggaaucaccgcugaguggcuguggagaacacucggccgcaauaaaaagccucggcugugcaccagagaagaguucacgaagaaagugcgcaccaacgccgcuaugggggccgucuuuacagaagagaaucagugggauagcgccaaggcggcuguggaagacgaggauuucuggaaacuuguugaccgggagagagaacugcacaagcucggaaaauguggcuccugcguguacaacaugauggggaagcgcgagaaaaagcugggcgaauuuggaaaggccaaaggcucuagagccauuugguacauguggcuuggggcucgguaucuggaguucgaggcccucggauuucugaaugaagaucauugguucagccgcgagaacuccuacucuggcgucgaaggggagggacugcacaagcucggcuauauccugagagacauuagcaaaauccccgggggcgcuauguacgccgaugacaccgcgggaugggacacacggaucaccgaagaugaccuucauaaugaggagaagauuacacagcagauggauccugaacacagacaacuggccaacgcuaucuuuaaacucaccuaucagaauaagguggucaaggugcagcggcccacgccgacaggcaccguuauggacauuaucucccgcaaagaucagagagggucuggacaagugggcaccuacgggcugaacacauucaccaauauggaggcccagcuuauucggcagauggaaggagagggcguccugagcaaggcugaccucgaaaacccucaucugcccgagaaaaagaucacacaguggcuggagacgaaagggguggaacgccucaagagaauggccaucuccggcgaugacugcgugguuaagcccauugaugaccgguuugcgaacgcccugcuugcucugaaugauaugggaaaagugcgcaaggacaucccucaauggcagccgagcaaaggcuggcaugauuggcagcagguccccuucuguucucaccauuuccacgagcucauuaugaaggacgggagaaaacuggugguuccuugccggccccaagacgaacuuaucggacgcgccagaauuucccagggcgcuggguggagccugcgggagaccgccugucucggaaaggcuuaugcccagauguggucucugauguacuuucaccgcagagaucugcggcucgcguccaacgccaucugcagcgcugugccuguccauugggugcccacaucucgcaccacaugguccauucacgcccaucaccaauggaugaccacggaagacaugcugaccgucuggaauagaguguggaucgaggauaacccuuggauggaggacaagacacccguuaccacaugggaaaaugugccguaccuuggcaaacgggaggaucaguggugugggagccugaucggccucaccuccagagccacgugggcucagaacauuccuacagccauccagcaaguccgcagccugauuggaaaugaagaguuccuugacuauaugcccucuaugaagcgguuuagaaaagaggaagagagcgaaggcgcgaucugguga

SEQ ID NO: 20791 - RNA, 9873 nt, Artificial Sequence
  derived and/or modified CDS sequence (opt5) from DENV-3__FJ639795__SS-prME
acaagccugugccucaugaugauccugcccgccgcucuugccuuccaccugacaucccgggacggcgagccucggaugauuguggggaagaacgaacgcggaaagucucuccuguuuaagacggcgagcggcaucaauauguguacccuuauugcuauggaucugggggaaaugugcgacgauacagucaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggcuagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacacgaucggagugcuggagcagggcaaacggacccuuacaccucagcccauggagcugaaguacucuuggaaaaccugggggaaggccaagauugucacagccgaaacccaaaacuccagcuucaucauugauggaccuaauacacccgagugcccgucugcuuccagagcguggaacgugugggaaguggaggacuauggcuuuggcgucuucaccacgaauaucuggcucaaacugcgcgaaguuuacacacagcugugugaccaccggcuuaugagcgccgcugugaaggaugagagagccgugcacgccgacaugggguacuggaucgagucccagaaaaacggaucuuggaagcucgaaaaagcuagccugauugaggucaagaccugcaccuggccuaagucccauacacuguggucuaauggcgugcucgaaagcgauaugaucauucccaaaucccuggccgggccuaucagccagcacaacuaucgccccggauaccauacccaaacggcgggcccuuggcaccuugggaagcuggagcucgacuuuaauuauugcgagggaacaaccguugugauuacagaaaacuguggcacccggggccccucucugagaacaaccacggucuccgggaaacugauccacgaguggugcugucgcagcugcacccuuccgccucuccgguacaugggagaagauggcuguugguaugggauggagaucagacccauuucugaaaaggaggagaauauggugaaaucccugguuagcgcuggaucuggcgaaguggacaacuucacaauggggguccugugccucgccauccuguuugaggaagugaugcggggaaaguucggcaagaaacauaugauugccggcguuuucuuuaccuucgugcuucugcucagcgggcagaucacauggcgcgauauggcucacacccugauuaugaucggauccaaugccagcgacagaaugggcauggggauuacguaccuggcgcuuaucgcuacauuuaagauccagcccuuccuggcccucggauuuuuccugcggaaacucaccucuagagagaaccugcuucugggcgucgggcucgccauggcuacaacccugcaacugccugaagauauugagcagauggccaauggaaucgcucuuggccugauggcccucaagcugauuacccaguuugagacauaucagcucuggacggcgcugaucucccuuaccuguagcaacacaauuuucacccugacaguggccuggcgcaccgcuacgcucauccuggccggcgugucccugcuuccggucugccaaucuagcuccaugcggaaaacagacuggcugcccaugaccguugcugccaugggggugccuccccucccucuguuuaucuucucucucaaggauacccugaagagacgcagcuggccccuuaaugaaggagugauggccgucggccugguguccauucuggcuucuagccuccugagaaacgacguuccuauggcggggccccuuguggccggaggccugcucaucgcuuguuacgucauuacagggaccuccgccgaucugacaguggagaaagccgcugacguuacgugggaagaggaagccgagcagaccggagugagccauaaccucaugaucacagucgacgaugacggcaccaugcggauuaaggaugacgagacagaaaauauccugaccgugcuucugaaaacggcgcugcucaucgucucuggcauuuuuccguacuccaucccugcuacccugcuuguguggcacacauggcagaagcagacccaacgcagcgggguucugugggaugugcccucuccucccgagacacagaaagccgaacucgaggagggagucuauagaauuaagcagcagggcaucuucgggaaaacccaagugggaguuggcgugcagaaggaaggggucuuucauacaauguggcacgugacgcggggagccgugcugaccuacaacggcaagcgccucgagccgaauugggcuuccguuaaaaaggaccugauuagcuauggcgggggauggagacuuucugcccaguggcaaaaaggcgaagagguccaggugaucgcgguggaaccugggaagaaccccaaaaauuuccagacaaugccuggaaccuuccagaccacaacgggcgagauuggggcuaucgcccuggauuuuaagcccggaaccuccggcagccccaucauuaaccgggagggcaaggucguggggcuguacggaaauggcguugugaccaagaacgggggauaugucuccggcaucgcccaaaccaaugcugaaccugacgggccgacacccgagcucgaagaggaaauguucaagaaacgcaaccugaccauuauggaucuucacccuggcagcggaaagacgagaaaauaccugcccgccaucgugcgggaggcuauuaagcgcagacuccggacacugauccucgccccuaccagaguuguggcggccgagauggaagaggcucugaagggccuucccauccgcuaucagaccacagccaccaaaucugaacauacagggcgggagauugucgaccugaugugccacgcuaccuuuacgaugagacugcucagcccugugcgcguuccgaauuacaaccugaucauuauggaugaagcccauuucacagaccccgccuccaucgcugcgcggggauacauuucuaccagagugggcaugggggaggccgcugccaucuuuaugacagccaccccucccggaacggcugaugccuucccucagagcaaugcgcccauccaggacgaggaacgcgacauuccggagcgguccuggaacucuggcaaugaauggaucaccgauuuugcugggaagacagucugguucgugccuagcauuaaagccggcaacgacaucgccaacugucuuagaaagaauggcaaaaaggugauucaacugucccgcaagaccuuugauacagaguaucagaaaaccaagcucaacgacugggauuucgucguuacaaccgacaucucugagaugggagcuaauuuuaaagccgaucgggugauugaccccagacggugccugaagcccgugauccugacggaugggccugaacgcgucauccucgcgggacccaugccugugacagccgcuagcgccgcucagagacggggccgcguugggagaaacccgcagaaagagaaugaccaauacauuuucaccggacagccccuuaacaaugaugaagaccacgcccauuggaccgaggcuaagaugcugcuggacaacaucaauacaccugaaggcauuauccccgcccucuucgagccugagcgggaaaaguccgcggccauugauggggaguauagacugaaaggcgaaagccgcaagaccuuuguggagcuuaugcggagaggagaccugcccgucuggcucgcucacaaaguggccucugaaggcaucaaguacacagaucgcaaauggugcuucgacgggcagcggaacaaucagauccuggaggagaacauggauguugaaauuuggacgaaggagggagagaagaagaagcugagaccgcgcuggcucgacgcucggaccuauuccgauccucuugcccugaaagaguuuaaggacuucgccgcuggcagaaaaagcaucgcgcuggaucucgugacagaaauugggcgcguccccacccaccuggcccauagaacacggaaugcucuugacaaccuggugaugcuccacaccucugagcauggaggcaaggccuaccgccacgccgucgaggaacugccugagacgauggaaacccugcuccuucugggccugaugauccuccugacagggggagcuaugcuuuuucugauuuccggcaaagggaucggaaagaccagcaucggccucauuugugugaucgccuccucugggaugcuguggauggcggagauuccccugcaauggaucgccagcgcuauuguucucgaguucuuuaugauggugcuucugaucccugaacccgagaagcagagaacaccgcaggauaaucaacuggccuauguggucauuggaauccucacccuggcugccacgaucgcggccaacgaaaugggccuucuggagacaaccaaacgggaccucggcauguccaaggaaccugggguugugagccccacaucuuaccuggauguggaccugcaccccgcuuccgccuggacccucuacgcugucgccaccacagugauuacgccuaugcuucgccauaccaucgagaauagcacagcuaacguuucucuggccgcgauugccaaccaggcugugguccugaugggacucgacaaaggcuggccgaucagcaagauggaucugggggugccccuucuggcccucggaugcuauucccaggucaauccucugacccugacagcugccgugcuccuucugauuacccacuacgccaucaucggccccgggcugcaggcgaaagcuacgagagaggcccaaaagcggacagcugccggaauuaugaagaacccuaccguugacggcaucaugaccauugaucucgaccccgugaucuaugauucuaaauucgaaaagcagcugggccaggucaugcuucuggugcucugugccguucagcugcugcucaugagaacaagcugggcucuuugcgaggcccugacccuggcgacagggccuauuacgacccucugggaaggauccccgggcaaauuuuggaauacaaccaucgccgugucuauggcuaacaucuuccgcgggagcuaccuggccggagcuggccuugccuuuuccauuaugaaaagcgucgggacaggaaaacggggcaccggcucucaaggggagacgcugggagaaaaguggaagaaaaagcucaaucagcuguccagaaaagaguucgaccuguauaagaaaagcggcaucaccgagguggaucgcacagaagcgaaggaggggcucaaacggggagaaauuacccaucacgccguguccagaggcucugcuaaacuucagugguuuguugagcggaacauggucauccccgaagggcgcgugauugaccugggauguggcagaggcggguggagcuacuauugcgccggacugaagaaagugacagagguccggggcuacaccaaagggggaccuggccaugaggaacccguuccuauguccacauacggguggaauaucgugaaacucaugucuggaaaggauguguucuaucugcccccggagaaaugugacacccuucugugcgauauuggcgaaagcuccccuagccccacggucgaggagucucgcacaaucagagugcucaagaugguugaacccuggcugaagaacaaucaguucuguaucaaagugcugaacccuuacaugcccaccgucauugagcaccucgaacggcuucaacgcaagcacggcgggaugcuggugagaaauccucugucccggaacagcacccaugagauguauuggaucucuaauggaacaggcaacauuguugcuuccgugaauauggucagccgccuccugcuuaacagauuuacgaugacccaccggagaccgacaaucgaaaaagacguggaucugggggccggaacccgccaugugaacgcugagcccgagacaccuaauauggacgucauuggcgaacggaucaagagaaucaaagaggaacacaacucuaccuggcacuacgacgaugagaaucccuauaagacaugggccuaccaugggagcuaugaaguuaaggcgaccggauccgccucuagcaugauuaacggcguggugaaacuccugacgaagccuugggacgucgugcccaugguuacccagauggcuaugacagauaccacaccguucggccagcaacgcguguuuaaagagaaggucgacacccggacgccuagauccaugcccgggacacgccgggugaugggaaucaccgccgaguggcuguggagaacacucggccgcaauaaaaagccucggcugugcaccagagaagaguucacgaagaaaguucgcaccaacgcugccaugggggccguguuuacagaagagaaucagugggauagcgcgaaggcugccgucgaagacgaggauuucuggaaacuuguggaccgggagagagaacugcacaagcucggaaaauguggcuccugcguuuacaacaugauggggaagcgcgagaaaaagcugggcgaauuuggaaaggccaaaggcucuagagcuauuugguacauguggcuuggggcccgguaucuggaguucgaggcucucggauuucugaaugaagaucauugguucagccgcgagaacuccuacucuggcguggaaggggagggacugcacaagcucggcuauauccugagagacauuagcaaaauccccgggggcgccauguacgcggaugacaccgccggaugggacacacggaucaccgaagaugaccuucauaaugaggagaagauuacacagcagauggauccugaacacagacaacuggcuaacgccaucuuuaaacucaccuaucagaauaaggucgugaagguccagcggcccacgccgacaggcaccgugauggacauuaucucccgcaaagaucagagagggucuggacaaguuggcaccuacgggcugaacacauucaccaauauggaggcucagcuuauucggcagauggaaggagagggcgugcugcucaaggccgaccuggaaaacccucaucugcccgagaaaaagaucacacaguggcucgagacgaaaggggucgaacgccugaagagaauggcgaucagcggcgaugacugcguggugaagcccauugaugaccgguuugccaacgcccuucuggcccucaaugauaugggaaaaguucgcaaggacaucccucaauggcagccguccaaaggcuggcaugauuggcaacaggugcccuucuguagccaccauuuccacgagcugauuaugaaggacgggagaaaacuugucgugccuugccggccccaagacgaacugaucggacgcgcuagaauuucucagggcgccggguggucccuccgggagaccgcuugucugggaaaggccuaugcgcagauguggagccugauguacuuucaccgcagagaucuccggcuggccucuaacgcuaucugcuccgccguuccugugcauuggguccccacaagccgcaccacauggucuauucacgcccaucaccaauggaugaccacggaagacaugcuuaccguguggaauagagucuggaucgaggauaacccuuggauggaggacaagacacccgugaccacaugggaaaauguuccguaccugggcaaacgggaggaucaguggugugggucccucaucggccugaccagcagagcuacgugggcccagaacauuccuacagcgauccagcaagugcgcucccuuauuggaaaugaagaguuccuggacuauaugcccagcaugaagcgguuuagaaaagaggaagagucugaaggcgcuaucugguga

SEQ ID NO: 20792 - RNA, 9873 nt, Artificial Sequence
  derived and/or modified CDS sequence (opt5) from DENV-3__FJ639798__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcacaucacagaaguugaacccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccguugagggcaaagugguccaguaugaaaaucucaaguacacagugauuaucaccguucauacaggggaccagcaccaggugggaaacgagacgcaaggcgucaccgcugaaaucacaccucaggccucuaccacagaggcuauucugcccgaauauggcacccuggggcucgagugcuccccucgcacgggacuggacuucaaugagaugauccuucugaccaugaaaaacaaggccuggauggugcauagacagugguuuuucgaucucccccugccguggacaagcggcgccaccacagaaaccccuacguggaaucggaaagagcuucuggucacauuuaagaacgcucacgcgaaaaagcaagaagugguugugcucgggucucaggagggagccaugcacaccgcucugacaggcgccaccgaaauucaaaauuccgggggcaccagcaucuucgccggacaucugaagugucgccucaaaauggacaagcuggagcuuaaaggcaugucuuacgcuaugugcacaaacacguuuguccugaagaaagagguguccgaaacccagcacgggacaauucucaucaagguugaguacaagggagaagaugugcccuguaaaaucccuuucagcaccgaggacggccaagggaaggcccauaacggaagacugauuacagcgaaucccgucgugaccaaaaaggaggaacccgugaacaucgaggcugaaccuccguucggcgaguccaauauuguuaucgggauuggcgauaacgcccugaaaaucaauugguauaagaagggaucuagcaucggcaaaauguuugaagccacggcuagaggggccagacgcauggcuauucuuggagacacagccugggauuucggcuccgucgggggagugcucaacagccugggcaagauggugcaccagaucuuugggucugcguacaccgcccuguucuccggcgucagcugggugaugaaaauuggaaucggcguucuccugaccuggauugggcuuaauucuaagaacacaagcauguccuuuucuugcaucgcuauuggaaucaucacccuguaucucggcgccgugguccaggcugacauggggugugugauuaauuggaaaggaaaggagcugaagugcggcagcgggaucuucguuacaaacgaggugcauacguggaccgaacaguacaaauuucaagccgauucccccaagcggcuggcgacagccauugcuggcgccugggagaauggagucuguggcaucagaagcaccacacgcauggaaaaccuucucuggaaacagauugcuaaugagcugaacuauauccugugggaaaauaacaucaagcucaccgugguugugggggacauuaucggaguccuggagcagggcaaacggacgcuuaccccucagcccauggagcugaaguacucuuggaaaacaugggggaaggccaagauugugaccgccgaaacacaaaacuccagcuucaucauugauggaccuaauacccccgagugcccgucugcuuccagagcguggaacgugugggaagucgaggacuauggcuuuggcguuuucacaaccaauaucuggcucaaacugcgcgaaguguacacgcagcugugugaccaccggcuuaugagcgccgcugugaaggaugagagagccguccacgccgacaugggguacuggaucgagucccagaaaaacggaucuuggaagcucgaaaaagcuagccugauugaggugaagacaugcaccuggccuaagucccauacccuguggucuaauggcguucucgaaagcgauaugaucauucccaaaucccuggccgggccuaucagccagcacaacuaucgccccggauaccauacacaaaccgcgggcccuuggcaccuugggaagcuggagcucgacuuuaauuauugcgagggaacgacaguggucauuaccgaaaacuguggcacacggggccccucucugagaaccacaaccguguccgggaaacugauccacgaguggugcugucgcagcugcacgcuuccgccucuccgguacaugggagaagauggcuguugguaugggauggagaucagacccauuucugaaaaggaggagaauaugguuaaaucccuggugagcgcuggaucuggcgaagucgacaacuucaccaugggggugcugugccucgccauccuguuugaggaaguuaugcggggaaaguucggcaagaaacauaugauugccggcguguucuuuacauucguccuucugcucagcgggcagaucaccuggcgcgauauggcucacacacugauuaugaucggauccaaugccagcgacagaaugggcaugggggugaccuaccuggcgcuuauugcuacguuuaagauccagcccuuccuggcccucggauuuuuccugcggaaacucacaucuagagagaaccugcuucugggcguggggcucgccauggcuaccacacugcaacugccugaagauaucgagcagauggccaauggaauugcucuuggccugauggcccucaagcugaucacccaguuugagaccuaucagcucuggacagcgcugauuucccuuacguguagcaacaccaucuucacacugaccgucgccuggcgcacagcuacccucauucuggccggcguuucccugcuuccggugugccaaucuagcuccaugcggaaaacggacuggcugcccaugacaguggcugccaugggggucccuccccucccucuguuuaucuucucucucaaggauacccugaagagacgcagcuggccccuuaaugaaggagugauggccguuggccugguguccauccuggcuucuagccuccugagaaacgacgucccuauggcggggccccuuguggccggaggccugcucauugcuuguuacguuaucaccgggacauccgccgaucugaccguggagaaagccgcugacgucacaugggaagaggaagccgagcagacgggagugagccauaaccucaugauuaccgucgacgaugacggcacaaugcggaucaaggaugacgagaccgaaaauauucugacagugcuucugaaaaccgcgcugcucaucguuucuggcaucuuuccguacuccauuccugcuacgcugcuuguguggcacaccuggcagaagcagacacaacgcagcgggguccugugggaugugcccucuccucccgagacccagaaagccgaacucgaggagggaguuuauagaaucaagcagcagggcauuuucgggaaaacacaagugggagucggcgugcagaaggaagggguguuucauaccauguggcacguuacacggggagccguccugacguacaacggcaagcgccucgagccgaauugggcuuccgugaaaaaggaccugaucagcuauggcgggggauggagacuuucugcccaguggcaaaaaggcgaagaggugcaggucauugcgguggaaccugggaagaaccccaaaaauuuccagaccaugccuggaacauuccagaccaccacaggcgagaucggggcuauugcccuggauuuuaagcccggaacguccggcagccccaucaucaaccgggagggcaagguuguggggcuguacggaaauggcgucgugaccaaaaacgggggauauguuuccggcauugcccaaacaaaugcugaaccugacgggccgacccccgagcucgaagaggaaauguucaagaaacgcaaccugacaaucauggaucuucacccuggcagcggaaagaccagaaaauaccugcccgccauugugcgggaggcuaucaagcgcagacuccggacgcugauucucgccccuacaagagucguggcggccgagauggaagaggcucugaagggccuucccauccgcuaucagaccaccgccacaaaaucugaacauaccgggcgggagaucguugaccugaugugccacgcuacauuuaccaugagacugcucagcccugugcgcgucccgaauuacaaccugauuaucauggaugaagcccauuucacggaccccgccuccauugcugcgcggggauacaucucuacaagagugggcaugggggaggccgcugccauuuuuaugaccgccacaccucccggaaccgcugaugccuucccucagagcaaugcgcccauccaggacgaggaacgcgacaucccggagcgguccuggaacucuggcaaugaauggauuacggauuuugcugggaagaccgugugguucgucccuagcaucaaagccggcaacgacauugccaacugucuuagaaagaauggcaaaaagguuauccaacugucccgcaagacauuugauaccgaguaucagaaaacaaagcucaacgacugggauuucguggugaccacagacauuucugagaugggagcuaauuuuaaagccgaucgggucaucgaccccagacggugccugaagcccgugauucugaccgaugggccugaacgcguuauccucgcgggacccaugccugugacggccgcuagcgccgcucagagacggggccgcgucgggagaaacccgcagaaagagaaugaccaauacaucuucacaggacagccccuuaacaaugaugaagaccacgcccauuggaccgaggcuaagaugcugcuggacaacauuaauaccccugaaggcaucauucccgcccucuucgagccugagcgggaaaaguccgcggccaucgauggggaguauagacugaaaggcgaaagccgcaagacauuuguggagcuuaugcggagaggagaccugcccguuuggcucgcucacaaaguggccucugaaggcauuaaguacaccgaucgcaaauggugcuucgacgggcagcggaacaaucagauccuggaggagaacauggaugucgaaaucuggacaaaggagggagagaagaagaagcugagaccgcgcuggcucgacgcucggacguauuccgauccucuugcccugaaagaguuuaaggacuucgccgcuggcagaaaaagcauugcgcuggaucucgugaccgaaaucgggcgcguccccacacaccuggcccauagaacccggaaugcucuugacaaccuggugaugcuccacacaucugagcauggaggcaaggccuaccgccacgccguugaggaacugccugagaccauggaaacgcugcuccuucugggccugaugauucuccugaccgggggagcuaugcuuuuucugaucuccggcaaagggauuggaaagacaagcaucggccucaucugugugauugccuccucugggaugcuguggauggcggagaucccccugcaauggauugccagcgcuaucgugcucgaguucuuuaugaugguccuucugauuccugaacccgagaagcagagaaccccgcaggauaaucaacuggccuauguugugaucggcauucucacacuggcugccaccaucgcggccaacgaaaugggccuucuggagacgacaaaacgggaccucggcauguccaaggaaccugggguggucagccccaccucuuaccuggauguggaccugcaccccgcuuccgccuggacacucuacgcuguugccaccaccgugaucacaccuaugcuucgccauacgauugagaauagcaccgcuaacgucucucuggccgcgaucgccaaccaggcugugguccugaugggacucgacaaaggcuggccgauuagcaagauggaucugggggugccccuucuggcccucggaugcuauucccagguuaauccucugacacugaccgcugccgugcuccuucugaucacacacuacgccauuaucggccccgggcugcaggcgaaagcuaccagagaggcccaaaagcggacggcugccggaaucaugaagaacccuacagucgacggcauuaugaccaucgaucucgaccccgugauuuaugauucuaaauucgaaaagcagcugggccagguuaugcuucuggugcucugugccguccagcugcugcucaugagaaccagcugggcucuuugcgaggcccugacacuggcgaccgggccuaucacaacgcucugggaaggauccccgggcaaauuuuggaauaccacaauugccgugucuauggcuaacaucuuccgcgggagcuaccuggccggagcuggccuugccuuuuccaucaugaaaagcguggggaccggaaaacggggcacaggcucucaaggggagacccugggagaaaaguggaagaaaaagcucaaucagcuguccagacgcgaguucgaccuguauaaaaagagcggcauuacggagguugaucggaccgaagcgaaagaggggcucaagagaggagaaaucacacaucacgccgucucccggggcucugcuaaacuucagugguuuguggagcgcaacauggugauucccgaagggagagucaucgaccugggauguggccggggcggguggagcuacuauugcgccggacugaagaagguuaccgaggugcgcggcuacacaaaagggggaccuggccaugaggaacccgugccuauguccaccuacggguggaauauugucaagcucaugucuggaaaagauguguucuaucugcccccggagaagugugacacacuucugugcgauaucggcgaaagcuccccuagccccaccguugaggagucuagaacgauucgggugcucaaaauggucgaacccuggcugaagaacaaucaguucuguaucaaggugcugaacccuuacaugcccacaguuaucgagcaccucgaacgccuucaaagaaaacacggcgggaugcuggugcggaauccucugucccgcaacagcacccaugagauguauuggauuucuaauggaaccggcaacaucgucgcuuccgugaauauggugagcagacuccugcuuaaccgguuuacaaugacgcacagacgcccgaccauugaaaaggacgucgaucugggggccggaacacggcauaucaacgcugagcccgagaccccuaauauggacguuauuggcgaaagaaucaaacgcaucaaggaggaacacaacucuacauggcacuacgacgaggaaaaucccuauaaaaccugggccuaccaugggagcuaugaggugaaggcgacaggauccgccucuagcaugauuaacggcguggucaagcuccugaccaaaccuugggaugugguucccauggugacgcagauggcuaugaccgacacaaccccguucggccagcaacgggucuuuaaggagaaaguggauacaagaaccccucgccccaugccugggacgcggagaguuaugggaaucacagccgaauggcuguggcgcacccucggccggaauaagaaacccagacugugcacacgcgaggaguucaccaagaaggugcggacgaacgcugccaugggggccgucuuuaccgaggaaaaucagugggacuccgcgaaagcugccguggaggaugaggacuucuggaaacuuguugauagagaacgcgagcugcacaaacucggaaaguguggcagcugcguguacaacaugauggggaaaagagaaaagaaacugggcgaguuuggaaaggccaagggcucccgggcuauuugguacauguggcuuggggcccgcuaucuggaguucgaagcucucggauuucugaaugaggaccauugguucucuagagaaaacagcuacuccggcgucgagggggaaggacugcacaaacucggcuauauccugcgggauauuucuaagaucccugggggcgccauguacgcggacgauacagccggaugggacaccagaaucacagaggacgaucuucauaaugaggagaagauuacccagcagauggaccccgagcaccggcaacuggcuaacgccaucuuuaagcucacauaucagaauaaaguggucaaggugcagcgcccgaccccuacgggcacaguuauggauauuaucagcagaaaggaccagcggggguccggacaagugggcaccuacgggcugaacaccuucacaaauauggaagcucagcuuauucgccagauggagggagaaggcguccugucuaaagccgaucucgagaacccccaucugcccgagaagaaaaucacccaguggcuggaaacaaaggggguggagagacucaaacggauggcgaucagcggcgacgauugcgugguuaagccuauugacgaucgcuuugccaacgcucugcuugcccugaaugacaugggaaaggugagaaaagauaucccgcaauggcagcccuccaagggcuggcaugacuggcagcaggucccuuucuguagccaccauuuccacgaacucauuaugaaagaugggcggaagcuggugguucccugccgcccucaagacgagcuuaucggacgggcucggauuucucagggcgccggguggucccugcgcgaaacggcuugucucggaaaagccuaugcgcagauguggagccugauguacuuucacagacgggaccugcgccucgccucuaacgcuaucugcuccgccgugcccguccauugggugccuaccagcagaacaaccuggucuauucacgcccaucaccaauggaugacaaccgaggauaugcugacggucuggaaucggguguggaucgaggacaaccccuggauggaagauaagaccccgguuacaaccugggagaaugugccuuaccuuggcaagagagaagaccaguggugugggucccugaucggccucacaagccgcgcuaccugggcccagaacauucccacggcgauccagcaaguccggucccugauuggaaaugaggaguuccuugauuauaugccuagcaugaaaagauuucgcaaggaagaggaaucugagggcgcuaucugguga

SEQ ID NO: 20793 - RNA, 9873 nt, Artificial Sequence
  derived and/or modified CDS sequence (opt5) from DENV-3__FJ639799__SS-prME
accagccugugccucaugaugauccugcccgccgcucuugccuuccaccugacauccagagacggagagccucggaugauuguggggaagaacgaacgcggaaaaucucuccuguuuaagacggcgagcggaaucaauauguguacccuuauugcuauggaucugggggaaaugugcgacgauacagucaccuacaaauguccgcacaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggcggcaaguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacgugaccacggauuccagaugcccuacacagggcgaagcggugcucccggaggaacaggaccagaauuaugucuguaaacacaccuacguggaucggggcugggggaacggaugcggccuguucgggaagggaagccuuguuaccugcgccaaguuucaaugucuggagcccaucgagggcaaagugguccaguaugaaaaucucaaguacacagugauuaucaccguucauacaggggaccagcaccaggugggaaacgagacgcaaggcgucaccgcugaaaucacaccucaggccucuaccacagaggcuauucugcccgaauauggcacccuggggcucgagugcuccccucgcacgggacuggacuucaaugagaugauccuucugaccaugaaaaacaaggccuggauggugcauagacagugguuuuucgaucucccccugccguggacaagcggcgccaccacagaaaccccuacguggaaucggaaagagcuucuggucacauuuaagaacgcucacgcgaaaaagcaagaagugguugugcucgggucucaggagggagccaugcacaccgcucugacaggcgccaccgaaauucaaaauuccgggggcaccagcaucuucgccggacaucugaagugucgccucaaaauggacaagcuggagcuuaaaggcaugucuuacgcuaugugcacaaacacguuuguccugaagaaagagguguccgaaacccagcacgggacaauucucaucaagguugaguacaagggagaagaugugcccuguaaaaucccuuucagcaccgaggacggccaagggaaggcccauaacggaagacugauuacagcgaaucccgucgugaccaaaaaggaggaacccgugaacaucgaggcugaaccuccguucggcgaguccaauauuguuaucgggauuggcgauaacgcccugaaaaucaauugguauaagaagggaucuagcaucggcaaaauguuugaagccacggcuagaggggccagacgcauggcuauucuuggagacacagccugggauuucggcuccgucgggggagugcucaacagccugggcaagauggugcaccagaucuuugggucugcguacaccgcccuguucuccggcgucagcugggugaugaaaauuggaaucggcguucuccugaccuggauugggcuuaauucuaagaacacaagcauguccuuuucuugcaucgcuauuggaaucaucacccuguaucucggcgccgugguccaggcugacauggggugugugauuaauuggaaaggaaaggagcugaagugcggcagcgggaucuucguuacaaacgaggugcauacguggaccgaacaguacaaauuucaagccgauucccccaagcggcuggcgacagccauugcuggcgccugggagaauggagucuguggcaucagaagcaccacacgcauggaaaaccuucucuggaaacagauugcuaaugagcugaacuauauccugugggaaaauaacaucaagcucaccgugguugugggggacauuaucggaguccuggagcagggcaaacggacgcuuaccccucagcccauggagcugaaguacucuuggaaaacaugggggaaggccaagauugugaccgccgaaacacaaaacuccagcuucaucauugauggaccuaauacccccgagugcccgucugcuuccagagcguggaacgugugggaagucgaggacuauggcuuuggcguuuucacaaccaauaucuggcucaaacugcgcgaaguguacacgcagcugugugaccaccggcuuaugagcgccgcugugaaggaugagagagccguccacgccgacaugggguacuggaucgagucccagaaaaacggaucuuggaagcucgaaaaagcuagccugauugaggugaagacaugcaccuggccuaagucccauacccuguggucuaauggcguucucgaaagcgauaugaucauucccaaaucccuggccgggccuaucagccagcacaacuaucgccccggauaccauacacaaaccgcgggcccuuggcaccuugggaagcuggagcucgacuuuaauuauugcgagggaacgacaguggucauuaccgaaaacuguggcacacggggccccucucugagaaccacaaccguguccgggaaacugauccacgaguggugcugucgcagcugcacgcuuccgccucuccgguacaugggagaagauggcuguugguaugggauggagaucagacccauuucugaaaaggaggagaauaugguuaaaucccuggugagcgcuggaucuggcgaagucgacaacuucaccaugggggugcugugccucgccauccuguuugaggaaguuaugcggggaaaguucggcaagaaacauaugauugccggcguguucuuuacauucguccuucugcucagcgggcagaucaccuggcgcgauauggcucacacacugauuaugaucggauccaaugccagcgacagaaugggcaugggggugaccuaccuggcgcuuauugcuacguuuaagauccagcccuuccuggcccucggauuuuuccugcggaaacucacaucuagagagaaccugcuucugggcguggggcucgccauggcuaccacacugcaacugccugaagauaucgagcagauggccaauggaauugcucuuggccugauggcccucaagcugaucacccaguuugagaccuaucagcucuggacagcgcugauuucccuuacguguagcaacaccaucuucacacugaccgucgccuggcgcacagcuacccucauucuggccggcguuucccugcuuccggugugccaaucuagcuccaugcggaaaacggacuggcugcccaugacaguggcugccaugggggucccuccccucccucuguuuaucuucucucucaaggauacccugaagagacgcagcuggccccuuaaugaaggagugauggccguuggccugguguccauccuggcuucuagccuccugagaaacgacgucccuauggcggggccccuuguggccggaggccugcucauugcuuguuacguuaucaccgggacauccgccgaucugaccguggagaaagccgcugacgucacaugggaagaggaagccgagcagacgggagugagccauaaccucaugauuaccgucgacgaugacggcacaaugcggaucaaggaugacgagaccgaaaauauucugacagugcuucugaaaaccgcgcugcucaucguuucuggcaucuuuccguacuccauuccugcuacgcugcuuguguggcacaccuggcagaagcagacacaacgcagcgggguccugugggaugugcccucuccucccgagacccagaaagccgaacucgaggagggaguuuauagaaucaagcagcagggcauuuucgggaaaacacaagugggagucggcgugcagaaggaagggguguuucauaccauguggcacguuacacggggagccguccugacguacaacggcaagcgccucgagccgaauugggcuuccgugaaaaaggaccugaucagcuauggcgggggauggagacuuucugcccaguggcaaaaaggcgaagaggugcaggucauugcgguggaaccugggaagaaccccaaaaauuuccagaccaugccuggaacauuccagaccaccacaggcgagaucggggcuauugcccuggauuuuaagcccggaacguccggcagccccaucaucaaccgggagggcaagguuguggggcuguacggaaauggcgucgugaccaaaaacgggggauauguuuccggcauugcccaaacaaaugcugaaccugacgggccgacccccgagcucgaagaggaaauguucaagaaacgcaaccugacaaucauggaucuucacccuggcagcggaaagaccagaaaauaccugcccgccauugugcgggaggcuaucaagcgcagacuccggacgcugauucucgccccuacaagagucguggcggccgagauggaagaggcucugaagggccuucccauccgcuaucagaccaccgccacaaaaucugaacauaccgggcgggagaucguugaccugaugugccacgcuacauuuaccaugagacugcucagcccugugcgcgucccgaauuacaaccugauuaucauggaugaagcccauuucacggaccccgccuccauugcugcgcggggauacaucucuacaagagugggcaugggggaggccgcugccauuuuuaugaccgccacaccucccggaaccgcugaugccuucccucagagcaaugcgcccauccaggacgaggaacgcgacaucccggagcgguccuggaacucuggcaaugaauggauuacggauuuugcugggaagaccgugugguucgucccuagcaucaaagccggcaacgacauugccaacugucuuagaaagaauggcaaaaagguuauccaacugucccgcaagacauuugauaccgaguaucagaaaacaaagcucaacgacugggauuucguggugaccacagacauuucugagaugggagcuaauuuuaaagccgaucgggucaucgaccccagacggugccugaagcccgugauucugaccgaugggccugaacgcguuauccucgcgggacccaugccugugacggccgcuagcgccgcucagagacggggccgcgucgggagaaacccgcagaaagagaaugaccaauacaucuucacaggacagccccuuaacaaugaugaagaccacgcccauuggaccgaggcuaagaugcugcuggacaacauuaauaccccugaaggcaucauucccgcccucuucgagccugagcgggaaaaguccgcggccaucgauggggaguauagacugaaaggcgaaagccgcaagacauuuguggagcuuaugcggagaggagaccugcccguuuggcucgcucacaaaguggccucugaaggcauuaaguacaccgaucgcaaauggugcuucgacgggcagcggaacaaucagauccuggaggagaacauggaugucgaaaucuggacaaaggagggagagaagaagaagcugagaccgcgcuggcucgacgcucggacguauuccgauccucuugcccugaaagaguuuaaggacuucgccgcuggcagaaaaagcauugcgcuggaucucgugaccgaaaucgggcgcguccccacacaccuggcccauagaacccggaaugcucuugacaaccuggugaugcuccacacaucugagcauggaggcaaggccuaccgccacgccguugaggaacugccugagaccauggaaacgcugcuccuucugggccugaugauucuccugaccgggggagcuaugcuuuuucugaucuccggcaaagggauuggaaagacaagcaucggccucaucugugugauugccuccucugggaugcuguggauggcggagaucccccugcaauggauugccagcgcuaucgugcucgaguucuuuaugaugguccuucugauuccugaacccgagaagcagagaaccccgcaggauaaucaacuggccuauguugugaucggcauucucacacuggcugccaucaucgcggccaacgaaaugggccuucuggagaccacgaaacgggaccucggcaugucccgcgaaccugggguggucagccccacaucuuaccuggauguggaccugcaccccgcuuccgccuggacccucuacgcuguugccacaaccgugauuaccccuaugcuuagacauacaaucgagaauagcacggcuaacgucucucuggccgcgauugccaaccaggcugugguccugaugggacucgacaagggcuggccgaucagcaaaauggaucugggggugccccuucuggcccucggaugcuauucccagguuaauccucugacccugacagcugccgugcuccuucugauuacccacuacgccaucaucggccccgggcugcaggcgaaggcuacacgggaggcccagaaacggaccgcugccggaauuaugaagaacccuacggucgacggcaucaugacaauugaucucgaccccgugaucuaugauucuaaguucgaaaaacagcugggccagguuaugcuucuggugcucugugccguccagcugcugcucaugcgcaccagcugggcucuuugcgaggcccugacccuggcgacagggccuauuaccacacucugggaaggauccccgggcaaguuuuggaauacgaccaucgccgugucuauggcuaacaucuuccgggggagcuaccuggccggagcuggccuugccuuuuccauuaugaaaagcguggggacaggaaagagaggcaccggcucucaaggggagacacugggagaaaaauggaagaagaaacucaaucagcugucccgcaaggaguucgaccuguauaaaaagagcggcaucaccgagguugaucggacggaagcgaaagaggggcucaagagaggagaaauuacccaucacgccgucucccggggcucugcuaaacuucagugguuuguggagcgcaacauggugauccccgaagggagagucauugaccugggauguggccggggcggguggagcuacuauugcgccggacugaagaagguuacagaggugcgcggcuacaccaaagggggaccuggccaugaggaacccgugccuauguccacauacggguggaauaucgucaagcucaugucuggaaaagauguguucuaucugcccccggagaagugugacacccuucugugcgauauuggcgaaagcuccccuagccccacaguugaggagucuagaaccauccgggugcucaaaauggucgaacccuggcugaagaacaaucaguucuguaucaaggugcugaacccuuacaugcccgcuguuauugagcaccucgaacgccuucaaagaaaacacggcgggaugcuggugcggaauccucugucccgcaacagcacgcaugagauguauuggaucucuaauggaacaggcaacauugucgccuccgugaauauggugagcagacuccugcuuaaccgguuuaccaugacccacagacgcccgacaaucgaaaaggacgucgaucugggggcuggaacgcggcauguuaacgccgagcccgagaccccuaauauggacgugauuggcgaaagaaucaaacgcaucaaggaggaacacaacucuacauggcacuacgacgaugagaaucccuauaaaaccugggcguaccaugggagcuaugaagugaaggccacaggauccgcuucuagcaugauuaacggcgucgugaagcuccugaccaaaccuugggacguugugcccauggucacacagauggccaugaccgauacgaccccguucggccagcaacggguguuuaaggagaaaguugacacaagaaccccucgcuccaugcccgggacacggagagugaugggaaucaccgcugaguggcuguggcgcacgcucggccggaauaagaaaccuagacugugcacacgcgaagaguucaccaagaagguccggacaaacgccgccaugggggcgguguuuaccgaagagaaucagugggauagcgcuaaagccgccguugaagacgaggauuucuggaaacuuguggacagagagcgcgaacugcacaaacucggaaaguguggcuccugcgucuacaacaugauggggaaaagagagaagaaacugggcgaauuuggaaaggcuaagggcucucgggccauuugguacauguggcuuggggcucgcuaucuggaguucgaggcccucggauuucugaaugaagaucauugguucagcagagagaacuccuacucuggcguggaaggggagggacugcacaaacucggcuauauccugcgggacauuagcaagauccccgggggcgcgauguacgccgaugacacggcuggaugggacaccagaaucacagaagaugaccuucauaaugaggagaaaauuacccagcagauggauccugaacaccggcaacuggccaacgcuaucuuuaagcucacauaucagaauaaagucgugaagguucagcgccccaccccgacaggcaccgugauggacauuaucuccagaaaggaucagcgggggucuggacaagucggcacguacgggcugaacacauucaccaauauggaggcccagcuuauucgccagauggaaggagagggcgugcugagcaaagcggaccucgaaaacccucaucugcccgagaagaaaaucacccaguggcuggagacaaaggggguggaaagacucaaacggauggccaucuccggcgaugacugcguugugaagcccauugaugaccgcuuugcuaacgcccugcuugcucugaaugauaugggaaaggucagaaaagacaucccucaauggcagccgagcaagggcuggcaugauuggcaacaggugcccuucuguucucaccauuuccacgagcucauuaugaaagacgggcggaagcugguugugccuugccgcccccaagacgaacuuaucggcagagcccggauuucccagggcgcuggguggagccugcgcgagaccgccugucucggaaaagcguaugcccagauguggucucugauguacuuucacagacgggaucugcgccucgcuuccaacgccaucugcagcgccgucccugugcauuggguccccacaucuagaacgaccugguccauucacgcucaucaccaauggaugacaaccgaagacaugcugacaguguggaaucggguuuggaucgaggauaacccuuggauggaggacaagacccccgugacgaccugggaaaaugucccguaccuuggcaagagagaggaucaguggugugggagccugaucggccucacaucccgcgccaccugggcgcagaacauuccuacagcuauccagcaagugcggagccugauuggaaaugaagaguuccuugacuauaugcccucuaugaaaagauuucgcaaggaggaagagagcgaaggcgccaucugguga

SEQ ID NO: 20794 - RNA, 9873 nt, Artificial Sequence
  derived and/or modified CDS sequence (opt5) from DENV-3__FJ639800__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaagugcagaauuccgggggcaccagcaucuucgccggacaucugaagugucgccucaaaauggacaagcuggagcuuaaaggcaugucuuacgcuaugugcacaaacacguuuguccugaagaaagagguguccgaaacccagcacgggacaauucucaucaagguugaguacaagggagaagaugugcccuguaaaaucccuuucagcaccgaggacggccaagggaaggcccauaacggaagacugauuacagcgaaucccgucgugaccaaaaaggaggaacccgugaacaucgaggcugaaccuccguucggcgaguccaauauuguuaucgggauuggcgauaacgcccugcggaucaauugguauaaaaagggaucuagcaucggcaagauguuugaagccacggcuagaggggcccgccggauggcuauucuuggagacacagccugggauuucggcuccgucgggggagugcucaacagccugggcaaaauggugcaccagaucuuugggucugcguacaccgcccuguucuccggcgucagcugggugaugaagauuggaaucggcguucuccugaccuggauugggcuuaauucuaaaaacacaagcauguccuuuucuugcaucgcuauuggaaucaucacccuguaucucggcgccgugguccaggcugacauggggugugugauuaauuggaagggaaaagagcugaagugcggcagcgggaucuucguuacaaacgaggugcauacguggaccgaacaguacaaguuucaagccgauucccccaaaagacuggcgacagccauugcuggcgccugggagaauggagucuguggcauccgcagcaccacacggauggaaaaccuucucuggaagcagauugcuaaugagcugaacuauauccugugggaaaauaacaucaaacucaccgugguugugggggacacgauuggaguccuggagcagggcaagagaacccuuacaccucagcccauggagcugaaauacucuuggaagaccugggggaaagccaagaucgugacagccgaaacccaaaacuccagcuucauuaucgauggaccuaauacacccgagugcccgucugcuucccgcgcguggaacgugugggaagucgaggacuauggcuuuggcguuuucaccacgaauauuuggcucaagcugcgggaaguguacacacagcugugugaccacagacuuaugagcgccgcugugaaagaugagcgcgccguccacgccgacaugggguacuggaucgagucccagaagaacggaucuuggaaacucgaaaaggcuagccugaucgaggugaaaaccugcaccuggccuaagucccauacacuguggucuaauggcguucucgaaagcgauaugauuauccccaagucccuggccgggccuauuagccagcacaacuaucggcccggauaccauacccaaacggcgggcccuuggcaccuugggaaacuggagcucgacuuuaauuauugcgagggaacaaccguggucaucacagaaaacuguggcaccagaggccccucucugcgcacaaccacgguguccgggaagcugauucacgaguggugcugucggagcugcacccuuccgccucucagauacaugggagaagauggcuguugguaugggauggagauccggcccaucucugaaaaagaggagaauaugguuaagucccuggugagcgcuggaucuggcgaagucgacaacuucacaaugggggugcugugccucgccauucuguuugaggaaguuaugcgcggaaaauucggcaagaagcauaugaucgccggcguguucuuuaccuucguccuucugcucagcgggcagauuacauggagagauauggcucacacccugaucaugauuggauccaaugccagcgaccggaugggcaugggggugacguaccuggcgcuuaucgcuacauuuaaaauucagcccuuccuggcccucggauuuuuccugagaaagcucaccucucgcgagaaccugcuucugggcguggggcucgccauggcuacaacccugcaacugccugaagauaucgagcagauggccaauggaaucgcucuuggccugauggcccucaaacugauuacccaguuugagacauaucagcucuggacggcgcugaucucccuuaccuguagcaacacaauuuucacccugacagucgccuggcggaccgcuacgcucauccuggccggcguuucccugcuuccggugugccaaucuagcuccaugagaaagacagacuggcugcccaugaccguggcugccaugggggucccuccccucccucuguuuauuuucaaucucaaagauacccugaagcgcagaucuuggccccuuaacgaaggagugauggccguuggccuggugagcauccuggcuuccucucuccugcggaacgacgucccuauggcggggccccuuguggccggaggccugcucaucgcuuguuacguuauuacagggaccagcgccgaucugacaguggagaaggccgcugacgucacgugggaagaggaagccgagcagaccggagugucccauaaucucaugaucacagucgacgaugacggcaccaugcgcauuaaagaugacgagacagaaaacauccugaccgugcuucugaagacggcgcugcucauuguuagcggcaucuuuccguacucuaucccugcuacccugcuuguguggcacacauggcagaaacagacccaaagauccgggguccugugggaugugcccagcccucccgagacacagaaggccgaacucgaggagggaguuuaucggauuaaacagcagggcaucuucgggaagacccaagugggagucggcgugcagaaagaagggguguuucauacaauguggcacguuacgcgcggagccguccugaccuacaauggcaagagacucgagccgaacugggcuucugugaagaaagaccugauuuccuauggcgggggauggcggcuuagcgcccaguggcaaaagggcgaagaggugcaggucaucgcgguggaaccugggaaaaaucccaagaacuuccagacaaugccuggaaccuuccagaccacaacgggcgagauuggggcuaucgcccuggauuuuaaacccggaaccucuggcucccccauuaucaaucgcgagggcaagguuguggggcuguacggaaacggcgucgugacaaagaaugggggauauguuagcggcaucgcccaaaccaacgcugaaccugacgggccgacacccgagcucgaagaggaaauguucaaaaagagaaaucugaccauuauggaucuucacccuggcuccggaaaaacgcggaaguaccugcccgccaucgugcgcgaggcuauuaaaagacggcucagaacacugauccucgccccuacccgcgucguggcggccgagauggaagaggcucugaagggccuucccauucgguaucagaccacagccaccaagagcgaacauacagggagagagaucguugaccugaugugccacgcuaccuuuacgaugcgccugcucucuccugugcgggucccgaacuacaaucugaucauuauggaugaagcccauuucacagaccccgccagcaucgcugcgagaggauacauuuccacccgcgugggcaugggggaggccgcugccaucuuuaugacagccaccccucccggaacggcugaugccuucccucagucuaacgcgcccauucaggacgaggaacgggacaucccggagagaagcuggaauuccggcaacgaauggaucaccgauuuugcugggaaaacagugugguucgucccuucuauuaaggccggcaacgacaucgccaauugucuucgcaaaaacggaaagaaaguuauucaacugagccggaagaccuuugauacagaguaucagaagaccaaacucaaugacugggauuucguggugacaaccgacaucuccgagaugggcgcuaacuuuaaggccgauagagucauugacccccggcgcugccugaaacccgugauccugacggaugggccugaaagaguuauucucgcgggacccaugccugugacagccgcuucugccgcucagcggcgcggcagagucgggcggaauccgcagaaggagaacgaccaauacaucuucaccggacagccccuuaauaacgaugaagaccacgcccauuggaccgaggcuaaaaugcugcuggacaauaucaacacaccugaaggcauuauccccgcccucuucgagccugagagagaaaagagcgcggccauugauggggaguaucgccugaagggcgaaucccggaaaaccuuuguggagcuuaugagacgcggagaccugcccguuuggcucgcucacaagguggccagcgaaggcaucaaauacacagaucggaaguggugcuucgacgggcagagaaauaaccagauucuggaggagaauauggaugucgaaaucuggacgaaagagggagaaaagaaaaagcugcgcccgcgguggcucgacgcuagaaccuauucugauccucuugcccugaaggaguuuaaagacuucgccgcuggccgcaaguccaucgcgcuggaucucgugacagaaauugggagaguccccacccaccuggcccaucggacacgcaacgcucuugacaaucuggugaugcuccacaccagcgagcauggaggcaaagccuacagacacgccguugaggaacugccugagacgauggaaacccugcuccuucugggccugaugauccuccugacagggggagcuaugcuuuuucugauuucuggcaaggggaucggaaaaaccuccauuggccucaucugugugaucgccagcuccgggaugcuguggauggcggagauuccccugcaauggaucgccucugcuauugugcucgaguucuuuaugaugguccuucugaucccugaacccgagaagcagcggacaccgcaggauaaccaacuggccuauguugugauuggaauccucacccuggcugccauuaucgcggccaaugaaaugggccuucuggagacgacaaagcgcgaccucggcaugagcaaagaaccugggguggucucccccaccagcuaccuggauguggaccugcaccccgcuucugccuggacacucuacgcuguugccaccaccgugaucacaccuaugcuuagacauacgauugagaacuccaccgcuaacgucagccuggccgcgaucgccaaucaggcugugguccugaugggacucgacaagggcuggccgauuucuaaaauggaucugggggugccccuucuggcccucggaugcuauagccagguuaacccucugacacugaccgcugccgugcuccuucugaucacacacuacgccauuaucggccccgggcugcaggcgaaggcuacccgggaggcccaaaaaagaacggcugccggaaucaugaagaauccuacagucgacggcauuaugaccaucgaucucgaccccgugauuuaugauuccaaguucgaaaaacagcugggccagguuaugcuucuggugcucugugccguccagcugcugcucaugcgcaccucuugggcucuuugcgaggcccugacacuggcgaccgggccuaucacaacgcucugggaaggaagcccgggcaaguuuuggaacaccacaauugccguguccauggcuaauaucuuccgggggucuuaccuggccggagcuggccuugccuuuagcaucaugaaauccguggggaccggaaagagaggcacaggcagccaaggggagacccugggagaaaaauggaagaagaaacucaaccagcugucucgcaaggaguucgaccuguauaaaaaguccggcauuacggagguugaucggaccgaagcgaaagaggggcucaagagaggagaaaucacacaucacgccgucagccggggcuccgcuaaacuucagugguuuguggagcgcaauauggugauucccgaagggagagucaucgaccugggauguggccggggcggguggucuuacuauugcgccggacugaagaagguuaccgaggugcgcggcuacacaaaagggggaccuggccaugaggaacccgugccuaugagcaccuacggguggaacauugucaagcucauguccggaaaagauguguucuaucugcccccggagaagugugacacacuucugugcgauaucggcgaaucuagcccuucccccaccguugaggagagcagaacgauucgggugcucaaaauggucgaacccuggcugaagaauaaccaguucuguaucaaggugcugaauccuuacaugcccacaguuaucgagcaccucgaacgccuucaaagaaaacacggcgggaugcuggugcggaacccucugucucgcaauuccacccaugagauguauuggauuagcaacggaucuggcaauaucgucgcuuccgugaacauggugagcagacuccugcuuaaccgguuuaccaugacacacagacgcccgacgauugaaaaggacgucgaucugggggccggaacccggcauguuaaugcugagcccgagacaccuaacauggacgugaucggcgaaagaauuaaacgcaucaaggaggaacacaauucuaccuggcacuacgacgaugagaaccccuauaaaacaugggccuaccaugggagcuaugaagugaaggcgaccggauccgccucuagcaugaucaauggcgucgugaagcuccugacaaaaccuugggacguugugcccauggucacccagauggcuaugacggauaccacaccguucggccagcaacggguguuuaaggagaaaguugacaccagaacaccucgcuccaugcccgggacccggagagugaugggaauuacggccgaguggcuguggcgcacacucggccggaacaagaaaccuagacugugcacccgcgaagaguucacaaagaagguccggaccaaugcugccaugggggccguguuuacggaagagaaccagugggauagcgcgaaagcugccguugaagacgaggauuucuggaagcuuguggacagagagcgcgaacugcacaaacucggaaaguguggcuccugcgucuacaauaugauggggaaaagagagaagaaacugggcgaauuuggaaaggccaagggcucucgggcuaucugguacauguggcuuggggcccgcuaucuggaguucgaggcucucggauuucugaacgaagaucauugguucagcagagagaauuccuacucuggcguggaaggggagggacugcacaaacucggcuauauucugcgggacaucagcaagauucccgggggcgccauguacgcggaugacaccgccggaugggacacaagaaucaccgaagaugaccuucauaacgaggagaaaaucacacagcagauggauccugaacaccggcaacuggcuaaugccauuuuuaagcucaccuaucagaacaaagucgugaagguucagcgccccacaccgaccggcacggugauggacaucauuuccagaaaggaucagcgggggucuggacaagucggcacauacgggcugaauaccuucaccaacauggaggcucagcuuauccgccagauggaaggagagggcgugcugagcaaagccgaccucgaaaacccucaccugcccgagaagaaaauuacacaguggcuggagaccaaggggguggaaagacucaaacggauggcgaucuccggcgaugacugcguugugaagcccaucgaugaccgcuuugccaaugcucugcuugcccugaacgauaugggaaaggucagaaaagacauuccucaauggcagccgagcaagggcuggcaugauuggcagcaggugcccuucuguucucaccauuuccacgagcucaucaugaaagacgggcggaagcugguugugccuugccgcccccaagacgaacuuauuggaagagcucggaucucccagggcgccggguggagccugcgcgagacagcuugucucggaaaagccuaugcgcagauguggucucugauguacuuucacagacgggaucugcgccucgccuccaaugcuauuugcagcgccgucccugugcauuggguccccacgucuagaaccacaugguccauccacgcccaucaccaauggaugaccacagaagacaugcugaccguguggaaccggguuuggauugaggauaauccuuggauggaggacaagacgcccgugaccacaugggaaaacgucccguaccuuggcaagagagaggaucaguggugugggagccugaucggccucaccucccgcgcuacaugggcccagaauaucccuaccgcgauucagcaagugcggagccugaucggaaacgaagaguuccuugacuauaugcccucuaugaaaagauuucgcaaggaggaagagagcgaaggcgcuauuugguga

SEQ ID NO: 20795 - RNA, 9873 nt, Artificial Sequence
  derived and/or modified CDS sequence (opt5) from DENV-3__FJ639801__SS-prME
acaagccugugccucaugaugauccugcccgccgcucuugccuuccaccugacaucccgggacggagagccucggaugauuguggggaagaacgaacgcggaaaaucucuccuguuuaagacggcgagcggcaucaauauguguacccuuauugcuauggaucugggggaaaugugcgacgauacagugaccuacaaauguccgcacaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacacgaucggagugcuggagcagggcaaacggacccuuacaccucagcccauggagcugaaguacucuuggaaaaccugggggaaggccaagauugucacagccgaaacccaaaacuccagcuucaucauugauggaccuaauacacccgagugcccgucugcuuccagagcguggaacgugugggaaguggaggacuauggcuuuggcgucuucaccacgaauaucuggcucaaacugcgcgaaguuuacacacagcugugugaccaccggcuuaugagcgccgcugugaaggaugagagagccgugcacgccgacaugggguacuggaucgagucccagaaaaacggaucuuggaagcucgaaaaagcuagccugauugaggucaagaccugcaccuggccuaagucccauacacuguggucuaauggcgugcucgaaagcgauaugaucauucccaaaucccuggccgggccuaucagccagcacaacuaucgccccggauaccauacccaaacggcgggcccuuggcaccuugggaagcuggagcucgacuuuaauuauugcgagggaacaaccguugugauuacagaaaacuguggcacccggggccccucucugagaacaaccacggucuccgggaaacugauccacgaguggugcugucgcagcugcacccuuccgccucuccgguacaugggagaagauggcuguugguaugggauggagaucagacccauuucugaaaaggaggagaauauggugaaaucccugguuagcgcuggaucuggcgaaguggacaacuucacaauggggguccugugccucgccauccuguuugaggaagugaugcggggaaaguucggcaagaaacauaugauugccggcguuuucuuuaccuucgugcuucugcucagcgggcagaucacauggcgcgauauggcucacacccugauuaugaucggauccaaugccagcgacagaaugggcaugggggucacguaccuggcgcuuauugcuacauuuaagauccagcccuuccuggcccucggauuuuuccugcggaaacucaccucuagagagaaccugcuucugggcguggggcucgccauggcuacaacccugcaacugccugaagauaucgagcagauggccaauggaauugcucuuggccugauggcccucaagcugaucacccaguuugagacauaucagcucuggacggcgcugauuucccuuaccuguagcaacacaaucuucacccugacaguggccuggcgcaccgcuacgcucauucuggccggcgucucccugcuuccgguuugccaaucuagcuccaugcggaaaacagacuggcugcccaugaccguggcugccaugggggugccuccccucccucuguuuaucuucucucucaaggauacccugaagagacgcagcuggccccuuaaugaaggagucauggccgugggccugguuuccauccuggcuucuagccuccugagaaacgacgugccuauggcggggccccuugucgccggaggccugcucauugcuuguuacgugaucacagggaccuccgccgaucugacaguugagaaagccgcugacgugacgugggaagaggaagccgagcagaccggagucagccauaaccucaugauuacaguggacgaugacggcaccaugcggaucaaggaugacgagacagaaaauauucugaccguccuucugaaaacggcgcugcucaucgugucuggcaucuuuccguacuccauuccugcuacccugcuuguuuggcacacauggcagaagcagacccaacgcagcggggugcugugggauguccccucuccucccgagacacagaaagccgaacucgaggagggaguguauagaaucaagcagcagggcauuuucgggaaaacccaaguuggagugggcguccagaaggaagggguguuucauacaauguggcacgugacgcggggagccguucugaccugcaacggcaagcgccucgagccgaauugggcuuccgucaaaaaggaccugaucagcuacggcgggggauggagacuuucugcccaguggcaaaaaggcgaagagguccaggugauugcggucgaaccugggaagaaccccaaaaauuuccagacaaugccuggaaccuuccagaccacaacgggcgagaucggggcuauugcccuggauuuuaagcccggaaccuccggcagccccaucaucaaccgggagggcaaggugguugggcuguauggaaauggcguggucaccaagaacgggggauacguguccggcauugcccaaaccaaugcugaaccugacgggccgacacccgagcucgaagaggaaauguucaagaaacgcaaccugaccaucauggaucuucacccuggcagcggaaagacgagaaaauaucugcccgccauuguucgggaggcuaucaagcgcagacuccggacacugauucucgccccuaccagaguggucgcggccgagauggaagaggcucugaagggccuucccauccgcuaccagaccacagccaccaaaucugaacauacagggcgggagaucguggaccugaugugucacgcuaccuuuacgaugagacugcucagcccuguucgcgugccgaauuauaaccugauuaucauggaugaagcccauuucacagaccccgccuccauugcugcgcggggauacaucucuaccagagucggcaugggggaggccgcugccauuuuuaugacagccaccccucccggaacggcugaugccuucccucagagcaaugcgcccauccaggacgaggaacgcgacaucccggagcgguccuggaacucuggcaaugaauggauuaccgauuuugcugggaagacagugugguucgugccuagcaucaaagccggcaacgacauugccaacugccuuagaaagaauggcaaaaaggucauccaacugucccgcaagaccuuugauacagaguaccagaaaaccaagcucaacgacugggauuucguugugacaaccgacauuucugagaugggagcuaauuuuaaagccgaucgggugaucgaccccagacggugccugaagcccgucauucugacggaugggccugaacgcgugauccucgcgggacccaugccuguuacagccgcuagcgccgcucagagacggggccgcguggggagaaacccgcagaaagagaaugaccaauauaucuucaccggacagccccuuaacaaugaugaagaccacgcccauuggaccgaggcuaagaugcugcuggacaacauuaauacaccugaaggcaucauucccgcccucuucgagccugagcgggaaaaguccgcggccaucgauggggaguacagacugaaaggcgaaagccgcaagaccuuugucgagcuuaugcggagaggagaccugcccguguggcucgcucacaaaguugccucugaaggcauuaaguauacagaucgcaaaugguguuucgacgggcagcggaacaaucagauccuggaggagaacauggauguggaaaucuggacgaaggagggagagaagaagaagcugagaccgcgcuggcucgacgcucggaccuacuccgauccucuugcccugaaagaguuuaaggacuucgccgcuggcagaaaaagcauugcgcuggaucucgucacagaaaucgggcgcgugcccacccaccuggcccauagaacacggaaugcucuugacaaccuggucaugcuccacaccucugagcauggaggcaaggccuaucgccacgccguggaggaacugccugagacgauggaaacccugcuccuucugggccugaugauucuccugacagggggagcuaugcuuuuucugaucuccggcaaagggauuggaaagaccagcaucggccucaucugcguuauugccuccucugggaugcuguggauggcggagaucccccugcaauggauugccagcgcuaucgugcucgaguucuuuaugauggugcuucugauuccugaacccgagaagcagagaacaccgcaggauaaucaacuggccuacgucguuaucggcauucucacccuggcugccacgaucgcggccaacgaaaugggccuucuggagacaaccaaacgggaccucggcauguccaaggaaccugggguggugagccccacaucuuaucuggaugucgaccugcaccccgcuuccgccuggacccucuacgcuguggccaccacaguuaucacgccuaugcuucgccauaccauugagaauagcacagcuaacgugucucuggccgcgaucgccaaccaggcugucgugcugaugggacucgacaaaggcuggccgauuagcaagauggaucugggggucccccuucuggcccucggauguuacucccaggugaauccucugacccugacagcugccguucuccuucugaucacccacuaugccauuaucggccccgggcugcaggcgaaagcuacgagagaggcccaaaagcggacagcugccggaaucaugaagaacccuaccguggacggcauuaugaccaucgaucucgaccccgucauuuacgauucuaaauucgaaaagcagcugggccaggugaugcuucugguucucugcgccgugcagcugcugcucaugagaacaagcugggcucuuugugaggcccugacccuggcgacagggccuaucacgacccucugggaaggauccccgggcaaauuuuggaauacaaccauugccgucucuauggcuaacaucuuccgcgggagcuaucuggccggagcuggccuugccuuuuccaucaugaaaagcguggggacaggaaaacggggcaccggcucucaaggggagacgcugggagaaaaguggaagaaaagacucaaucagcugucccgcaaggaguucgaccuguacaaaaagagcggcauuaccgagguggaucggacagaagcgaaagaggggcucaagagaggagaaaucacccaucacgccguuucccggggcucugcuaaacuucagugguuugucgagcgcaacauggugauucccgaagggagagugaucgaccugggaugcggccggggcggguggagcuauuacugugccggacugaagaaggucacagagguucgcggcuauaccaaagggggaccuggccaugaggaacccgugccuauguccacauacggguggaauauugugaagcucaugucuggaaaagaugucuucuaccugcccccggagaagugcgacacccuucugugugauaucggcgaaagcuccccuagccccacgguggaggagucuagaacaauucggguucucaaaaugguggaacccuggcugaagaacaaucaguucugcaucaagguccugaacccuuauaugcccaccgugaucgagcaccucgaacgccuucaaagaaaacacggcgggaugcugguucggaauccucugucccgcaacagcacccaugagauguacuggauuucuaauggaacaggcaacaucguggcuuccgucaauauggugagcagacuccugcuuaaccgguuuacgaugacccacagacgcccgacaauugaaaaggacguggaucugggggccggaacccggcaugucaacgcugagcccgagacaccuaauauggacguuaucggcgaaagaauuaaacgcaucaaggaggaacacaacucuaccuggcacuaugacgaugagaaucccuacaaaacaugggccuaucaugggagcuacgaagugaaggcgaccggauccgccucuagcaugaucaacggcguggucaagcuccugacgaaaccuugggacgugguucccauggugacccagauggcuaugacagauaccacaccguucggccagcaacgggucuuuaaggagaaaguggacaccagaacgccucgcuccaugcccgggacacggagaguuaugggaauuaccgccgaguggcuguggcgcacacucggccggaauaagaaaccuagacuguguacccgcgaagaguucacgaagaaggugcggaccaacgcugccaugggggccgucuuuacagaagagaaucagugggauagcgcgaaagcugccguggaagacgaggauuucuggaaacuuguugacagagagcgcgaacugcacaaacucggaaagugcggcuccugcguguauaacaugauggggaaaagagagaagaaacugggcgaauuuggaaaggccaagggcucucgggcuaucugguacauguggcuuggggcccgcuaccuggaguucgaggcucucggauuucugaaugaagaucauugguucagcagagagaacuccuauucuggcgucgaaggggagggacugcacaaacucggcuacauucugcgggacaucagcaagauucccgggggcgccauguaugcggaugacaccgccggaugggacacaagaaucaccgaagaugaccuucauaaugaggagaaaaucacacagcagauggauccugaacaccggcaacuggcuaacgccauuuuuaagcucaccuaccagaauaaaguggucaaggugcagcgccccacgccgacaggcaccguuauggacaucauuuccagaaaggaucagcgggggucuggacaagugggcaccuaugggcugaacacauucaccaauauggaggcucagcuuauccgccagauggaaggagagggcguccugagcaaagccgaccucgaaaacccucaucugcccgagaagaaaauuacacaguggcuggagacgaaggggguggaaagacucaaacggauggcgaucuccggcgaugacugugugguuaagcccaucgaugaccgcuuugccaacgcucugcuugcccugaaugauaugggaaaggugagaaaagacauuccucaauggcagccgagcaagggcuggcaugauuggcagcagguccccuucugcucucaccauuuccacgagcucaucaugaaagacgggcggaagcuggugguuccuugucgcccccaagacgaacuuauuggacgggcucggaucucccagggcgccggguggagccugcgcgagaccgcuugccucggaaaagccuacgcgcagauguggucucugauguauuuucacagacgggaucugcgccucgccuccaacgcuauuuguagcgccgugccuguccauugggugcccacaucuagaaccacaugguccauccacgcccaucaccaauggaugaccacggaagacaugcugaccgucuggaaucggguguggauugaggauaacccuuggauggaggacaagacacccguuaccacaugggaaaaugugccguaccuuggcaagagagaggaucaguggugcgggagccugaucggccucaccucccgcgcuacgugggcccagaacaucccuacagcgauucagcaaguccggagccugaucggaaaugaagaguuccuugacuacaugcccucuaugaaaagauuucgcaaggaggaagagagcgaaggcgcuauuugguga

SEQ ID NO: 20796 - RNA, 9873 nt, Artificial Sequence
  derived and/or modified CDS sequence (opt5) from DENV-3__KF955471__SS-prME
accagccugugccucaugaugauccugcccgccgcucuugccuuccaccugacaucccgggacggcgaaccucggaugauuguggggaagaaugaacgcggaaagucucuccuguuuaagacggcgagcggcaucaauauguguacccuuauugcuauggaucugggggagaugugcgacgauacagugaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucaaucucaaggauacccugaagagacgcucuuggccccuuaacgaaggagucauggccgugggccugguuagcauucuggcuuccucucuccugagaaacgacgugccuauggcggggccccuugucgccggaggccugcucaucgcuuguuacgugauuaccgggacaagcgccgaucugaccguugagaaagccgcugacgugacaugggaagaggaagccgagcagacgggagucucccauaaucucaugaucaccguggacgaugacggcacaaugcggauuaaggaugacgagaccgaaaacauccugacaguccuucugaaaaccgcgcugcucaucgugagcggcauuuuuccguacucuaucccugcuacgcugcuuguuuggcacaccuggcagaagcagacacaacgcuccggggugcugugggauguccccagcccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaauggcaagcgccucgagccgaacugggcuucugucaaaaaggaccugauuuccuauggcgggggauggagacuuagcgcccaguggcaaaaaggcgaagagguccaggugaucgcggucgaaccugggaagaaucccaaaaacuuccagaccaugccuggaacauuccagaccaccacaggcgagauuggggcuaucgcccuggauuuuaagcccggaacgucuggcucccccaucauuaaucgggagggcaaggugguugggcuguacggaaacggcguggucaccaaaaaugggggauaugugagcggcaucgcccaaacaaacgcugaaccugacgggccgacccccgagcucgaagaggaaauguucaagaaacgcaaucugacaauuauggaucuucacccuggcuccggaaagaccagaaaauaccugcccgccaucguucgggaggcuauuaagcgcagacuccggacgcugauccucgccccuacaagaguggucgcggccgagauggaagaggcucugaagggccuucccauccgcuaucagaccaccgccacaaaaagcgaacauaccgggcgggagauuguggaccugaugugccacgcuacauuuaccaugagacugcucucuccuguucgcgugccgaacuacaaucugaucauuauggaugaagcccauuucacggaccccgccagcaucgcugcgcggggauacauuuccacaagagucggcaugggggaggccgcugccaucuuuaugaccgccacaccucccggaaccgcugaugccuucccucagucuaacgcgcccauccaggacgaggaacgcgacauuccggagcggagcuggaacuccggcaacgaauggaucacggauuuugcugggaagaccgugugguucgugccuucuauuaaagccggcaacgacaucgccaauugucuuagaaagaacggcaaaaaggucauucaacugagccgcaagacauuugauaccgaguaucagaaaacaaagcucaaugacugggauuucguugugaccacagacaucuccgagaugggagcuaacuuuaaagccgaucgggugauugaccccagacggugccugaagcccgucauccugaccgaugggccugaacgcgugauccucgcgggacccaugccuguuacggccgcuucugccgcucagagacggggccgcguggggagaaauccgcagaaagagaacgaccaauacauuuucacaggacagccccuuaauaacgaugaagaccacgcccauuggaccgaggcuaagaugcugcuggacaauaucaacaccccugaaggcauuauccccgcccucuucgagccugagcgggaaaagagcgcggccauugauggggaguauagacugaaaggcgaaucccgcaagacauuugucgagcuuaugcggagaggagaccugcccguguggcucgcucacaaaguugccagcgaaggcaucaaguacaccgaucgcaaauggugcuucgacgggcagcggaauaaccagauccuggaggagaauauggauguggaaauuuggacaaaggagggagagaagaagaagcugagaccgcgcuggcucgacgcucggacguauucugauccucuugcccugaaagaguuuaaggacuucgccgcuggcagaaaauccaucgcgcuggaucucgucaccgaaauugggcgcgugcccacacaccuggcccauagaacccggaacgcucuugacaaucuggucaugcuccacacaagcgagcauggaggcaaggccuaccgccacgccguggaggaacugccugagaccauggaaacgcugcuccuucugggccugaugauccuccugaccgggggagcuaugcuuuuucugauuucuggcaaagggaucggaaagacauccaucggccucauuuguguuaucgccagcuccgggaugcuguggauggcggagauuccccugcaauggaucgccucugcuauugugcucgaguucuuuaugauggugcuucugaucccugaacccgagaagcagagaaccccgcaggauaaccaacuggccuaugucguuauuggaauccucacacuggcugccaucauugcggccaaugaaaugggccuucuggagaccacgaaacgggaccucggcaugagcaaggaaccugggguggugucccccacaagcuaccuggaugucgaccugcaccccgcuucugccuggacccucuacgcuguggccacaaccguuaucaccccuaugcuucgccauacaauugagaacuccacggcuaacgugagccuggccgcgaucgccaaucaggcugucgugcugaugggacucgacaaaggcuggccgauuucuaagauggaucugggggucccccuucuggcccucggaugcuauagccaggugaacccucugacccugacagcugccguucuccuucugaucacccacuacgccaucauuggccccgggcugcaggcgaaagcuacaagagaggcccaaaagcggaccgcugccggaaucaugaagaauccuacgguggacggcauuaugacaaucgaucucgaccccgucauuuaugauuccaaauucgaaaagcagcugggccaggugaugcuucugguucucugugccgugcagcugcugcucaugagaaccucuugggcucuuugcgaggcccugacccuggcgacagggccuaucaccacacucugggaaggaagcccgggcaaauuuuggaacacgaccaucgccgucuccauggcuaauauuuuccgcgggucuuaccuggccggagcuggccuugccuuuagcaucaugaaguccguggggacaggaaaacggggcaccggcagccaaggggagacacugggagaaaaguggaagaaaaagcucaaccagcugucuagaaaagaguucgaccuguauaagaaauccggcauuaccgagguggaucgcacggaagcgaaggaggggcucaaacggggagaaaucacccaucacgccguuagcagaggcuccgcuaaacuucagugguuugucgagcggaauauggugauucccgaagggcgcgugaucgaccugggauguggcagaggcggguggucuuacuauugcgccggacugaagaaagucacagagguucggggcuacaccaaagggggaccuggccaugaggaacccgugccuaugagcacauacggguggaacauugugaaacucauguccggaaaggaugucuucuaucugcccccggagaaaugugacacccuucugugcgauaucggcgaaucuagcccuucccccacaguggaggagagccgcaccaucagaguucucaagaugguggaacccuggcugaagaauaaccaguucuguauuaaaguccugaauccuuacaugcccacggugaucgagcaccucgaacggcuucaacgcaagcacggcgggaugcugguuagaaacccucugucuagaaauuccacacaugagauguauuggauuagcaacggaucuggcaauaucguggcuuccgucaacauggugagccgccuccugcuuaacagauuuaccaugacccaccggagaccgacaauugaaaaagacguggaucugggggccggaacgcgccaugucaaugcugagcccgagaccccuaacauggacguuaucggcgaacggaucaagagaauuaaagaggaacacaauucuacauggcacuacgacgaugagaaccccuauaagaccugggccuaccaugggagcuaugaagugaaggcgacaggauccgccucuagcaugaucaauggcguggucaaacuccugaccaagccuugggacgugguucccauggugacacagauggcuaugaccgauacgaccccguucggccagcaacgcgucuuuaaagagaagguggacacacggaccccuagauccaugcccgggacacgccggguuaugggaauuaccgccgaguggcuguggagaacgcucggccgcaacaaaaagccucggcugugcacaagagaagaguucaccaagaaagugcgcacaaaugcugccaugggggccgucuuuaccgaagagaaccagugggauagcgcgaaggcugccguggaagacgaggauuucuggaaacuuguugaccgggagagagaacugcacaagcucggaaaauguggcuccugcguguacaauaugauggggaagcgcgagaaaaagcugggcgaauuuggaaaggccaaaggcucuagagcuaucugguacauguggcuuggggcccgguaucuggaguucgaggcucucggauuucugaacgaagaucauugguucagccgcgaaaauuccuacucuggcgucgagggggagggacugcacaagcucggcuauauucugagagacaucagcaaaauccccgggggcgccauguacgcggaugacacggccggaugggacacccggauuacagaagaugaccuucauaacgaggagaagaucacccagcagauggauccugaacacagacaacuggcuaaugccauuuuuaaacucacauaucagaacaagguggucaaggugcagcggcccaccccgacaggcaccguuauggacaucauuucccgcaaagaucagagagggucuggacaagugggcacguacgggcugaauacauucaccaacauggaggcucagcuuauccggcagauggaaggagagggcguccugagcaaggccgaccucgaaaacccucaucugcccgagaaaaagaucacccaguggcuggagacaaaagggguggaacgccucaagagaauggcgauuuccggcgaugacugcgugguuaagcccaucgaugaccgguuugccaaugcucugcuugcccugaacgauaugggaaaagugcgcaaggacauuccucaauggcagccgagcaaaggcuggcaugauuggcagcagguccccuucuguucucaccauuuccacgagcucaucaugaaggacgggagaaaacuggugguuccuugccggccccaagacgaacuuauuggacgcgcuagaaucucccagggcgccggguggagccugcgggagaccgcuugucucggaaaggccuaugcgcagauguggucucugauguacuuucaccgcagagaucugcggcucgccuccaaugcuauuugcagcgccgugccuguccauugggugcccacaucucgcacgaccugguccauccacgcccaucaccaauggaugacaaccgaagacaugcugacagucuggaacagaguguggaucgaggauaauccuuggauggaggacaagacccccguuacgaccugggaaaacgugccguaccuuggcaaacgggaggaucaguggugugggagccugauuggccucacauccagagcuaccugggcccagaauaucccuacagcgauucagcaaguccgcagccugaucggaaacgaagaguuccuugacuauaugcccucuaugaagcgguuuagaaaagaggaagagagcgaaggcgcuauuugguga

SEQ ID NO: 20797 - RNA, 9873 nt, Artificial Sequence
  derived and/or modified CDS sequence (opt5) from DENV-3__FJ639803__SS-prME
accagccugugccucaugaugauccugcccgccgcucuugccuuccaccugacaucccgggacggcgaaccucggaugauuguggggaagaaugaacgcggaaagucucuccuguuuaagacggcgagcggcaucaauauguguacccuuauugcuauggaucugggggagaugugcgacgauacagugaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucaaucucaaggauacccugaagagacgcucuuggccccuuaacgaaggagucauggccgugggccugguuagcauucuggcuuccucucuccugagaaacgacgugccuauggcggggccccuugucgccggaggccugcucaucgcuuguuacgugauuaccgggacaagcgccgaucugaccguugagaaagccgcugacgugacaugggaagaggaagccgagcagacgggagucucccauaaucucaugaucaccguggacgaugacggcacaaugcggauuaaggaugacgagaccgaaaacauccugacaguccuucugaaaaccgcgcugcucaucgugagcggcauuuuuccguacucuaucccugcuacgcugcuuguuuggcacaccuggcagaagcagacacaacgcuccggggugcugugggauguccccagcccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaauggcaagcgccucgagccgaacugggcuucugucaaaaaggaccugauuuccuauggcgggggauggagacuuagcgcccaguggcaaaaaggcgaagagguccaggugaucgcggucgaaccugggaagaaucccaaaaacuuccagaccaugccuggaacauuccagaccaccacaggcgagauuggggcuaucgcccuggauuuuaagcccggaacgucuggcucccccaucauuaaucgggagggcaaggugguugggcuguacggaaacggcguggucaccaaaaaugggggauaugugagcggcaucgcccaaacaaacgcugaaccugacgggccgacccccgagcucgaagaggaaauguucaagaaacgcaaucugacaauuauggaucuucacccuggcuccggaaagaccagaaaauaccugcccgccaucguucgggaggcuauuaagcgcagacuccggacgcugauccucgccccuacaagaguggucgcggccgagauggaagaggcucugaagggccuucccauccgcuaucagaccaccgccacaaaaagcgaacauaccgggcgggagauuguggaccugaugugccacgcuacauuuaccaugagacugcucucuccuguucgcgugccgaacuacaaucugaucauuauggaugaagcccauuucacggaccccgccagcaucgcugcgcggggauacauuuccacaagagucggcaugggggaggccgcugccaucuuuaugaccgccacaccucccggaaccgcugaugccuucccucagucuaacgcgcccauccaggacgaggaacgcgacauuccggagcggagcuggaacuccggcaacgaauggaucacggauuuugcugggaagaccgugugguucgugccuucuauuaaagccggcaacgacaucgccaauugucuuagaaagaacggcaaaaaggucauucaacugagccgcaagacauuugauaccgaguaucagaaaacaaagcucaaugacugggauuucguugugaccacagacaucuccgagaugggagcuaacuuuaaagccgaucgggugauugaccccagacggugccugaagcccgucauccugaccgaugggccugaacgcgugauccucgcgggacccaugccuguuacggccgcuucugccgcucagagacggggccgcguggggagaaauccgcagaaagagaacgaccaauacauuuucacaggacagccccuuaauaacgaugaagaccacgcccauuggaccgaggcuaagaugcugcuggacaauaucaacaccccugaaggcauuauccccgcccucuucgagccugagcgggaaaagagcgcggccauugauggggaguauagacugaaaggcgaaucccgcaagacauuugucgagcuuaugcggagaggagaccugcccguguggcucgcucacaaaguugccagcgaaggcaucaaguacaccgaucgcaaauggugcuucgacgggcagcggaauaaccagauccuggaggagaauauggauguggaaauuuggacaaaggagggagagaagaagaagcugagaccgcgcuggcucgacgcucggacguauucugauccucuugcccugaaagaguuuaaggacuucgccgcuggcagaaaauccaucgcgcuggaucucgucaccgaaauugggcgcgugcccacacaccuggcccauagaacccggaacgcucuugacaaucuggucaugcuccacacaagcgagcauggaggcaaggccuaccgccacgccguggaggaacugccugagaccauggaaacgcugcuccuucugggccugaugauccuccugaccgggggagcuaugcuuuuucugauuucuggcaaagggaucggaaagacauccaucggccucauuuguguuaucgugagcuccgggaugcuguggauggccgagauuccccugcaauggaucgcgucugccauugugcucgaguucuuuaugaugguccuucugaucccugaacccgagaagcagagaaccccgcaggauaaccaacuggcuuauguugugauuggaauccucacacuggccgcuaucauugccgcgaaugaaaugggccuucuggagaccacgaaacgggaccucggcaugagcaaggaaccugggguggucucccccacaagcuaccuggauguggaccugcaccccgccucugcuuggacccucuacgccguugcuacaaccgugaucaccccuaugcuucgccauacaauugagaacuccacggccaacgucagccuggcugccaucgcgaaucaggccgugguccugaugggacucgacaaaggcuggccgauuucuaagauggaucugggggugccccuucuggcucucggaugcuauagccagguuaacccucugacccugacagccgcugugcuccuucugaucacccacuacgccaucauuggccccgggcugcaggccaaagcgacaagagaggcucaaaagcggaccgccgcuggaaucaugaagaauccuacggucgacggcauuaugacaaucgaucucgaccccgugauuuaugauuccaaauucgaaaagcagcugggccagguuaugcuucuggugcucugugccguccagcugcugcucaugagaaccucuugggcccuuugcgaggcucugacccuggccacagggccuaucaccacacucugggaaggaagcccgggcaaauuuuggaacacgaccaucgcgguguccauggccaauauuuuccgcgggucuuaccuggcuggagccggccuugcuuuuagcaucaugaaguccguggggacaggaaaacggggcaccggcagccaaggggagacacugggagaaaaguggaagaaaaagcucaaccagcugucuagaaaagaguucgaccuguauaagaaauccggcauuaccgagguugaucgcacggaagccaaggaggggcucaaacggggagaaaucacccaucacgcggucagcagaggcuccgccaaacuucagugguuuguggagcggaauauggugauucccgaagggcgcgucaucgaccugggauguggcagaggcggguggucuuacuauugcgcuggacugaagaaaguuacagaggugcggggcuacaccaaagggggaccuggccaugaggaacccgugccuaugagcacauacggguggaacauugucaaacucauguccggaaaggauguguucuaucugcccccggagaaaugugacacccuucugugcgauaucggcgaaucuagcccuucccccacaguugaggagagccgcaccaucagagugcucaagauggucgaacccuggcugaagaauaaccaguucuguauuaaagugcugaauccuuacaugcccacgguuaucgagcaccucgaacggcuucaacgcaagcacggcgggaugcuggugagaaacccucugucuagaaauuccacacaugagauguauuggauuagcaacggaucuggcaauaucgucgccuccgugaacauggugagccgccuccugcuuaacagauuuaccaugacccaccggagaccgacaauugaaaaagacgucgaucugggggcuggaacgcgccauguuaaugccgagcccgagaccccuaacauggacgugaucggcgaacggaucaagagaauuaaagaggaacacaauucuacauggcacuacgacgaugagaaccccuauaagaccugggcuuaccaugggagcuaugaagugaaggccacaggauccgcgucuagcaugaucaauggcgucgugaaacuccugaccaagccuugggacguugugcccauggucacacagauggccaugaccgauacgaccccguucggccagcaacgcguguuuaaagagaagguugacacacggaccccuagauccaugcccgggacacgccgggugaugggaauuaccgcugaguggcuguggagaacgcucggccgcaacaaaaagccucggcugugcacaagagaagaguucaccaagaaaguccgcacaaaugccgcuaugggggccguguuuaccgaagagaaccagugggauagcgccaaggcggcuguugaagacgaggauuucuggaaacuuguggaccgggagagagaacugcacaagcucggaaaauguggcuccugcgucuacaauaugauggggaagcgcgagaaaaagcugggcgaauuuggaaaggccaaaggcucuagagccaucugguacauguggcuuggggcucgguaucuggaguucgaggcccucggauuucugaacgaagaucauugguucagccgcgaaaauuccuacucuggcguggagggggagggacugcacaagcucggcuauauucugagagacaucagcaaaauccccgggggcgcuauguacgccgaugacacggcgggaugggacacccggauuacagaagaugaccuucauaacgaggagaagaucacccagcagauggauccugaacacagacaacuggccaaugcuauuuuuaaacucacauaucagaacaaggucgugaagguucagcggcccaccccgacaggcaccgugauggacaucauuucccgcaaagaucagagagggucuggacaagucggcacguacgggcugaauacauucaccaacauggaggcccagcuuauccggcagauggaaggagagggcgugcugagcaaggcugaccucgaaaacccucaucugcccgagaaaaagaucacccaguggcuggagacaaaagggguggaacgccucaagagaauggccauuuccggcgaugacugcguugugaagcccaucgaugaccgguuugcgaaugcccugcuugcucugaacgauaugggaaaaguccgcaaggacauuccucaauggcagccgagcaaaggcuggcaugauuggcaacaggugcccuucuguucucaccauuuccacgagcucaucaugaaggacgggagaaaacugguugugccuugccggccccaagacgaacuuauuggacgcgccagaaucucccagggcgcuggguggagccugcgggagaccgccugucucggaaaggcuuaugcccagauguggucucugauguacuuucaccgcagagaucugcggcucgcguccaaugccauuugcagcgcugucccugugcauuggguccccacaucucgcacgaccugguccauccacgcccaucaccaauggaugacaaccgaagacaugcugacaguguggaacagaguuuggaucgaggauaauccuuggauggaggacaagacccccgugacgaccugggaaaacgucccguaccuuggcaaacgggaggaucaguggugugggagccugauuggccucacauccagagccaccugggcucagaauaucccuacagccauucagcaagugcgcagccugaucggaaacgaagaguuccuugacuauaugcccucuaugaagcgguuuagaaaagaggaagagagcgaaggcgcgauuugguga

SEQ ID NO: 20798 - RNA, 9873 nt, Artificial Sequence
  derived and/or modified CDS sequence (opt5) from DENV-3__FJ639804__SS-prME
accagccugugccucaugaugauccugcccgccgcucuugccuuccaccugacgucccgggacggcgaaccucggaugauuguggggaagaacgaacgcggaaagucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaucccaaguuggagugggcguccagaaggaagggguguuucauacaauguggcacgugacccggggagccguucugacauacaacggcaagcgccucgagccgaauugggcuagcgucaaaaaggaccugauuucuuauggcgggggauggagacuuuccgcccaguggcaaaaaggcgaagagguccaggugaucgcggucgaaccugggaagaaccccaaaaauuuccagacgaugccuggaaccuuccagacaaccaccggcgagauuggggcuaucgcccuggauuuuaagcccggaacaagcggcucccccaucauuaaccgggagggcaagaucguggggcuguacggaaauggcguugugacgaaaaacgggggauaugucagcggcauugcccaaaccaaugcugaaccugacgggccgacacccgagcucgaagaggaaauguucaagaaacgcaaccugaccaucauggaucuucacccuggcucuggaaagacaagaaaauaccugcccgccauugugcgggaggcuaucaagcgcagacuccggacccugauccucgccccuacgagaguuguggcggccgagauggaagaggcucugaagggccuucccauucgcuaucagacaaccgccaccaaaagcgaacauacagggcgggagaucgucgaccugaugugccacgcuaccuuuacaaugagacugcucuccccugugcgcguuccgaauuacaaccugauuaucauggaugaagcccauuucaccgaccccgccucuauugcugcgcggggauacaucagcacgagagugggcaugggggaggccgcugccaucuuuaugacagccaccccucccggaacagcugaugccuucccucaguccaaugcgcccauucaggacgaggaacgcgacaucccggagcggucuuggaacagcggcaaugaauggauuaccgauuuugcugggaagacggucugguucgugccuuccaucaaagccggcaacgacauugccaacugucuuagaaagaauggcaaaaaggugauccaacugucucgcaagaccuuugauacagaguaucagaaaaccaagcucaacgacugggauuucgucguuacaaccgacauuagcgagaugggagcuaauuuuaaagccgaucgggugaucgaccccagacggugccugaagcccgugauccugacagaugggccugaacgcgucauucucgcgggacccaugccugugaccgccgcuuccgccgcucagagacggggccgcguugggagaaacccgcagaaagagaaugaccaauacaucuucacgggacagccccuuaacaaugaugaagaccacgcccauuggacagaggcuaagaugcugcuggacaacauuaauaccccugaaggcaucauucccgcccucuucgagccugagcgggaaaagagcgcggccaucgauggggaguauagacugaaaggcgaaucucgcaagaccuuuguggagcuuaugcggagaggagaccugcccgucuggcucgcucacaaaguggccuccgaaggcaucaaguacacagaucgcaaauggugcuucgacgggcagcggaacaaucagauucuggaggagaacauggauguugaaaucuggaccaaggagggagagaagaagaagcugagaccgcgcuggcucgacgcucggacauauagcgauccucuugcccugaaagaguuuaaggacuucgccgcuggcagaaaaucuauugcgcuggaucucgugacggaaaucgggcgcguccccacccaccuggcccauagaacacggaaugcucuugacaaccuggugaugcuccacaccuccgagcauggaggcaaggccuaccgccacgccgucgaggaacugccugagacaauggaaacccugcuccuucugggccugaugauucuccugacagggggagcuaugcuuuuucugaucagcggcaaagggaucggaaagaccuccauuggccucaucugugugauugccucuagcgggaugcuguggauggcggagaucccccugcaauggauugccuccgcuaucguucucgaguucuuuaugauggugcuucugauuccugaacccgagaagcagagaacaccgcaggauaaucaacuggccuauguggucaucggaauccucacccuggcugccacaauugcggccaacgaaaugggccuucuggagaccacgaaacgggaccucggcaugagcaaggaaccugggguugugucucccacauccuaccuggauguggaccugcaccccgcuagcgccuggacccucuacgcugucgccacaaccgugaucaccccuaugcuucgccauacaauugaaaauucuacggcuaacguuagccuggccgcgaucgccaaccaggcugugguccugaugggacucgacaaaggcuggccgauuuccaagauggaucugggggugccccuucuggcccucggaugcuauucucaggucaauccucugacccugacagcugccgugcuccuucugaucacccacuacgccaucauuggccccgggcugcaggcgaaagcuacaagagaggcccaaaagcggaccgcugccggaaucaugaagaacccuacgguugacggcauuaugacaaucgaucucgaccccgugauuuaugauagcaaauucgaaaagcagcugggccaggucaugcuucuggugcucugugccguucagcugcugcucaugagaaccuccugggcucuuugcgaggcccugacccuggcgacagggccuaucaccacacucugggaaggaucuccgggcaaauuuuggaauacgaccaucgccgugagcauggcuaacauuuuccgcggguccuaccuggccggagcuggccuugccuuuagcaucaugaagucugucgggacaggaaaacggggcaccggcucccaaggggagacacugggagaaaaguggaagaaaaagcucaaucagcugagcagaaaagaguucgaccuguauaagaaauccggcauuaccgagguggaucgcacggaagcgaaggaggggcucaaacggggagaaaucacccaucacgccgugucuagaggcagcgcuaaacuucagugguuuguugagcggaacauggucauucccgaagggcgcgugaucgaccugggauguggcagaggcgggugguccuacuauugcgccggacugaagaaagugacagagguccggggcuacaccaaagggggaccuggccaugaggaacccguuccuaugucuacauacggguggaauauugugaaacucaugagcggaaaggauguguucuaucugcccccggagaaaugugacacccuucugugcgauaucggcgaauccagcccuucucccacagucgaggagucccgcaccaucagagugcucaagaugguugaacccuggcugaagaacaaucaguucuguauuaaagugcugaacccuuacaugcccacggucaucgagcaccucgaacggcuucaacgcaagcacggcgggaugcuggugagaaauccucugagccggaacucuacacaugagauguauuggauuuccaauggaaccggcaacaucguugcuagcgugaauauggucucucgccuccugcuuaacagauuuaccaugacauaccggagaccgacgauugaaaaagacguggaucugggggccggaacccgccacgugaacgcugagcccgagacaccuaauauggacgucaucggcgaacggaucgagagaauuaaggaagaacacaacagcaccuggcacuaugacgaugaaaaucccuacaaaacaugggccuaucacggguccuacgagguuaaggcgaccggaucugccagcuccaugaucaacggcguggugaagcuccugacaaaaccuugggacgucgugcccaugguuacccagauggcuaugacggauaccacaccguucggccagcaacgcguguuuaaggagaaagucgacacccggauuccuagaagcaugcccgggacacgccgggugaugggaaucaccgccgaauggcuguggagaacgcucggccgcaauaagaaaccucggcugugcacaagagaggaguucaccaagaagguucgcacaaacgcugccaugggggccguguuuaccgaggaaaaucagugggauuccgcgaaagcugccgucgaggacgaggauuucuggaaacuuguggaccgggaaagagagcugcauaaacucggaaaguguggcucuugcguuuacaacaugauggggaaacgcgaaaagaaacugggcgaguuuggaaaggccaagggcagcagagcuauuugguauauguggcuuggggcccgguaccuggaguucgaagcucucggauuucugaaugaggaucacugguucucccgcgaaaacucuuauagcggcguggagggggaaggacugcauaaacucggcuacauccugagagacaucuccaagauucccgggggcgccauguaugcggaugacacggccggaugggacacccggaucacagaggaugaccuucacaaugaggagaagauuacccagcagauggauccugagcauagacaacuggcuaacgccaucuuuaagcucacauaccagaauaaagucgugaagguccagcggcccaccccgacaggcaccgugauggacauuaucucucgcaaggaucagagagggagcggacaaguuggcacguaugggcugaacacauucaccaauauggaagcucagcuuauccggcagauggagggagaaggcgugcuguccaaagccgaccucgagaacccucaucugcccgagaagaaaauuacccaguggcuggaaacaaagggggucgagcgccucagacggauggcgaucagcggcgaugacugcguggugaaacccauugaugaccgcuuugccaacgcucugcuugcccugaaugauaugggaaagguuagaaaggacaucccucaauggcagccgucuaaaggcuggcacgauuggcaacaggugcccuucuguucccaucacuuccaugaacucauuaugaaggacgggcggaaacuggucgugccuugccgcccccaagacgagcuuaucggacgggcucggauuagccagggcgccggguggucucugcgcgaaaccgcuugucucggaaaggccuacgcgcagauguggucccugauguacuuucacagacgggaucugcgccucgccagcaacgcuaucugcucugccguuccugugcacuggguccccacauccagaacgaccuggagcauccaugcccaccaucaauggaugacaaccgaggacaugcugacaguguggaaucgggucuggauugaggauaacccuuggauggaagacaaaacccccgugacgaccugggagaauguuccguaucuuggcaagagagaagaucaguggugugggucccugaucggccucacaagccgcgcuaccugggcccagaacauuccuacagcgauccagcaagugcggucucugauuggaaaugaggaguuccuugacuacaugcccagcaugaagagauuucgcaaagaagaggaauccgagggcgcuaucugguga

SEQ ID NO: 20799 - RNA, 9873 nt, Artificial Sequence
  derived and/or modified CDS sequence (opt5) from DENV-3__FJ639805__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcucggggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuuccuuacauuugugcugcuccugagcgggcagauuaccuggcgcgauauggcucacacacugaucaugauuggauccaaugccagcgacagaaugggcaugggggucaccuaccuugcgcugaucgcuacguucaagauccagcccuuucucgcccugggauucuuucuccggaaacugacaucuagagagaaccuucugcucggcguggggcuggccauggcuaccacacugcaacuuccugaagauauugagcagauggccaauggaaucgcucugggccucauggcccugaagcucauuacccaguucgagaccuaucagcuguggacagcgcuuaucucccugacguguagcaacaccauuuuuacacucaccguggccuggcgcacagcuacccugauccuggccggcgucucccuucugccgguuugccaaucuagcuccaugcggaaaacggacuggcuccccaugacaguggcugccaugggggugccuccccugccucucuucaucuuuaaucugaaggauacccuuagacgcagaucuuggccccugaacgaaggagucauggccgugggccugguuagcauucucgcuuccucucugcuucggaacgacgugccuauggcggggccccuggucgccggaggccuccugaucgcuuguuacgugauuaccgggacaagcgccgaucucaccguugagaaggccgcugacgugacaugggaagaggaagccgagcagacgggagucucccauaaucugaugaucaccguggacgaugacggcacaaugcgcauuaaagaugacgagaccgaaaacauccuuacaguccugcugaagaccgcgcuccugaucgugagcggcauuuucccguacucuaucccugcuacgcuucugguuuggcacaccuggcagaaacagacacaaagauccggggugcucugggauguccccagcccucccgagacccagaaggccgaacuggaggagggaguguaucggauuaaacagcagggcaucuuugggaagacacaaguuggagugggcguccagaaagaagggguguuccauaccauguggcacgugacacgcggagccguucucacguacaauggcaagagacuggagccgaacugggcuucugucaagaaagaccuuauuuccuauggcgggggauggcggcugagcgcccaguggcaaaagggcgaagaggugcaggugaucgcggucgaaccugggaaaaaucccaagaacuuucagaccaugccuggaacauuccagaccaccacaggcgagauuggggcuaucgcccuggauuucaaacccggaacgucuggcucccccaucauuaaucgcgagggcaaggugguugggcucuacggaaacggcguggucaccaagaaugggggauaugugagcggcaucgcccaaacaaacgcugaaccugacgggccgacccccgagcuggaagaggaaauguuuaaaaagagaaaucuuacaauuauggaucugcacccuggcuccggaaaaacccggaaguaccuccccgccaucguucgcgaggcuauuaaaagacggcugagaacgcucauccuggccccuacacgcguggucgcggccgagauggaagaggcucuuaagggccugcccauccgguaucagaccaccgccacaaagagcgaacauaccgggagagagauuguggaccugaugugccacgcuacauucaccaugcgccuccugucuccuguucgggugccgaacuacaaucuuaucauuauggaugaagcccauuuuacggaccccgccagcaucgcugcgagaggauacauuuccacacgcgucggcaugggggaggccgcugccaucuucaugaccgccacaccucccggaaccgcugaugccuuuccucagucuaacgcgcccauccaggacgaggaacgggacauuccggagagaagcuggaauuccggcaacgaauggaucacggauuucgcugggaaaaccgugugguuugugccuucuauuaaggccggcaacgacaucgccaauugucugcgcaaaaacggaaagaaagucauucaacucagccggaagacauucgauaccgaguaucagaagacaaaacugaaugacugggauuuuguugugaccacagacaucuccgagaugggcgcuaacuucaaggccgauagagugauugacccccggcgcugccugaaacccgucauccucaccgaugggccugaaagagugauccuugcgggacccaugccuguuacggccgcuucugccgcucagcggcgcggcagaguggggcggaauccgcagaaggagaacgaccaauacauuuuuacaggacagccccugaauaacgaugaagaccacgcccauuggaccgaggcuaaaaugcugcucgacaauaucaacaccccugaaggcauuauccccgcccuguucgagccugagagagaaaagagcgcggccauugauggggaguaucgccuuaagggcgaaucccggaaaacauucgucgagcugaugagacgcggagaccuccccguguggcuggcucacaagguugccagcgaaggcaucaaauacaccgaucggaaguggugcuuugacgggcagagaaauaaccagauccuggaggagaauauggauguggaaauuuggacaaaagagggagaaaagaaaaagcuccgcccgcgguggcuugacgcuagaacguauucugauccucuggcccugaaggaguucaaagacuuugccgcuggccgcaaguccaucgcgcucgaucuggucaccgaaauugggagagugcccacacaccuugcccaucggacccgcaacgcucuggacaaucucgucaugcugcacacaagcgagcauggaggcaaagccuacagacacgccguggaggaacugccugagaccauggaaacgcuccuucugcugggccucaugauccugcuuaccgggggagcuaugcuguuccucauuucuggcaaggggcugggaaaaacauccaucggccugaucuguguuauugccagcuccgggaugcucuggauggcggagaucccccuucaauggauugccucugcuaucgugcuggaguuuuucaugauggugcugcucauuccugaacccgagaagcagcggaccccgcaggauaaccaacuggccuaugucguuaucggaauucuuacacuggcugccaucaucgcggccaaugaaaugggccuccuggagaccacgaagcgcgaccugggcaugagcaaagaaccugggguggugucccccacaagcuaccucgaugucgaccuucaccccgcuucugccuggacccuguacgcuguggccacaaccguuauuaccccuaugcugagacauacaaucgagaacuccacggcuaacgugagccucgccgcgauugccaaucaggcugucgugcugaugggacuugacaagggcuggccgaucucuaaaauggaucugggggucccccuccuggcccugggaugcuauagccaggugaacccucucacccuuacagcugccguucugcugcucauuacccacuacgccaucaucggccccgggcugcaggcgaaggcuacacgggaggcccaaaaaagaaccgcugccggaauuaugaagaauccuacgguggacggcaucaugacaauugaucuugaccccgucaucuaugauuccaaguuugaaaaacagcugggccaggugaugcuccugguucugugugccgugcagcuccuucugaugcgcaccucuugggcucugugcgaggcccucacccuggcgacagggccuauuaccacacuuugggaaggaagcccgggcaaguucuggaacacgaccaucgccgucuccauggcuaauaucuuucgggggucuuaccuggccggagcuggccucgccuucagcauuaugaaauccguggggacaggaaagagaggcaccggcagccaaggggagacacugggagaaaaauggaagaagaaacugaaccagcucucucgcaaggaguuugaccuuuauaaaaaguccggcaucaccgagguggaucggacggaagcgaaagaggggcugaagagaggagaaauuacccaucacgccguuagccggggcuccgcuaaacugcagugguucgucgagcgcaauauggugauccccgaagggagagugauugaccucggauguggccggggcggguggucuuacuauugcgccggacugaagaaggucacagagguucgcggcuacaccaaagggggaccuggccaugaggaacccgugccuaugagcacauacggguggaacaucgugaagcuuauguccggaaaagaugucuuuuaucugcccccggagaagugugacacccuccugugcgauauuggcgaaucuagcccuucccccacaguggaggagagcagaaccauccggguucugaaaaugguggaacccuggcucaagaauaaccaguucuguaucaagguccuuaauccuuacaugcccacggugauugagcaccuggaacgccugcaaagaaaacacggcgggaugcucguucggaacccucugucucgcaauuccacacaugagauguauuggaucagcaacggaaccggcaauauuguggcuucugucaacaugguguccagacuucugcucaaccgguucaccaugacacacagacgcccgacgaucgaaaaggacguggaucugggggccggaacccggcaugucaaugcugagcccgagacaccuaacauggacguuauuggcgaaagaaucaaacgcaucaaggaggaacacaauagcaccuggcacuacgacgaugagaaccccuauaaaacaugggccuaccaugggucuuaugaagugaaggcgaccggaagcgccuccucuaugauuaauggcguggucaagcugcucacaaaaccuugggacgugguucccauggugauccagauggcuaugaccgauacgaccccguuuggccagcaacgggucuucaaggagaaaguggacacaagaaccccucgcagcaugcccgggacacggagaguuaugggaauuaccgccgaguggcuguggcgcacgcuuggccggaacaagaaaccuagacugugcacacgcgaagaguuuaccaagaaggugcggacaaaugcugccaugggggccgucuucaccgaagagaaccagugggauuccgcgaaagcugccguggaagacgaggauuuuuggaagcucguugacagagagcgcgaacugcacaaacuuggaaaguguggcagcugcguguacaauaugauggggaaaagagagaagaaacugggcgaauucggaaaggccaagggcucccgggcuaucugguacauguggcucggggcccgcuaucuggaguuugaggcucugggauuccucaacgaagaucauugguuuucuagagagaauagcuacuccggcgucgaaggggagggacugcacaaacuuggcuauauucugcgggacaucucuaagauccccgggggcgccauguacgcggaugacacggccggaugggacaccagaauuacagaagaugaccuccauaacgaggagaaaaucacccagcagauggauccugaacaccggcaacuggcuaaugccauuuucaagcuuacauaucagaacaaaguggucaaggugcagcgccccaccccgacaggcaccguuauggacaucauuagcagaaaggaucagcggggguccggacaagugggcacguacgggcugaauacauuuaccaacauggaggcucagcucauccgccagauggaaggagagggcguccugucuaaagccgaccuggaaaacccucaccuccccgagaagaaaaucacccaguggcuggagacaaaggggguggaaagacuuaaacggauggcgauuagcggcgaugacugcgugguuaagcccaucgaugaccgcuucgccaaugcucugcucgcccugaacgauaugggaaaggugagaaaagacauuccucaauggcagccguccaagggcuggcaugauuggcagcagguccccuuuuguagccaccauuuccacgagcuuaucaugaaagacgggcggaagcuggugguuccuugccgcccccaagacgaacucauuggaagagcucggaucucucagggcgccggguggucccugcgcgagaccgcuugucugggaaaagccuaugcgcagauguggagccucauguacuuccacagacgggaucugcgccuugccucuaaugcuauuugcuccgccgugccuguccauugggugcccacaagcagaacgaccuggucuauccacgcccaucaccaauggaugacaaccgaagacaugcugacagucuggaaccggguguggaucgaggauaauccuuggauggaggacaagacccccguuacgaccugggaaaacgugccguaccucggcaagagagaggaucaguggugugggucccugauuggccuuacaagccgcgcuaccugggcccagaauaucccuacagcgauucagcaaguccggucccugaucggaaacgaagaguuucucgacuauaugcccagcaugaaaagauuccgcaaggaggaagagucugaaggcgcuauuugguga

SEQ ID NO: 20800 - RNA, 9873 nt, Artificial Sequence
  derived and/or modified CDS sequence (opt5) from DENV-3__FJ639807__SS-prME
acaagccugugccucaugaugauccugcccgccgcucuugccuuccaccugacaucccgggacggagagccucggaugauuguggggaagaacgaacgcggaaaaucucuccuguuuaagacggcgagcggcaucaauauguguacccuuauugcuauggaucugggggaaaugugcgacgauacagugaccuacaaauguccgcacaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacacgaucggagugcuggagcagggcaaacggacccuuacaccucagcccauggagcugaaguacucuuggaaaaccugggggaaggccaagauugucacagccgaaacccaaaacuccagcuucaucauugauggaccuaauacacccgagugcccgucugcuuccagagcguggaacgugugggaaguggaggacuauggcuuuggcgucuucaccacgaauaucuggcucaaacugcgcgaaguuuacacacagcugugugaccaccggcuuaugagcgccgcugugaaggaugagagagccgugcacgccgacaugggguacuggaucgagucccagaaaaacggaucuuggaagcucgaaaaagcuagccugauugaggucaagaccugcaccuggccuaagucccauacacuguggucuaauggcgugcucgaaagcgauaugaucauucccaaaucccuggccgggccuaucagccagcacaacuaucgccccggauaccauacccaaacggcgggcccuuggcaccuugggaagcuggagcucgacuuuaauuauugcgagggaacaaccguugugauuacagaaaacuguggcacccggggccccucucugagaacaaccacggucuccgggaaacugauccacgaguggugcugucgcagcugcacccuuccgccucuccgguacaugggagaagauggcuguugguaugggauggagaucagacccauuucugaaaaggaggagaauauggugaaaucccugguuagcgcuggaucuggcgaaguggacaacuucacaauggggguccugugccucgccauccuguuugaggaagugaugcggggaaaguucggcaagaaacauaugauugccggcguuuucuuuaccuucgugcuucugcucagcgggcagaucacauggcgcgauauggcucacacccugauuaugaucggauccaaugccagcgacagaaugggcaugggggucacguaccuggcgcuuauugcuacauuuaagauccagcccuuccuggcccucggauuuuuccugcggaaacucaccucuagagagaaccugcuucugggcguggggcucgccauggcuacaacccugcaacugccugaagauaucgagcagauggccaauggaauugcucuuggccugauggcccucaagcugaucacccaguuugagacauaucagcucuggacggcgcugauuucccuuaccuguagcaacacaaucuucacccugacaguggccuggcgcaccgcuacgcucauucuggccggcgucucccugcuuccgguuugccaaucuagcuccaugcggaaaacagacuggcugcccaugaccguggcugccaugggggugccuccccucccucuguuuaucuucucucucaaggauacccugaagagacgcagcuggccccuuaaugaaggagucauggccgugggccugguuuccauccuggcuucuagccuccugagaaacgacgugccuauggcggggccccuugucgccggaggccugcucauugcuuguuacgugaucacagggaccuccgccgaucugacaguugagaaagccgcugacgugacgugggaagaggaagccgagcagaccggagucagccauaaccucaugauuacaguggacgaugacggcaccaugcggaucaaggaugacgagacagaaaauauucugaccguccuucugaaaacggcgcugcucaucgugucuggcaucuuuccguacuccauuccugcuacccugcuuguuuggcacacauggcagaagcagacccaacgcagcggggugcugugggauguccccucuccucccgagacacagaaagccgaacucgaggagggaguguauagaaucaagcagcagggcauuuucgggaaaacccaaguuggagugggcguccagaaggaagggguguuucauacaauguggcacgugacgcggggagccguucugaccuacaacggcaagcgccucgagccgaauugggcuuccgucaaaaaggaccugaucagcuauggcgggggauggagacuuucugcccaguggcaaaaaggcgaagagguccaggugauugcggucgaaccugggaagaaccccaaaaauuuccagacaaugccuggaaccuuccagaccacaacgggcgagaucggggcuauugcccuggauuuuaagcccggaaccuccggcagccccaucaucaaccgggagggcaaggugguugggcuguacggaaauggcguggucaccaagaacgggggauauguguccggcauugcccaaaccaaugcugaaccugacgggccgacacccgagcucgaagaggaaauguucaagaaacgcaaccugaccaucauggaucuucacccuggcagcggaaagacgagaaaauaccugcccgccauuguucgggaggcuaucaagcgcagacuccggacacugauucucgccccuaccagaguggucgcggccgagauggaagaggcucugaagggccuucccauccgcuaucagaccacagccaccaaaucugaacauacagggcgggagaucguggaccugaugugccacgcuaccuuuacgaugagacugcucagcccuguucgcgugccgaauuacaaccugauuaucauggaugaagcccauuucacagaccccgccuccauugcugcgcggggauacaucucuaccagagucggcaugggggaggccgcugccauuuuuaugacagccaccccucccggaacggcugaugccuucccucagagcaaugcgcccauccaggacgaggaacgcgacaucccggagcgguccuggaacucuggcaaugaauggauuaccgauuuugcugggaagacagugugguucgugccuagcaucaaagccggcaacgacauugccaacugucuuagaaagaauggcaaaaaggucauccaacugucccgcaagaccuuugauacagaguaucagaaaaccaagcucaacgacugggauuucguugugacaaccgacauuucugagaugggagcuaauuuuaaagccgaucgggugaucgaccccagacggugccugaagcccgucauucugacggaugggccugaacgcgugauccucgcgggacccaugccuguuacagccgcuagcgccgcucagagacggggccgcguggggagaaacccgcagaaagagaaugaccaauacaucuucaccggacagccccuuaacaaugaugaagaccacgcccauuggaccgaggcuaagaugcugcuggacaacauuaauacaccugaaggcaucauucccgcccucuucgagccugagcgggaaaaguccgcggccaucgauggggaguauagacugaaaggcgaaagccgcaagaccuuugucgagcuuaugcggagaggagaccugcccguguggcucgcucacaaaguugccucugaaggcauuaaguacacagaucgcaaauggugcuucgacgggcagcggaacaaucagauccuggaggagaacauggauguggaaaucuggacgaaggagggagagaagaagaagcugagaccgcgcuggcucgacgcucggaccuauuccgauccucuugcccugaaagaguuuaaggacuucgccgcuggcagaaaaagcauugcgcuggaucucgucacagaaaucgggcgcgugcccacccaccuggcccauagaacacggaaugcucuugacaaccuggucaugcuccacaccucugagcauggaggcaaggccuaccgccacgccguggaggaacugccugagacgauggaaacccugcuccuucugggccugaugauucuccugacagggggagcuaugcuuuuucugaucuccggcaaagggauuggaaagaccagcaucggccucaucuguguuauugccuccucugggaugcuguggauggcggagaucccccugcaauggauugccagcgcuaucgugcucgaguucuuuaugauggugcuucugauuccugaacccgagaagcagagaacaccgcaggauaaucaacuggccuaugucguuaucggcauucucacccuggcugccacgaucgcggccaacgaaaugggccuucuggagacaaccaaacgggaccucggcauguccaaggaaccugggguggugagccccacaucuuaccuggaugucgaccugcaccccgcuuccgccuggacccucuacgcuguggccaccacaguuaucacgccuaugcuucgccauaccauugagaauagcacagcuaacgugucucuggccgcgaucgccaaccaggcugucgugcugaugggacucgacaaaggcuggccgauuagcaagauggaucugggggucccccuucuggcccucggaugcuauucccaggugaauccucugacccugacagcugccguucuccuucugaucacccacuacgccauuaucggccccgggcugcaggcgaaagcuacgagagaggcccaaaagcggacagcugccggaaucaugaagaacccuaccguggacggcauuaugaccaucgaucucgaccccgucauuuaugauucuaaauucgaaaagcagcugggccaggugaugcuucugguucucugugccgugcagcugcugcucaugagaacaagcugggcucuuugcgaggcccugacccuggcgacagggccuaucacgacccucugggaaggauccccgggcaaauuuuggaauacaaccauugccgucucuauggcuaacaucuuccgcgggagcuaccuggccggagcuggccuugccuuuuccaucaugaaaagcguggggacaggaaaacggggcaccggcucucaaggggagacgcugggagaaaaguggaagaaaagacucaaucagcugucccgcaaggaguucgaccuguauaaaaagagcggcauuaccgagguggaucggacagaagcgaaagaggggcucaagagaggagaaaucacccaucacgccguuucccggggcucugcuaaacuucagugguuugucgagcgcaacauggugauucccgaagggagagugaucgaccugggauguggccggggcggguggagcuacuauugcgccggacugaagaaggucacagagguucgcggcuacaccaaagggggaccuggccaugaggaacccgugccuauguccacauacggguggaauauugugaagcucaugucuggaaaagaugucuucuaucugcccccggagaagugugacacccuucugugcgauaucggcgaaagcuccccuagccccacgguggaggagucuagaacaauucggguucucaaaaugguggaacccuggcugaagaacaaucaguucuguaucaagguccugaacccuuacaugcccaccgugaucgagcaccucgaacgccuucaaagaaaacacggcgggaugcugguucggaauccucugucccgcaacagcacccaugagauguauuggauuucuaauggaacaggcaacaucguggcuuccgucaauauggugagcagacuccugcuuaaccgguuuacgaugacccacagacgcccgacaauugaaaaggacguggaucugggggccggaacccggcaugucaacgcugagcccgagacaccuaauauggacguuaucggcgaaagaauuaaacgcaucaaggaggaacacaacucuaccuggcacuacgacgaugagaaucccuauaaaacaugggccuaccaugggagcuaugaagugaaggcgaccggauccgccucuagcaugaucaacggcguggucaagcuccugacgaaaccuugggacgugguucccauggugacccagauggcuaugacagauaccacaccguucggccagcaacgggucuuuaaggagaaaguggacaccagaacgccucgcuccaugcccgggacacggagaguuaugggaauuaccgccgaguggcuguggcgcacacucggccggaauaagaaaccuagacugugcacccgcgaagaguucacgaagaaggugcggaccaacgcugccaugggggccgucuuuacagaagagaaucagugggauagcgcgaaagcugccguggaagacgaggauuucuggaaacuuguugacagagagcgcgaacugcacaaacucggaaaguguggcuccugcguguacaacaugauggggaaaagagagaagaaacugggcgaauuuggaaaggccaagggcucucgggcuaucugguacauguggcuuggggcccgcuaucuggaguucgaggcucucggauuucugaaugaagaucauugguucagcagagagaacuccuacucuggcgucgaaggggagggacugcacaaacucggcuauauucugcgggacaucagcaagauucccgggggcgccauguacgcggaugacaccgccggaugggacacaagaaucaccgaagaugaccuucauaaugaggagaaaaucacacagcagauggauccugaacaccggcaacuggcuaacgccauuuuuaagcucaccuaucagaauaaaguggucaaggugcagcgccccacgccgacaggcaccguuauggacaucauuuccagaaaggaucagcgggggucuggacaagugggcaccuacgggcugaacacauucaccaauauggaggcucagcuuauccgccagauggaaggagagggcguccugagcaaagccgaccucgaaaacccucaucugcccgagaagaaaauuacacaguggcuggagacgaaggggguggaaagacucaaacggauggcgaucuccggcgaugacugcgugguuaagcccaucgaugaccgcuuugccaacgcucugcuugcccugaaugauaugggaaaggugagaaaagacauuccucaauggcagccgagcaagggcuggcaugauuggcagcagguccccuucuguucucaccauuuccacgagcucaucaugaaagacgggcggaagcuggugguuccuugccgcccccaagacgaacuuauuggacgggcucggaucucccagggcgccggguggagccugcgcgagaccgcuugucucggaaaagccuaugcgcagauguggucucugauguacuuucacagacgggaucugcgccucgccuccaacgcuauuugcagcgccgugccuguccauugggugcccacaucuagaaccacaugguccauccacgcccaucaccaauggaugaccacggaagacaugcugaccgucuggaaucggguguggauugaggauaacccuuggauggaggacaagacacccguuaccacaugggaaaaugugccguaccuuggcaagagagaggaucaguggugugggagccugaucggccucaccucccgcgcuacgugggcccagaacaucccuacagcgauucagcaaguccggagccugaucggaaaugaagaguuccuugacuauaugcccucuaugaaaagauuucgcaaggaggaagagagcgaaggcgcuauuugguga

SEQ ID NO: 20801 - RNA, 9873 nt, Artificial Sequence
  derived and/or modified CDS sequence (opt5) from DENV-3__FJ639810__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcucggggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacacagggugugucaucaauuggaaaggaaaggagcugaagugcggcagcgggauuuucgugacgaacgagguucauaccuggacagaacaguacaaauuucaagccgauucccccaagcggcuggcgaccgccaucgcuggcgccugggagaauggaguguguggcauuagaagcacaacccgcauggaaaaccuucucuggaaacagaucgcuaaugagcugaacuauauccugugggaaaauaacauuaagcucacggucgugguuggggacaucauuggagugcuggagcagggcaaacggacccuuacaccucagcccauggagcugaaguacucuuggaaaaccugggggaaggccagaaucgucacagccgaaacccaaaacuccagcuucauuaucgauggaccuaauacacccgagugcccgaacaccucucgcgcuuggaaugugugggaaguggaggacuauggcuuuggcgucuucacgacaaacaucuggcucaagcugcgggaaguuuacacccagcugugugaccacagacuuauguccgcggccgugaaagaugagcgcgcugugcacgccgacaugggguacuggauugagagccagaagaauggauccuggaaacucgaaaaggccucucugaucgaggucaaaaccugcacauggccuaagagccauacccugugguccaacggcgugcucgaaucugauaugauuauccccaagagccuggcugggccuauuucccagcacaauuaucggcccggauaccauacgcaaacagccggcccuuggcaccuugggaaacuggagcucgacuuuaacuauugcgagggaaccacaguugugaucaccgaaaauuguggcacaagaggccccagccugcgcaccacgaccgucucugggaagcugauccacgaguggugcugucgguccugcacacuuccgccucucagauacaugggagaagauggcuguugguaugggauggagauucggcccaucagcgaaaaagaggagaacauggugaagucucugguuuccgcgggaagcggcgaaguggacaauuucaccauggggguccugugccucgcuauucuguuugaggaagugaugcgcggaaaauucggcaagaagcauaugaucgccggcguucuuuucacauuugugcugcuccugucugggcagauuaccuggagagauauggcccacacgcugaucaugauuggaagcaacgcuuccgaccggaugggcaugggggucacauaccuugcccugaucgcgaccuucaaaauccagcccuuucucgcucugggauucuuucucagaaagcugacaagccgcgagaaucuucugcucggcguggggcuggccauggccaccacccugcaacuuccugaagauauugagcagauggcuaacggaaucgcccugggccucauggcucugaaacucauuacacaguucgagacguaucagcuguggaccgcccuuaucucucugacauguuccaauaccauuuuuacacucaccguggcguggcggacggccacacugauccuggcuggcgucagccuucugccgguuugccaauccucuagcaugagaaagaccgacuggcuccccaugaccguggccgcuaugggggugccuccccugccucucuucaucuuuugucugaaagauacacuuaagcgcagauccuggccccugaacgaaggagucauggccgugggccugguuucuauucucgccagcucccugcuucggaacgacgugccuauggcugggccccuggucgcgggaggccuccugaucgccugcuacgugauuaccgggacaucugcugaucucacgguugagaaggccgccgacgugaccugggaagaggaagcugagcagacaggagucagccauaaucugaugaucaccguggacgaugacggcacaaugcgcauuaaagaugacgagaccgaaaacauccuuacgguccugcugaagaccgcccuccugaucguguccggcauuuucccguacagcaucccugcgacacuucugguuuggcacaccuggcagaaacagacacaaagaucuggggugcucugggauguccccuccccucccgagacccagaaggcugaacuggaggagggaguguaucggauuaaacagcagggcaucuuugggaagacacaaguuggagugggcguccagaaagaagggguguuccauacgauguggcacgugacccgcggagccguucucacauacaauggcaagagacuggagccgaacugggccagcgucaagaaagaccuuauuucuuauggcgggggauggcggcuguccgcucaguggcaaaagggcgaagaggugcaggugaucgccgucgaaccugggaaaaaucccaagaacuuucagaccaugccuggaaccuuccagacaacgaccggcgagauuggggcgaucgcucuggauuucaaacccggaacaagcggcucucccaucauuaaucgcgagggcaaggugguugggcucuacggaaacggcguggucaccaagaaugggggauauguguccggcaucgcccaaacaaacgccgaaccugacgggccgacccccgagcuggaagaggaaauguuuaaaaagagaaaucuuacgauuauggaucugcacccuggcagcggaaaaacacggaaguaccuccccgcuaucguucgcgaggccauuaaaagacggcugagaacccucauccuggcuccuacccgcguggucgccgcggagauggaagaggcccuuaagggccugcccauccgguaucagacaaccgcuacaaaguccgaacauaccgggagagagauuguggaccugaugugucacgccacguucacaaugcgccuccugagcccuguucgggugccgaacuacaaucuuaucauuauggaugaagcucauuuuaccgaccccgccucuaucgccgcuagaggauacauuagcacacgcgucggcaugggggaggcggccgcuaucuucaugaccgccacgccucccggaaccgccgaugcuuuuccucaguccaacgcccccauccaggacgaggaacgggacauuccggagagaucuuggaauagcggcaacgaauggaucacagauuucgcggggaaaaccgugugguuugugccuuccauuaaggcuggcaacgacaucgccaauugccugcgcaaaaacggaaagaaagucauucaacucucucggaagacauucgauaccgaguaucagaagacaaaacugaaugacugggauuuuguugugaccacggacaucagcgagaugggcgccaacuucaaggcugauagagugauugacccccggcgcugccugaaacccgucauccucacagaugggccugaaagagugauccuugccggacccaugccuguuaccgcggccuccgcugcccagcggcgcggcagaguggggcggaauccgcagaaggagaacgaccaauacauuuuuaccggacagccccugaauaacgaugaagaccacgcucauuggacagaggccaaaaugcugcucgacaauaucaacaccccugaaggcauuaugcccgcucuguucgagccugagagagaaaagucugccgcgaucgauggggaguaucgccuuaagggcgaaagccggaaaacauucgucgagcugaugagacgcggagaccuccccguguggcuggcccacaagguugcuuccgaaggcauuaaauacacggaucggaagugguguuuugacgggcagagaaauaaccagauccuggaggagaauauggauguggaaaucuggaccaaagagggagaaaagaaaaagcuccgcccgcgguggcuugacgccagaacauauagcgauccucuggcucugaaggaguucaaagacuuugccgccggccgcaagucuauugcucucgaucuggucaccgaaaucgggagagugcccacacaccuugcgcaucggacccgcaacgcccuggacaaucucgucaugcugcacacguccgagcauggaggcaaagcuuacagacacgccguggaggaacugccugagaccauggaaacacuccuucugcugggccucaugauucugcuuaccgggggagccaugcuguuccucaucagcggcaaggggauuggaaaaacaucuaucggccugaucugcguuauugcuuccagcgggaugcuguggauggccgagaucccccuccaauggauugcguccgccaucgugcuugaguuuuucaugauggugcugcugauuccugaacccgagaagcagcggaccccgcaggauaaccaacucgcuuaugucguuaucggaauucugacgcuugccgcuaucaucgccgcgaaugaaaugggccugcucgagacaaccaagcgcgaccugggcaugucuaaagaaccugggguggugagccccacauccuaccuggaugucgaccuccaccccgccagcgcuuggacccuuuacgccguggcuaccacaguuauuacgccuaugcugagacauaccaucgagaacucuacagccaacgugucccuggcugccauugcgaaucaggccgucgugcucaugggacuggacaagggcuggccgaucagcaaaauggaucuuggggucccccugcucgcucugggauguuauucucaggugaacccucugacccucacagccgcuguucuucugcugauuacccacuacgccaucaucggccccgggcuccaggccaaggcgacgcgggaggcucaaaaaagaacagccgcuggaauuaugaagaauccuaccguggacggcaucaugaccauugaucuggaccccgucaucuaugauagcaaguuugaaaaacagcuuggccaggugaugcugcucguucugugcgccgugcagcugcuccuuaugcgcacauccugggcccugugugaggcucugacccucgccacagggccuauuacgacccugugggaaggaucuccgggcaaguucuggaacacaaccaucgcggucagcauggccaauaucuuucggggguccuaccuugcuggagccggccuggcuuucucuauuaugaaaagcguggggacaggaaagagaggcaccggcucccaaggggagacgcucggagaaaaauggaagaagaaacugaaccagcugagccgcaaggaguuugaccucuauaaaaagucuggcaucaccgagguggaucggacagaagccaaagaggggcuuaagagaggagaaauuacccaucacgcgguuucccggggcagcgccaaacugcagugguucgucgagcgcaauauggugauccccgaagggagagugauugaccugggaugcggccggggcgggugguccuacuauugugcuggacucaagaaggucacagagguucgcggcuacaccaaagggggaccuggccaugaggaacccgugccuaugucuacauacggguggaacaucgugaagcugaugagcggaaaagaugucuuuuaucuucccccggagaagugcgacacccugcucugugauauuggcgaauccucuccuagccccacgguggaggaguccagaacaauccggguucugaaaaugguggaacccuggcugaagaauaaccaguucugcaucaagguccucaauccuuacaugcccgccgugauugagcaccuugaacgccugcaaagaaaacacggcgggaugcugguucggaacccucucagccgcaauucuacccaugagauguauuggaucuccaacggaaccggcaauauuguggcuagcgucaacauggugucuagacugcuucugaaccgguucacaaugacgcacagacgcccgaccaucgaaaaggacguggaucucggggccggaacacggcaugucaaugcugagcccgagaccccuaacauggacguuauuggcgaaagaaucaaacgcaucaaggaggaacacaauuccacauggcacuacgacgaugagaaccccuauaaaaccugggccuaccaugggagcuaugaagugaaggcgacaggaucugccagcuccaugauuaauggcguggucaagcugcugaccaaaccuugggacgugguucccauggugacgcagauggcuaugaccgauacaaccccguuuggccagcaacgggucuucaaggagaaaguggacacaagaaccccucgcucuaugcccgggacgcggagaguuaugggaaucacagccgaguggcucuggcgcacccugggccggaacaagaaaccuagacuuuguacacgcgaagaguuuaccaagaaggugcggacgaaugcugccaugggggccgucuucaccgaagagaaccagugggauagcgcgaaagcugccguggaagacgaggauuuuuggaagcugguugacagagagcgcgaacuccacaaacugggaaagugcggcuccugcguguacaauaugauggggaaaagagagaagaaacuuggcgaauucggaaaggccaagggcagccgggcuauuugguacauguggcugggggcccgcuaucucgaguuugaggcucugggauuccugaacgaagaucauugguuuuccagagagaauucuuacagcggcgucgaaggggagggacuccacaaacugggcuauauccuucgggacauuuccaagauccccgggggcgccauguacgcggaugacacagccggaugggacaccagaaucacagaagaugaccuguauaacgaggagaaaauuacccagcagauggauccugaacaucggcaacucgcuaaugccaucuucaagcugacauaccagaacaaaguggucaaggugcagcgccccaccccgacgggcacaguuauggacauuaucucuagaaaggaucagcgggggagcggacaagugggcaccuaugggcuuaauaccuuuacaaacauggaggcucagcugauucgccagauggaaggagagggcguccucuccaaagccgaccuggaaaacccucaccugcccgagaagaaaaucacccaguggcucgagacaaaggggguggaaagacugaaacggauggcgaucucuggcgaugacugugugguuaagcccauugaugaccgcuucgccaaugcucuucuggcccucaacgauaugggaaaggugagaaaagacaucccucaauggcagccgagcaagggcuggcacgauuggcagcagguccccuuuugcucccaucacuuccaugagcugauuaugaaagacgggcggaagcuugugguuccuugucgcccccaagacgaacugaucggaagagcucggauuagccagggcgccggguggucucuccgcgagacggcuugccugggaaaagccuacgcgcagauguggucccugauguacuuccacagacgggaucuccgccuggccagcaaugcuaucuguucugccgugccuguccacugggugcccaccuccagaacaaccuggagcauucaugcccaccaucaauggaugacaaccgaagacaugcuuacggucuggaaccggguguggaucgaggauaauccuuggauggaggacaagacccccguuacaaccugggaaaacgugccguaucugggcaagagagaggaucaguggugcgggucucucaucggccugacaucccgcgcuaccugggcccagaauauuccuacggcgauccagcaaguccggagccuuauuggaaacgaagaguuucuggacuacaugcccuccaugaaaagauuccgcaaggaggaagagagcgaaggcgcuaucugguga

SEQ ID NO: 20802 - RNA, 9873 nt, Artificial Sequence
  derived and/or modified CDS sequence (opt5) from DENV-3__FJ639816__SS-prME
accagccugugccucaugaugauccugcccgccacacuugcuuuccaccugacguccagagacggcgagccucggaugauuguggggaagaacgaacgcggaaaaucucuccuguuuaagaccgccagcggcaucaauauguguacacuuauugcgauggaucugggggagaugugcgacgauaccgucacauacaaauguccgcauaucaccgaaguugagcccgaagacauugauugcugguguaaccucacauccaccugggugacguauggaaccugcaaucaggcuggcgagcacagacgggacaagcgcucuguggcccuggccccucaugucgggaugggacuggauacaagaacccaaacauggaugagcgcugagggcgccuggcggcagguggaaaaaguugagaccugggcucuccgccaccccggcuucacgauccuggcccuuuuucuggcgcauuacaucgggacaucccucacccagaagguggucauuuucauccugcuuaugcuggugacaccuucuaugaccaugagauguguuggagugggcaaccgggacuuugucgaagggcucagcggagccaccuggguggaugugguccuggagcacggcgggugcguuacaacgauggcuaagaauaaacccacccuggacauugagcuccagaagacagaagccacccaacuggcuacacuucgcaaacuguguaucgagggaaagauuaccaacaucacgacagauuccagaugcccuacccagggcgaagccgugcucccggaggaacaggaccagaauuauguguguaaacacaccuacgucgaucggggcugggggaacggaugcggccuguucgggaagggaagccuugugacaugcgcgaaguuucaaugucuggagcccauugagggcaaaguugugcaguaugaaaaucucaaguacaccgucaucaucacagugcauacgggggaccagcaccagguuggaaacgagacccaaggcgugacagccgaaauuaccccucaggcuucuacaaccgaggccauccugcccgaauauggcacgcuggggcucgagugcuccccucgcaccggacuggacuucaaugagaugauucuucugacaaugaaaaacaaggcuuggaugguccauagacagugguuuuucgaucucccccugccguggaccagcggcgccacaaccgaaacgccuacauggaaucggaaagagcuucuggugaccuuuaagaacgcccacgcuaaaaagcaagaagucgugguucucgggucucaggagggagcgaugcacacagcccugaccggcgcuaccgaaauccagaauuccgggggcacaagcauuuucgccggacaucugaagugucgccucaaaauggacaagcuggagcuuaaaggcaugucuuacgccaugugcacgaacaccuuugugcugaagaaagaggucuccgaaacacagcacgggaccauccucaucaagguggaguacaagggagaagauguucccuguaaaauuccuuucagcacagaggacgagcaaggcaaggcucauaacgggagacugaucaccgccaaucccguggucacgaaaaaggaagagcccgugaacauugaagcggagccuccguucggagaauccaauaucgugauuggcaucggggauaacgcucugaaaaucaauugguauaagaagggcucuagcauuggaaaaauguuugaggccacagcccggggcgcuagacgcauggccauccuuggggacaccgcuugggauuucggauccguuggcgggguccucaacagccugggaaagauggugcaccagauuuuuggcucugccuacaccgcgcuguucuccggggugagcugggucaugaaaaucggcauuggagugcuccugacauggaucggccuuaauucuaagaacaccagcauguccuuuucuugcauugccaucgggaucauuacacuguaucucggagcuguugugcaggccgacaugggcugugucaucaauuggaaagggaaggagcugaagugcggaagcggcauuuucgugacgaacgaaguucauaccuggacagagcaguacaaauuucaagcugauucccccaagcggcuggccaccgcgaucgccggggcuugggaaaauggcguguguggaauuagaagcacaacccgcauggagaaccuucucuggaaacagaucgccaaugaacugaacuauauccugugggagaauaacauuaagcucacggucgugguuggcgacaucauuggggugcuggagcagggaaaacggacccuuacaccucagcccauggaacugaaguacucuuggaaaaccuggggcaaggcuagaaucgucacagccgagacccaaaacuccagcuucauuaucgaugggccuaauacacccgaaugcccgucugccucccgcgcuuggaacgugugggagguggaagacuauggauuuggcgucuucaccacgaauaucuggcucaagcugcgggagguuuacacacagcugugugaccacagacuuaugagcgcggccgugaaagaugagcgcgcugugcacgccgacaugggcuacuggauugaaucccagaagaacgggucuuggaaacucgagaaggccagccugaucgaagucaaaaccugcaccuggccuaagucccauacacuguggucuaauggagugcucgagagcgauaugauuauccccaagucccuggcuggcccuauuagccagcacaacuaucggcccggguaccauacccaaacggccggaccuuggcaccuuggcaaacuggagcucgacuuuaauuauugcgaagggacaaccguugugaucacagagaacuguggaaccagaggccccucucugcgcacaaccacggucuccggcaagcugauccacgaauggugcugucggagcugcacccuuccgccucucagauacaugggggaggauggauguugguauggcauggaaauucggcccaucucugagaaagaggaaaauauggugaagucccugguuagcgcggggucuggagagguggacaacuucacaaugggcguccugugccucgcuauucuguuugaagaggugaugcgcgggaaauucggaaagaagcauaugaucgccggcguuuucuuuaccuucgugcuucugcucagcggccagauuacauggagagauauggcccacacccugaucaugauuggguccaaugcuagcgaccggaugggaaugggcgucacguaccuggcccuuaucgcgacauuuaaaauccagcccuuccuggcucucggguuuuuccugagaaagcucaccucucgcgaaaaccugcuucugggagugggccucgccauggccacaacccugcaacugccugaggauauugagcagauggcuaaugggaucgcccuuggacugauggcucucaaacugauuacccaguuugaaacauaucagcucuggacggcccugaucucccuuaccuguagcaacacaauuuucacccugacaguggcguggcggaccgccacgcucauccuggcuggcgucucccugcuuccgguuugccaaucuagcuccaugagaaagacagacuggcugcccaugaccguggccgcuaugggcgugccuccccucccucuguuuaucuucucucucaaagauacccugaagcgcagaagcuggccccuuaaugagggggucauggccgugggacugguuuccauucuggccucuagccuccugcggaacgacgugccuauggcuggcccccuugucgcggggggacugcucaucgccuguuacgugauuacaggcaccuccgcugaucugacaguugaaaaggccgccgacgugacgugggaggaagaggcugagcagaccggggucagccauaaccucaugaucacaguggacgaugacggaaccaugcgcauuaaagaugacgaaacagagaauauccugaccguccuucugaagacggcccugcucaucgugucuggcauuuuuccguacuccaucccugcgacccugcuuguuuggcacacauggcagaaacagacccaaagaagcggcgugcugugggauguccccucuccucccgaaacacagaaggcugagcucgaggaagggguguaucggauuaaacagcagggaaucuucggcaagacccaaguuggggugggaguccagaaagagggcguguuucauacaauguggcacgugacgcgcggggccguucugaccuacaacggaaagagacucgaaccgaauugggccuccgucaagaaagaccugauuagcuauggcggcggguggcggcuuucugcucaguggcaaaagggagaggaagugcaggugaucgccgucgagccuggcaaaaaccccaagaauuuccagacaaugccugggaccuuccagaccacaacgggagagauuggcgcgaucgcucuggauuuuaaacccgggaccuccggaagccccaucauuaaccgcgaaggcaagaucgugggccuguacgggaauggaguugugacaaagaacggcggguaugucuccggaauugcccaaaccaaugccgagccugacggcccgacacccgaacucgaggaagagauguucaaaaagagaaaccugaccaucauggaucuucacccugggagcggcaaaacgcggaaguaccugcccgcuauugugcgcgaggccaucaaaagacggcucagaacacugauccucgcuccuacccgcguuguggccgcggaaauggaggaagcccugaagggacuucccauucgguaucagaccacagcuaccaagucugagcauacaggcagagaaaucgucgaccugaugugccacgccaccuuuacgaugcgccugcucagcccugugcggguuccgaauuacaaccugauuaucauggaugaggcucauuucacagaccccgccuccauugccgcuagaggguacaucucuacccgcgugggaaugggcgaggcggccgcuaucuuuaugacagccaccccucccgggacggccgaugcuuucccucagagcaaugcccccauucaggacgaagagcgggacaucccggaaagauccuggaacucuggaaaugaguggauuaccgauuuugcgggcaaaacagucugguucgugccuagcaucaaggcugggaacgacauugccaacugucuucgcaaaaauggcaagaaagugauccaacugucccggaagaccuuugauacagaguaucagaagaccaaacucaacgacugggauuucgucguuacaaccgacauuucugaaaugggagccaauuuuaaggcugauagagugaucgacccccggcgcugccugaaacccgugauccugacggauggcccugagagagucauucucgccgggcccaugccugugacagcggccagcgcugcccagcggcgcggaagaguuggccggaacccgcagaaggaaaaugaccaauacaucuucaccgggcagccccuuaacaaugaugaggaccacgcucauuggaccgaagccaaaaugcugcuggacaacauuaauacaccugagggaaucauucccgcucucuucgagccugaaagagagaaguccgccgcgaucgauggcgaauaucgccugaagggggagagccggaaaaccuuuguggaacuuaugagacgcggcgaccugcccgucuggcucgcccacaagguggcuucugagggaaucaaauacacagaucggaaguggugcuucgacggccagagaaacaaucagauucuggaggaaaacauggauguugagaucuggacgaaagaaggggagaagaaaaagcugcgcccgcgguggcucgacgccagaaccuauuccgauccucuugcucugaaggaauuuaaagacuucgccgccggacgcaagagcauugcucuggaucucgugacagagaucggcagaguccccacccaccuggcgcaucggacacgcaaugcccuugacaaccuggugaugcuccacaccucugagcaugggggaaaagcuuacagacacgccgucgaagagcugccugaaacgauggagacccugcuccuucugggccugaugauucuccugacaggcggggccaugcuuuuucugaucuccggaaagggcaucgggaaaaccagcauuggacucaucugugugauugcuuccucuggcaugcuguggauggccgagaucccccugcaauggauugcgagcgccaucguucucgaauucuuuaugauggugcuucugauuccugagcccgaaaagcagcggacaccgcaggauaaucaacuggcuuauguggucaucgggauccucacccuggccgcuacgauugccgcgaacgagaugggacuucuggaaacaaccaagcgcgaccucggcauguccaaagagccuggcguugugagccccacaucuuaccuggauguggaccugcaccccgccuccgcuuggacccucuacgccgucgcuaccacagugaucacgccuaugcuuagacauaccauugagaauagcacagccaacguuucucuggcugccaucgcgaaccaggccgugguccugauggggcucgacaagggauggccgauuagcaaaauggaucugggcgugccccuucuggcucucgggugcuauucccaggucaauccucugacccugacagccgcugugcuccuucugaucacccacuacgccaucauuggacccggccugcaggccaaggcgacgcgggaagcucaaaaaagaacagccgcugggaucaugaagaacccuaccguugacggaauuaugaccaucgaucucgaccccgugauuuaugauucuaaguucgagaaacagcugggccaggucaugcuucuggugcucugugccguucagcugcugcucaugcgcacaagcugggcccuuugcgaagcucugacccuggccacaggcccuaucacgacccucugggagggguccccgggaaaguuuuggaauacaaccaucgcggugucuauggccaacauuuuccggggcagcuaccuggcuggggccggacuugcuuuuuccgucaugaaaagcgugggcacagggaagagaggaaccggcucucaaggcgaaacgcugggggagaaauggaagaagaaacucaaucagcugucccgcaaggaguucgaccuguauaaaaagagcggaaucaccgaaguggaucggacagaggccaaagaaggccucaagagaggggagauuacccaucacgcgguuucccggggaucugccaaacuucagugguuugucgaacgcaacauggugauccccgagggcagagugauugaccugggguguggacggggcggcuggagcuacuauugcgcugggcugaagaaggucacagagguucgcggauacaccaaaggcgggccuggacaugaagagcccgugccuauguccacauacggcuggaauaucgugaagcucaugucugggaaagaugucuucuaucugcccccggaaaagugugacacccuucugugcgauauuggagagagcuccccuagccccacgguggaggaaucuagaacaauccggguucucaaaaugguggagcccuggcugaagaacaaucaguucuguaucaagguccugaacccuuacaugcccaccgugauugaacaccucgagcgccuucaaagaaaacacggcggcaugcugguucggaauccucugucccgcaacagcacccaugaaauguauuggaucucuaaugggacaggaaacauuguggccuccgucaauauggugagcagacuccugcuuaaccgguuuacgaugacccacagacgcccgacaaucgagaaggacguggaucugggcgcugggacccggcaugucaacgccgagcccgaaacaccuaauauggacguuauuggagagagaaucaaacgcaucaaggaagagcacaacucuaccuggcacuacgacgaugaaaaucccuauaaaacaugggcuuaccauggcagcuaugaggugaaggccaccggguccgcgucuagcaugauuaacggaguggucaagcuccugacgaaaccuugggacgugguucccauggugacccagauggccaugacagauaccacaccguucggccagcaacgggucuuuaaggagaaaguggacaccagaacgccucgcuccaugcccggcacacggagaguuauggggaucaccgcugaauggcuguggcgcacacucggacggaauaagaaaccuagacugugcacccgcgaggaauucacgaagaaggugcggaccaacgccgcuaugggcgccgucuuuacagaggaaaaucagugggauagcgccaaagcggcuguggaggacgaggauuucuggaagcuuguugacagagaacgcgagcugcacaaacucgggaaguguggauccugcguguacaacaugaugggcaaaagagaaaagaaacugggggaguuuggcaaggccaagggaucucgggccauuugguacauguggcuuggcgcucgcuaucuggaguucgaagcccucggguuucugaaugaggaucauugguucagcagagaaaacuccuacucuggagucgagggcgaagggcugcacaaacucggauauauccugcgggacauuagcaagauccccggcggggcuauguacgccgaugacaccgcgggcugggacacaagaaucaccgaggaugaccuucauaaugaggaaaaaauuacacagcagauggauccugagcaccggcaacuggccaacgcuaucuuuaagcucaccuaucagaauaaaguggucaaggugcagcgccccacgccgacaggaaccguuauggacauuaucuccagaaaggaucagcggggcucugggcaagugggaaccuacggccugaacacauucaccaauauggaagcccagcuuauucgccagauggagggggaaggaguccugagcaaagcugaccucgagaacccucaccugcccgagaagaaaaucacacaguggcuggaaacgaagggcguggagagacucaaacggauggccaucuccggggaugacugcgugguuaagcccauugaugaccgcuuugcgaacgcccugcuugcucugaaugauaugggcaaggugagaaaagacaucccucaauggcagccgagcaagggauggcaugauuggcagcagguccccuucuguucucaccauuuccacgaacucauuaugaaagacggccggaagcuggugguuccuugccgcccccaagacgagcuuaucgggagagcccggauuucccagggagcuggcuggagccugcgcgaaaccgccugucucgggaaagcuuaugcccagauguggucucugauguacuuucacagacgggaucugcgccucgcguccaacgccaucugcagcgcugugccuguccauugggugcccacaucuagaaccacaugguccauucacgcccaucaccaauggaugaccacggaggacaugcugaccgucuggaaucggguguggaucgaggauaacccuuggauggaagacaagacacccguuaccacaugggagaaugugccguaccuuggaaagagagaagaucagugguguggcagccugaucgggcucaccucccgcgccacgugggcucagaacauuccuacagccauccagcaaguccggagccugauuggcaaugaggaguuccuugacuauaugcccucuaugaaaagauuucgcaaggaagaggaaagcgagggagcgaucugguga

SEQ ID NO: 20803 - RNA, 9873 nt, Artificial Sequence
  derived and/or modified CDS sequence (opt5) from DENV-3__FJ639817__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacgugaccacggauuccagaugcccuacacagggcgaagcggugcucccggaggaacaggaccagaauuaugucuguaaacacaccuacguggaucggggcugggggaacggaugcggccuguucgggaagggaagccuuguuaccugcgccaaguuucaaugucuggagcccaucgagggcaaagugguccaguaugaaaaucucaaguacacagugauuaucaccguucauacaggggaccagcaccaggugggaaacgagacgcaaggcgucaccgcugaaaucacaccucaggccucuaccacagaggcuauucugcccgaauauggcacccuggggcucgagugcuccccucgcacgggacuggacuucaaugagaugauccuucugaccaugaaaaacaaggccuggauggugcauagacagugguuuuucgaucucccccugccguggacaagcggcgccaccacagaaaccccuacguggaaucggaaagagcuucuggucacauuuaagaacgcucacgcgaaaaagcaagaagugguugugcucgggucucaggagggagccaugcacaccgcucugacaggcgccaccgaaauucagaauuccgggggcaccagcaucuucgccggacaucugaagugucgccucaaaauggacaagcuggagcuuaaaggcaugucuuacgcuaugugcacaaacacguuuguccugaagaaagagguguccgaaacccagcacgggacaauucucaucaagguugaguacaagggagaagaugugcccuguaaaaucccuuucagcaccgaggacggccaagggaaggcccauaacggaagacugauuacagcgaaucccgucgugaccaaaaaggaggaacccgugaacaucgaggcugaaccuccguucggcgaguccaauauuguuaucgggauuggcgauaacgcccugaaaaucaauugguauaagaagggaucuagcaucggcaaaauguuugaagccacggcucggggggccagacgcauggcuauucuuggagacacagccugggauuucggcuccgucgggggagugcucaacagccugggcaagauggugcaccagaucuuugggucugcguacaccgcccuguucuccggcgucagcugggugaugaaaauuggaaucggcguucuccugaccuggauugggcuuaauucucggaacacaagcauguccuuuucuugcaucgcuauuggaaucaucacccuguaucucggcgccgugguccaggcugacauggggugugugauuaauuggaagggaaaagagcugaagugcggcagcgggaucuucguuacaaacgaggugcauacguggaccgaacaguacaaguuucaagccgauucccccaaaagacuggcgacagccauugcuggcgccugggagaauggagucuguggcauccgcagcaccacacggauggaaaaccuucucuggaagcagauugcuaaugagcugaacuauauccugugggaaaauaacaucaaacucaccgugguugugggggacauuaucggaguccuggagcagggcaagagaacgcuuaccccucagcccauggagcugaaauacucuuggaagacaugggggaaagccaagauugugaccgccgaaacacaaaacuccagcuucaucauugauggaccuaauacccccgagugcccgucugcuucccgcgcguggaacgugugggaagucgaggacuauggcuuuggcguuuucacaaccaauaucuggcucaagcugcgggaaguguacacgcagcugugugaccacagacuuaugagcgccgcugugaaagaugagcgcgccguccacgccgacaugggguacuggaucgagucccagaagaacggaucuuggaaacucgaaaaggcuagccugauugaggugaaaacaugcaccuggccuaagucccauacccuguggucuaauggcguucucgaaagcgauaugaucauucccaagucccuggccgggccuaucagccagcacaacuaucggcccggauaccauacacaaaccgcgggcccuuggcaccuugggaaacuggagcucgacuuuaauuauugcgagggaacgacaguggucauuaccgaaaacuguggcacaagaggccccucucugcgcaccacaaccguguccgggaagcugauccacgaguggugcugucggagcugcacgcuuccgccucucagauacaugggagaagauggcuguugguaugggauggagauccggcccauuucugaaaaagaggagaauaugguuaagucccuggugagcgcuggaucuggcgaagucgacaacuucaccaugggggugcugugccucgccauccuguuugaggaaguuaugcgcggaaaauucggcaagaagcauaugauugccggcguguucuuuacauucguccuucugcucagcgggcagaucaccuggagagauauggcucacacacugauuaugaucggauccaaugccagcgaccggaugggcaugggggugaccuaccuggcgcuuauugcuacguuuaaaauccagcccuuccuggcccucggauuuuuccugagaaagcucacaucucgcgagaaccugcuucugggcguggggcucgccauggcuaccacacugcaacugccugaagauaucgagcagauggccaauggaauugcucuuggccugauggcccucaaacugaucacccaguuugagaccuaucagcucuggacagcgcugauuucccuuacguguagcaacaccaucuucacacugaccgucgccuggcggacagcuacccucauucuggccggcguuucccugcuuccggugugccaaucuagcuccaugagaaagacggacuggcugcccaugacaguggcugccaugggggucccuccccucccucuguuuaucuucucucucaaagauacccugaagcgcagaagcuggccccuuaaugaaggagugauggccguuggccugguguccauccuggcuucuagccuccugcggaacgacgucccuauggcggggccccuuguggccggaggccugcucauugcuuguuacguuaucaccgggacauccgccgaucugaccguggagaaggccgcugacgucacaugggaagaggaagccgagcagacgggagugagccauaaccucaugauuaccgucgacgaugacggcacaaugcgcaucaaagaugacgagaccgaaaauauucugacagugcuucugaagaccgcgcugcucaucguuucuggcaucuuuccguacuccauuccugcuacgcugcuuguguggcacaccuggcagaaacagacacaaagaagcgggguccugugggaugugcccucuccucccgagacccagaaggccgaacucgaggagggaguuuaucggaucaaacagcagggcauuuucgggaagacacaagugggagucggcgugcagaaagaagggguguuucauaccauguggcacguuacacgcggagccguccugacguacaacggcaagagacucgagccgaauugggcuuccgugaagaaagaccugaucagcuauggcgggggauggcggcuuucugcccaguggcaaaagggcgaagaggugcaggucauugcgguggaaccugggaaaaaccccaagaauuuccagaccaugccuggaacauuccagaccaccacaggcgagaucggggcuauugcccuggauuuuaaacccggaacguccggcagccccaucaucaaccgcgagggcaagguuguggggcuguacggaaauggcgucgugaccaagaacgggggauauguuuccggcauugcccaaacaaaugcugaaccugacgggccgacccccgagcucgaagaggaaauguucaaaaagagaaaccugacaaucauggaucuucacccuggcagcggaaaaacccggaaguaccugcccgccauugugcgcgaggcuaucaaaagacggcucagaacgcugauucucgccccuacacgcgucguggcggccgagauggaagaggcucugaagggccuucccauccgguaucagaccaccgccacaaagucugaacauaccgggagagagaucguugaccugaugugccacgcuacauuuaccaugcgccugcucagcccugugcgggucccgaauuacaaccugauuaucauggaugaagcccauuucacggaccccgccuccauugcugcgagaggauacaucucuacacgcgugggcaugggggaggccgcugccauuuuuaugaccgccacaccucccggaaccgcugaugccuucccucagagcaaugcgcccauccaggacgaggaacgggacaucccggagagauccuggaacucuggcaaugaauggauuacggauuuugcugggaaaaccgugugguucgucccuagcaucaaggccggcaacgacauugccaacugucuucgcaaaaauggaaagaaaguuauccaacugucccggaagacauuugauaccgaguaucagaagacaaaacucaacgacugggauuucguggugaccacagacauuucugagaugggcgcuaauuuuaaggccgauagagucaucgacccccggcgcugccugaaacccgugauucugaccgaugggccugaaagaguuauccucgcgggacccaugccugugacggccgcuagcgccgcucagcggcgcggcagagucgggcggaacccgcagaaggagaaugaccaauacaucuucacaggacagccccuuaacaaugaugaagaccacgcccauuggaccgaggcuaaaaugcugcuggacaacauuaauaccccugaaggcaucauucccgcccucuucgagccugagagagaaaaguccgcggccaucgauggggaguaucgccugaagggcgaaagccggaaaacauuuguggagcuuaugagacgcggagaccugcccguuuggcucgcucacaagguggccucugaaggcauuaaauacaccgaucggaaguggugcuucgacgggcagagaaacaaucagauccuggaggagaacauggaugucgaaaucuggacaaaagagggagaaaagaaaaagcugcgcccgcgguggcucgacgcuagaacguauuccgauccucuugcccugaaggaguuuaaagacuucgccgcuggccgcaagagcauugcgcuggaucucgugaccgaaaucgggagaguccccacacaccuggcccaucggacccgcaaugcucuugacaaccuggugaugcuccacacaucugagcauggaggcaaagccuacagacacgccguugaggaacugccugagaccauggaaacgcugcuccuucugggccugaugauucuccugaccgggggagcuaugcuuuuucugaucuccggcaaggggauuggaaaaacaagcaucggccucaucugugugauugccuccucugggaugcuguggauggcggagaucccccugcaauggauugccagcgcuaucgugcucgaguucuuuaugaugguccuucugauuccugaacccgagaagcagcggaccccgcaggauaaucaacuggccuauguugugaucggaauucucacacuggcugccaucaucgcggccaacgaaaugggccuucuggagaccacgaagcgcgaccucggcauguccagagaaccugggguggucagccccacaucuuaccuggauguggaccugcaccccgcuuccgccuggacccucuacgcuguugccacaaccgugauuaccccuaugcuucggcauacaaucgagaauagcacggcuaacgucucucuggccgcgauugccaaccaggcugugguccugaugggacucgacaaaggcuggccgaucagcaagauggaucugggggugccccuucuggcccucggaugcuauucccagguuaauccucugacccugacagcugccgugcuccuucugauuacccacuacgccaucaucggccccgggcugcaggcgaaagcuacaagagaggcccaaaagcgcaccgcugccggaauuaugaaaaacccuacggucgacggcaucaugacaauugaucucgaccccgugaucuaugauucuaaguucgaaaagcagcugggccagguuaugcuucuggugcucugugccguccagcugcugcucaugcggaccagcugggcucuuugcgaggcccugacccuggcgacagggccuauuaccacacucugggaaggauccccgggcaaauuuuggaauacgaccaucgccgugucuauggcuaacaucuucagagggagcuaccuggccggagcuggccuugccuuuuccauuaugaagagcguggggacaggaaaacgcggcaccggcucucaaggggagacacugggagaaaaguggaaaaagaagcucaaucagcugucccggaaagaguucgaccuguauaagaaaagcggcaucaccgagguugauagaacggaagcgaaggaggggcucaaacggggagaaauuacccaucacgccgucucccgcggcucugcuaagcuucagugguuuguggagagaaacauggugauccccgaagggcgggucauugaccugggauguggccgcggcggguggagcuacuauugcgccggacugaaaaagguuacagaggugagaggcuacaccaaggggggaccuggccaugaggaacccgugccuauguccacauacggguggaauaucgucaaacucaugucuggaaaggauguguucuaucugcccccggagaaaugugacacccuucugugcgauauuggcgaaagcuccccuagccccacaguugaggagucucggaccauccgcgugcucaagauggucgaacccuggcugaaaaacaaucaguucuguaucaaggugcugaacccuuacaugcccgcuguuauugagcaccucgaaagacuucaacggaagcacggcgggaugcuggugcgcaauccucuguccagaaacagcacgcaugagauguauuggaucucuaauggaacaggcaacauugucgccuccgugaauauggugagccggcuccugcuuaacagauuuaccaugacccaccgccggccgacaaucgaaaaagacgucgaucugggggcuggaacgagacauguuaacgccgagcccgagaccccuaauauggacgugauuggcgaacgcaucaagcggaucaaagaggaacacaacucuacauggcacuacgacgaugagaaucccuauaagaccugggcguaccaugggagcuaugaagugaaagccacaggauccgcuucuagcaugauuaacggcgucgugaagcuccugaccaagccuugggacguugugcccauggucacacagauggccaugaccgauacgaccccguucggccagcaaagaguguuuaaagagaagguugacacacgcaccccucgguccaugcccgggacaagacgcgugaugggaaucaccgcugaguggcuguggcggacgcucggcagaaauaaaaagccucgccugugcacacgggaagaguucaccaaaaaggucagaacaaacgccgccaugggggcgguguuuaccgaagagaaucagugggauagcgcuaaggccgccguugaagacgaggauuucuggaaacuuguggaccgcgagagagaacugcacaagcucggaaaauguggcuccugcgucuacaacaugauggggaagcgggagaaaaagcugggcgaauuuggaaaagcuaagggcucucgcgccauuugguacauguggcuuggggcuagauaucuggaguucgaggcccucggauuucugaaugaagaucauugguucagccgggagaacuccuacucuggcguggaaggggagggacugcacaagcucggcuauauccugagagacauuagcaaaauccccgggggcgcgauguacgccgaugacacggcuggaugggacacccggaucacagaagaugaccuucauaaugaggagaagauuacccagcagauggauccugaacaccgccaacuggccaacgcuaucuuuaaacucacauaucagaauaaggucgugaaaguucagagacccaccccgacaggcaccgugauggacauuaucucccggaaggaucagcgcgggucuggacaagucggcacguacgggcugaacacauucaccaauauggaggcccagcuuauuagacagauggaaggagagggcgugcugagcaaggcggaccucgaaaacccucaccugcccgagaaaaagaucacccaguggcuggagacaaaagggguggaacggcucaagcgcauggccaucuccggcgaugacugcguugugaaacccauugaugacagauuugcuaacgcccugcuugcucugaaugauaugggaaagguccggaaggacaucccucaauggcagccgagcaaaggcuggcaugauuggcagcaggugcccuucuguucucaccauuuccacgagcucauuaugaaggacgggcgcaaacugguugugccuugcagaccccaagacgaacuuaucggacgggcccgcauuucccagggcgcuggguggagccugagagagaccgccugucucggaaaggcguaugcccagauguggucucugauguacuuucaccggcgcgaucugagacucgcuuccaacgccaucugcagcgccgucccugugcauuggguccccacaucucggacgaccugguccauucacgcucaucaccaauggaugacaaccgaagacaugcugacaguguggaauagaguuuggaucgaggauaacccuuggauggaggacaaaacccccgugacgaccugggaaaaugucccguaccuuggcaagcgcgaggaucaguggugugggagccugaucggccucacaucccgggccaccugggcgcagaacauuccuacagcuauccagcaagugagaagccugauuggaaaugaagaguuccuugacuauaugcccucuaugaagcgcuuucggaaagaggaagagagcgaaggcgccaucugguga

SEQ ID NO: 20804 - RNA, 9873 nt, Artificial Sequence
  derived and/or modified CDS sequence (opt5) from DENV-3__FJ639825__SS-prME
acaagccucugccucaugaugauccugcccgccgcucuugccuuccaccugacaucccgggacggcgaaccucggaugauuguggggaagaacgaacgcggaaagucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggauuacaagggagaggacguucccuguaaaauuccuuucagcaccgaagauggccaagggaaggcccauaacggaagacugaucacagcgaaucccguggucaccaaaaaggaggagcccgugaacauugaagcugagccuccguucggcgaauccaauaucgugauugggaucggcgacaacgcccugaaaaucaauugguauaagaagggaucuagcauuggcaaaauguuugaggccacggcuagaggggccagacgcauggcuauccuuggagauacagccugggacuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugauacagggugugucaucaauuggaaaggaaaggaacugaagugcggcagcgggauuuucgugacgaacgagguucauaccuggacagagcaguacaaauuucaagccgacucccccaagcggcuggcgaccgccaucgcuggcgccugggaaaauggaguguguggcauuagaagcacaacccgcauggagaaccuucucuggaaacagaucgcuaaugaacugaacuauauccugugggagaauaacauuaagcucacggucgugguuggggauaucauuggagugcuggaacagggcaaacggacccuuacaccucagcccauggagcugaaguacucuuggaaaaccugggggaaggccaagaucgucacagccgagacccaaaacuccagcuucauuaucgacggaccuaauacacccgaaugcccgucugcuuccagagcguggaacgugugggagguggaagacuauggcuuuggcgucuucaccacgaauaucuggcucaaacugcgcgagguuuacacacagcagugugaucaccggcugaugagcgccgcugugaaggacgaaagagccgugcacgccgauaugggguacuggauugagucccagaaaaacggaucuuggaaacuugagaaagcuagccucaucgaagucaagaccugcaccuggccuaagucccauacacuguggucuaauggcgugcuggagagcgacaugauuauccccaaaucccucgccgggccuauuagccaacacaacuaucgccccggauaccauacccagacggcgggcccuuggcaccuggggaaacuugaacuggauuuuaauuauugcgagggaacaaccguugugaucacagagaacuguggcacccggggccccucucucagaacaaccacggucuccgggaaacugauccacgaauggugcugucgcagcugcacccugccgccucuucgguacaugggagaggacggcuguugguaugggauggaaauuagacccaucucugagaaggaagagaauauggugaaaucccucguuagcgcuggaucuggcgagguggauaacuucacaauggggguccugugccuggccauucucuuugaagaggugaugcggggaaaguucggcaagaaacauaugaucgccggcguuuucuuuaccuucgugcugcuucugagcgggcagauuacauggcgcgacauggcucacacccucaucaugauuggauccaaugccagcgauagaaugggcaugggggucacguaccuggcgcugaucgcuacauuuaagauccaacccuuccuugcccugggauuuuuccuccggaaacugaccucuagagaaaaccuccugcuuggcguggggcuggccauggcuacaacccuccagcugccugaggacauugaacagauggccaauggaaucgcucugggccuuauggcccugaagcucauuacccaguuugagacauaucaacuguggacggcgcucaucucccugaccuguagcaacacaauuuucacccuuacaguggccuggcgcaccgcuacgcugauccucgccggcgucucccugcugccgguuugccagucuagcuccaugcggaaaacagauuggcuucccaugaccguggcugccaugggggugccuccccugccucucuuuaucuucucucugaaggacacccucaagagacgcagcuggccccugaaugagggagucauggccgugggccuuguuuccauucuggcuucuagccugcucagaaacgaugugccuauggcggggccccuggucgccggaggccuucugaucgcuuguuacgugauuacagggaccuccgccgaccucacaguugaaaaagccgcugacgugacgugggaggaagaggccgaacagaccggagucagccauaaccugaugaucacaguggaugacgauggcaccaugcggauuaaggacgaugagacagagaauauccucaccguccugcuuaaaacggcgcugcugaucgugucuggcauuuuuccguacuccaucccugcuacccuccugguuuggcacacauggcagaagcaaacccagcgcagcggggugcuuugggacguccccucuccucccgaaacacagaaagccgagcuggaagagggaguguauagaauuaagcagcaaggcaucuucgggaaaacccagguuggagugggcguccagaaggaggggguguuucauacaauguggcacgugacgcggggagccguucucaccuacaacggcaagcgccuggaaccgaauugggcuuccgucaaaaaggaucucauuagcuauggcgggggauggagacugucugcccaauggcagaaaggcgaggaaguccaggugaucgcggucgagccugggaagaaccccaaaaauuuccagacaaugccuggaaccuuccaaaccacaacgggcgaaauuggggcuaucgcccuugacuuuaagcccggaaccuccggcagccccaucauuaaccgggagggcaaggugguugggcuguacggaaauggcguggucaccaagaacgggggauauguguccggcaucgcccagaccaaugcugagccugaugggccgacacccgaacuggaggaagagauguucaagaaacgcaaccucaccauuauggaccugcacccuggcagcggaaagacgagaaaauaccuucccgccaucguucgggaagcuauuaagcgcagacugcggacacucauccuggccccuaccagaguggucgcggccgagauggaggaagcucucaagggccugcccauccgcuaucagaccacagccaccaaaucugagcauacagggcgggaaauuguggaucuuaugugccacgcuaccuuuacgaugagacugcugagcccuguucgcgugccgaauuacaaccucaucauuauggacgaggcccauuucacagaucccgccuccaucgcugcgcggggauacauuucuaccagagucggcaugggggaagccgcugccaucuuuaugacagccaccccucccggaacggcugacgccuucccucagagcaaugcgcccauccaagacgaggagcgcgauauuccggaacgguccuggaacucuggcaaugaguggaucaccgacuuugcugggaagacagugugguucgugccuagcauuaaagccggcaacgauaucgccaacugucugagaaagaauggcaaaaaggucauucagcuuucccgcaagaccuuugacacagaauaucagaaaaccaagcugaacgauugggacuucguugugacaaccgauaucucugagaugggagcuaauuuuaaagccgaccgggugauugaucccagacggugccucaagcccgucauccugacggacgggccugagcgcgugauccuggcgggacccaugccuguuacagccgcuagcgccgcucagagacggggccgcguggggagaaacccgcaaaaagaaaaugaucaguacauuuucaccggacagccccucaacaaugacgaggaccacgcccauuggaccgaagcuaagaugcuucuggauaacaucaauacaccugagggcauuauccccgcccuguucgaaccugagcgggagaaguccgcggccauugacggggaauauagacucaaaggcgagagccgcaagaccuuugucgaacugaugcggagaggagaucuucccguguggcuggcucacaaaguugccucugagggcaucaaguacacagaccgcaaauggugcuucgaugggcagcggaacaaucaaauccucgaagagaacauggacguggagauuuggacgaaggaaggagagaaaaagaagcugagaccgcgcuggcuggaugcucggaccuauuccgacccucucgcccuuaaagaauuuaaggauuucgccgcuggcagaaaaagcaucgcgcuggaccuggucacagagauugggcgcgugcccucucaccucgcccauagaacccggaaugcucuggauaaccuugucaugcugcacacauccgaacauggaggcaaggccuaccgccacgccguggaggagcucccugaaaccauggagacgcugcugcuccuuggccugaugauccugcucaccgggggagcuaugcuguuucuuauuagcggcaaagggaucggaaagacauccaucggccugauuuguguuaucgccucuagcgggaugcucuggauggcggaaauuccccugcaguggaucgccuccgcuauugugcuggaguucuuuaugauggugcuccuuaucccugagcccgaaaagcagagaaccccgcaagacaaucagcuggccuaugucguuauuggaauccugacacucgcugccaucauugcggccaacgagaugggccugcuugaaaccacgaaacgggaucugggcaugagcaaggagccugggguggugucucccacauccuaccucgacgucgaccugcaccccgcuagcgccuggacccuguacgcuguggccacaaccguuaucaccccuaugcuccgccauacaauugaaaauucuacggcuaacgugagccuugccgcgaucgccaaccaggcugucgugcugaugggacuggauaaaggcuggccgauuuccaagauggaccucggggucccccugcuugcccugggaugcuauucucaggugaauccucucacccugacagcugccguucugcuccuuaucacccacuacgccaucauuggccccgggcugcaagcgaaagcuacaagagaggcccagaagcggaccgcugccggaaucaugaagaacccuacgguggauggcauuaugacaaucgaccuggaucccgucauuuaugacagcaaauucgagaagcagcucggccaggugaugcugcuuguucugugugccgugcaacuccugcugaugagaaccuccugggcucucugcgaagcccuuacccuggcgacagggccuaucaccacacugugggagggaucuccgggcaaauuuuggaauacgaccaucgccgucagcauggcuaacauuuuccgcggguccuaccucgccggagcuggccuggccuuuagcaucaugaagucuguggggacaggaaaacggggcaccggcucccagggggaaacacuuggagagaaguggaagaaaaagcugaaucagcucagcagaaaagaguucgaucuguauaagaaauccggcauuaccgagguggaccgcacggaggcgaaggaagggcugaaacggggagagaucacccaucacgccguuucuagaggcagcgcuaagcuccagugguuugucgaacggaacauggugauucccgaggggcgcgugaucgaucuuggauguggcagaggcgggugguccuacuauugcgccggacugaagaaagucacagaaguucggggcuacaccaaagggggaccuggccaugaggagcccgugccuaugucuacauacggguggaauauugugaaacugaugagcggaaaggacgucuucuaucugcccccggaaaaaugugauacccugcuuugcgacaucggcgaguccagcccuucucccacaguggaagagucccgcaccaucagaguucugaagaugguggagcccuggcucaagaacaaucaauucuguauuaaaguccugaacccuuacaugcccacggugaucgaacaccuggagcggcuccagcgcaagcacggcgggaugcuuguuagaaauccucugagccggaacucuacacaugaaauguauuggauuuccaauggaaccggcaacaucguggcuagcgucaauauggugucucgccugcuccugaacagauuuaccaugacacaccggagaccgacgauugagaaagauguggaccuuggggccggaacccgccaugucaacgcugaacccgagacaccuaauauggacguuaucggcgagcggaucaagagaauuaaagaagaacacaacagcaccuggcacuacgaugacgaaaaucccuauaagacaugggccuaccauggguccuaugaggugaaggcgaccggaucugccagcuccaugaucaacggcguggucaaacugcucacaaagccuugggaugugguucccauggugacccagauggcuaugacggacaccacaccguucggccaacagcgcgucuuuaaagaaaagguggauacccggacaccuagaagcaugcccgggacccgccggguuaugggaauuacggccgaguggcuguggagaacacugggccgcaauaaaaagccucggcucugcaccagagaggaguucacaaagaaagugcgcaccaacgcugccaugggggccgucuuuacggaggaaaaucagugggacuccgcgaaggcugccguggaggaugaagacuucuggaaacugguugaucgggagagagagcuucacaagcugggaaaauguggcucuugcguguacaacaugauggggaagcgcgagaagaagcucggcgaguuuggaaaggccaaaggcagcagagcuaucugguacauguggcugggggcccgguaucuugaguucgaggcucugggauuucucaaugaggaccauugguucucccgcgaaaacucuuacagcggcgucgagggggaaggacugcacaagcugggcuauauucucagagauaucuccaaaauccccgggggcgccauguacgcggacgacaccgccggaugggauacacggauuaccgaggacgaucugcauaaugaagagaagaucacacagcaaauggacccugagcacaaacagcuugcuaacgccauuuuuaagcugaccuaucagaauaagguggucaaagugcagagacccacaccgaccggcacgguuauggauaucauuucucggaaggaccaacgcgggagcggacaggugggcacauacgggcucaacaccuucaccaauauggaagcucagcugaucagacagauggagggagaaggcguccuuuccaaagccgaucuggagaacccucaccuccccgaaaagaaaaucacacaauggcuggagaccaaggggguggagcggcugaagcgcauggcgauuagcggcgacgauugcgugguuaaacccaucgacgauagauuugccaacgcucuccuggcccuuaaugacaugggaaaggugcggaaagauauuccucaguggcagccgucuaagggcuggcaugacuggcagcaaguccccuucuguucccaccauuuccacgaacugaucaugaaagacgggcgcaagcucgugguuccuugcagaccccaggaugagcugauuggacgggcucgcaucagccagggcgccggguggucucuuagagaaacagcuugucugggaaaggccuaugcgcaaauguggucccucauguacuuucaccggcgcgaccugagacuggccagcaacgcuauuugcucugccgugccuguccauugggugcccacgucccggaccacauggagcauccacgcccaucaccaguggaugaccacagaggauaugcucaccgucuggaaucgcguguggaucgaagacaacccuuggauggaggauaaaacgcccguuaccacaugggagaaugugccguaccugggcaagagagaagaccaguggugugggucccuuauuggccugaccagccgggcuacaugggcccagaacaucccuaccgcgauucaacaggucagaucucucaucggaaaugaggaguuccuggauuauaugcccagcaugaaacgcuuucggaaggaggaggaauccgagggcgcuauuugguga

SEQ ID NO: 20805 - RNA, 9873 nt, Artificial Sequence
  derived and/or modified CDS sequence (opt5) from DENV-3__FJ639826__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcucggggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacacagggugugucaucaauuggaaaggaaaggagcugaagugcggcagcgggauuuucgugacgaacgagguucauaccuggacagaacaguacaaauuucaagccgauucccccaagcggcuggcgaccgccaucgcuggcgccugggagaauggaguguguggcauuagaagcacaacccgcauggaaaaccuucucuggaaacagaucgcuaaugagcugaacuauauccugugggaaaauaacauuaagcucacggucgugguuggggacaucauuggagugcuggagcagggcaaacggacccuuacaccucagcccauggagcugaaguacucuuggaaaaccugggggaaggccagaaucgucacagccgaaacccaaaacuccagcuucauuaucgauggaccuaauacacccgagugcccgaacaccucucgcgcuuggaaugugugggaaguggaggacuauggcuuuggcgucuucacgacaaacaucuggcucaagcugcgggaaguuuacacccagcugugugaccacagacuuauguccgcggccgugaaagaugagcgcgcugugcacgccgacaugggguacuggauugagagccagaagaauggauccuggaaacucgaaaaggccucucugaucgaggucaaaaccugcacauggccuaagagccauacccugugguccaacggcgugcucgaaucugauaugauuauccccaagagccuggcugggccuauuucccagcacaauuaucggcccggauaccauacgcaaacagccggcccuuggcaccuugggaaacuggagcucgacuuuaacuauugcgagggaaccacaguugugaucaccgaaaauuguggcacaagaggccccagccugcgcaccacgaccgucucugggaagcugauccacgaguggugcugucgguccugcacacuuccgccucucagauacaugggagaagauggcuguugguaugggauggagauucggcccaucagcgaaaaagaggagaacauggugaagucucugguuuccgcgggaagcggcgaaguggacaauuucaccauggggguccugugccucgcuauucuguuugaggaagugaugcgcggaaaauucggcaagaagcauaugaucgccggcguuuucuuuacauucgugcuucugcucucugggcagauuaccuggagagauauggcccacacgcugaucaugauuggaagcaacgcuacagaccggaugggcaugggggucaccuaccuggcccuuaucgcgacauuuaaaauccagcccuuccuggcucucggauuuuuccugagaaagcucaccucccgcgagaaucugcuucugggcguggggcucgccauggccaccacacugcaacugccugaagauauugagcagauggcuaacggaaucgcccuuggccugauggcucucaaacugauuacgcaguuugagaccuaucagcucuggacagcccugaucagccuuaccuguucuaauacaauuuucacccugacgguggcguggcggacagccacccucauccuggcuggcgucucccugcuuccgguuugccaaagcuccucuaugagaaagaccgacuggcugcccaugacaguggccgcuaugggggugccuccccucccucuguuuaucuucagccucaaagauacccugaagcgcagauccuggccccuuaacgaaggagucauggccgugggccugguuucuauucuggccagcucccuccugcggaacgacgugccuauggcugggccccuugucgcgggaggccugcucaucgccuguuacgugauuacagggacgucugcugaucugaccguugagaaggccgccgacgugacaugggaagaggaagcugagcagaccggagucagccauaaucucaugaucacaguggacgaugacggcaccaugcgcauuaaagaugacgagacggaaaacauccugaccguccuucugaagacagcccugcucaucguguccggcauuuuuccguacagcaucccugcgacccugcuuguuuggcacacauggcagaaacagacccaaagaucuggggugcugugggauguccccuccccucccgagacacagaaggcugaacucgaggagggaguguaucggauuaaacagcagggcaucuucgggaagacgcaaguuggagugggcguccagaaagaagggguguuucauaccauguggcacgugacacgcggagccguucugaccuacaauggcaagagacucgagccgaacugggccagcgucaagaaagaccugauuucuuauggcgggggauggcggcuuuccgcucaguggcaaaagggcgaagaggugcaggugaucgccgucgaaccugggaaaaaucccaagaacuuccagaccaugccuggaacauuccagacgaccacaggcgagauuggggcgaucgcucuggauuuuaaacccggaaccagcggcucucccaucauuaaucgcgagggcaaggugguugggcuguacggaaacggcguggucacaaagaaugggggauauguguccggcaucgcccaaaccaacgccgaaccugacgggccgacgcccgagcucgaagaggaaauguucaaaaagagaaaucugacaauuauggaucuucacccuggcagcggaaaaacccggaaguaccugcccgcuaucguucgcgaggccauuaaaagacggcucagaacccugauccucgcuccuacacgcguggucgccgcggagauggaagaggcccugaagggccuucccauccgguaucagaccacagcuaccaaguccgaacauacggggagagagauuguggaccugaugugccacgccacauuuaccaugcgccugcucagcccuguucgggugccgaacuacaaucugaucauuauggaugaagcucauuucacagaccccgccucuaucgccgcuagaggauacauuagcacccgcgucggcaugggggaggcggccgcuaucuuuaugacggccaccccucccggaacagccgaugcuuucccucaguccaacgcccccauccaggacgaggaacgggacauuccggagagaucuuggaauagcggcaacgaauggaucaccgauuuuacagggaaaaccgugugguucgugccuuccauuaaggcgggcaacgacaucgcuaauugucuucgcaaaaacggaaagaaagucauucaacugucucggaagacauuugauaccgaguaucagaagacgaaacucaaugacugggauuucguugugacaaccgacaucagcgagaugggcgccaacuuuaaggccgauagagugauugacccccggcgcugccugaaacccgucauccugaccgaugggccugaaagagugauccucgcuggacccaugccuguuacagccgcguccgccgcucagcggcgcggcagaguggggcggaauccgcagaaggagaacgaccaauacauuuucaccggacagccccuuaauaacgaugaagaccacgcccauuggacagaggcuaaaaugcugcuggacaauaucaacacgccugaaggcauuauccccgcccucuucgagccugagagagaaaagucugcugccauugauggggaguaucgccugaagggcgaaagccggaaaaccuuugucgagcuuaugagacgcggagaccugcccguguggcucgcgcacaagguugccuccgaaggcaucaaauacacagaucggaaguggugcuucgacgggcagagaaauaaccagauccuggaggagaauauggauguggaaauuuggaccaaagagggagaaaagaaaaagcugcgcccgcgguggcucgacgcuagaacauauagcgauccucuugcccugaaggaguuuaaagacuucgcugccggccgcaagucuaucgcccuggaucucgucaccgaaauugggagagugcccacgcaccuggcucaucggacccgcaacgcgcuugacaaucuggucaugcuccacacauccgagcauggaggcaaagccuacagacacgcuguggaggaacugccugagaccauggaaacacugcuccuucugggccugaugauccuccugaccgggggagccaugcuuuuucugauuagcggcaaggggaucggaaaaacgucuaucggccucauuuguguuaucgccuccagcgggaugcuguggauggcugagauuccccugcaauggaucgccuccgcgauugugcucgaguucuuuaugauggugcuucugaucccugaacccgagaagcagcggacaccgcaggauaaccaacuggccuaugucguuauuggaauccucacccuggcugccaucauugcugccaaugaaaugggccuucuggagacaaccaagcgcgaccucggcaugucuaaagaaccugggguggugagccccaccuccuaccuggaugucgaccugcaccccgcgagcgccuggacacucuacgcuguggccacgaccguuaucacaccuaugcuuagacauaccauugagaacucuacagcuaacgugucccuggccgcuaucgccaaucaggcggucgugcugaugggacucgacaagggcuggccgauuagcaaaauggaucugggggucccccuucuggcccucggaugcuauucucaggugaacccucugacccugacggcugccguucuccuucugaucacacacuacgcuaucauuggccccgggcugcaggccaaggccacccgggaggcgcaaaaaagaaccgcugccggaaucaugaagaauccuacaguggacggcauuaugaccaucgaucucgaccccgucauuuaugauagcaaguucgaaaaacagcugggccaggugaugcuucugguucucugugcugugcagcugcugcucaugcgcacauccugggcccuuugcgaggcccugacgcuggcuaccgggccuaucacaacccucugggaaggaucuccgggcaaguuuuggaacacaaccaucgccgucagcauggcgaauauuuuccggggguccuaccuggccggagcuggccuugccuuuucuaucaugaaaagcguggggacgggaaagagaggcaccggcucccaaggggagacacugggagaaaaauggaagaagaaacucaaccagcugagccgcaaggaguucgaccuguauaaaaagucuggcauuaccgagguggaucggacagaagcuaaagaggggcucaagagaggagaaaucacccaucacgccguuucccggggcagcgcgaaacuucagugguuugucgagcgcaauauggugauucccgaagggagagugaucgaccugggauguggccggggcgggugguccuacuauugcgccggacugaagaaggucacagagguucgcggcuacaccaaagggggaccuggccaugaggaacccgugccuaugucuacguacggguggaacauugugaagcucaugagcggaaaagaugucuucuaucugcccccggagaagugugacacacuucugugcgauaucggcgaauccucuccuagccccaccguggaggaguccagaaccauccggguucucaaaaugguggaacccuggcugaagaauaaccaguucuguauuaagguccugaauccuuacaugcccgcugugaucgagcaccucgaacgccuucaaagaaaacacggcgggaugcugguucggaacccucugagccgcaauucuacacaugagauguauuggauuuccaacggaacgggcaauaucguggccagcgucaacauggugucuagacuccugcuuaaccgguuuaccaugacacacagacgcccgaccauugaaaaggacguggaucugggggcuggaacacggcaugucaaugccgagcccgagaccccuaacauggacguuaucggcgaaagaaucaaacgcauuaaggaggaacacaauuccacauggcacuacgacgaugagaaccccuauaaaaccugggcuuaccaugggagcuaugaagugaaggccacgggaucugcgagcuccaugaucaauggcguggucaagcuccugaccaaaccuugggacgugguucccauggugacacagauggccaugaccgauacaaccccguucggccagcaacgggucuuuaaggagaaaguggacacgagaacaccucgcucuaugcccgggacccggagaguuauggagauuacagcugaauggcuguggcgcacccucggacggaacaagaaaccuagacugugcacgcgcgaggaauucaccaagaaggugcggacaaaugccgcuaugggcgccgucuuuaccgaggaaaaccagugggauagcgccaaagcggcuguggaggacgaggauuucuggaagcuuguugacagagaacgcgagcugcacaaacucgggaaguguggauccugcguguacaauaugaugggcaaaagagaaaagaaacugggggaguuuggcaaggccaagggaagccgggccaucugguacauguggcuuggcgcucgcuaucuggaguucgaagcccucggguuucugaacgaggaucauugguucuccagagaaaauucuuacagcggagucgagggcgaagggcugcacaaacucggauauauucugcgggacaucuccaagauccccggcggggcuauguacgccgaugacacagcgggcugggacaccagaauuacagaggaugaccuucauaacgaggaaaaaaucacccagcagauggauccugagcaccggcaacuggccaaugcuauuuuuaagcucacguaucagaacaaaguggucaaggugcagcgccccacaccgaccggaaccguuauggacaucauuucuagaaaggaucagcggggcagcgggcaagugggaacauacggccugaauaccuucacaaacauggaagcccagcuuauccgccagauggagggggaaggaguccuguccaaagcugaccucgagaacccucaccugcccgagaagaaaaucacgcaguggcuggaaaccaagggcguggagagacucaaacggauggccauuucuggggaugacugcgugguuaagcccaucgaugaccgcuuugcgaaugcccugcuugcucugaacgauaugggcaaggugagaaaagacauuccucaauggcagccgagcaagggauggcaugauuggcagcagguccccuucuguucccaccauuuccacgaacucaucaugaaagacggccggaagcuggugguuccuugccgcccccaagacgagcuuauugggagagcccggaucagccagggagcuggcuggucucugcgcgaaacagccugucucgggaaagcuuaugcccagauguggucccugauguacuuucacagacgggaucugcgccucgcgagcaaugccauuugcucugcugugccuguccauugggugcccaccuccagaacaaccuggagcauccacgcccaucaccaauggaugacgaccgaggacaugcugacagucuggaaccggguguggaucgaggauaauccuuggauggaagacaagacccccguuacaaccugggagaacgugccguaccuuggaaagagagaagaucagugguguggcucucugauugggcucacgucccgcgccacaugggcucagaauaucccuaccgccauucagcaaguccggagccugaucggcaacgaggaguuccuugacuauaugcccuccaugaaaagauuucgcaaggaagaggaaagcgagggagcgauuugguga

SEQ ID NO: 20806 - RNA, 9873 nt, Artificial Sequence
  derived and/or modified CDS sequence (opt5) from DENV-3__FJ810416__SS-prME
accagccugugccucaugaugauccugcccgccgcucuugccuuccaccugacgucccgggacggcgaaccucggaugauuguggggaagaacgaacgcggaaagucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaacggcaagcgccucgagccgaauugggcuuccgucaaaaaggaccugauuagcuauggcgggggauggagacuuucugcccaguggcaaaaaggcgaagagguccaggugaucgcggucgaaccugggaagaaccccaaaaauuuccagaccaugccuggaacauuccagaccaccacaggcgagauuggggcuaucgcccuggauuuuaagcccggaacguccggcagccccaucauuaaccgggagggcaaggugguugggcuguacggaaauggcguggucaccaaaaacgggggauauguguccggcaucgcccaaacaaaugcugaaccugacgggccgacccccgagcucgaagaggaaauguucaagaaacgcaaccugacaauuauggaucuucacccuggcagcggaaagaccagaaaauaccugcccgccaucguucgggaggcuauuaagcgcagacuccggacgcugauccucgccccuacaagaguggucgcggccgagauggaagaggcucugaagggccuucccauccgcuaucagaccaccgccacaaaaucugaacauaccgggcgggagauuguggaccugaugugccacgcuacauuuaccaugagacugcucagcccuguucgcgugccgaauuacaaccugaucauuauggaugaagcccauuucacggaccccgccuccaucgcugcgcggggauacauuucuacaagagucggcaugggggaggccgcugccaucuuuaugaccgccacaccucccggaaccgcugaugccuucccucagagcaaugcgcccauccaggacgaggaacgcgacauuccggagcgguccuggaacucuggcaaugaauggaucacggauuuugcugggaagaccgugugguucgugccuagcauuaaagccggcaacgacaucgccaacugucuuagaaagaauggcaaaaaggucauucaacugucccgcaagacauuugauaccgaguaucagaaaacaaagcucaacgacugggauuucguugugaccacagacaucucugagaugggagcuaauuuuaaagccgaucgggugauugaccccagacggugccugaagcccgucauccugaccgaugggccugaacgcgugauccucgcgggacccaugccuguuacggccgcuagcgccgcucagagacggggccgcguggggagaaacccgcagaaagagaaugaccaauacauuuucacaggacagccccuuaacaaugaugaagaccacgcccauuggaccgaggcuaagaugcugcuggacaacaucaauaccccugaaggcauuauccccgcccucuucgagccugagcgggaaaaguccgcggccauugauggggaguauagacugaaaggcgaaagccgcaagacauuugucgagcuuaugcggagaggagaccugcccguguggcucgcucacaaaguugccucugaaggcaucaaguacaccgaucgcaaauggugcuucgacgggcagcggaacaaucagauccuggaggagaacauggauguggaaauuuggacaaaggagggagagaagaagaagcugagaccgcgcuggcucgacgcucggacguauuccgauccucuugcccugaaagaguuuaaggacuucgccgcuggcagaaaaagcaucgcgcuggaucucaugaccgaaauugggcgcguccccucucaccuggcccauagaacacggaaugcucuugacaaccuggugaugcuccacaccuccgagcauggaggcaaggccuaccgccacgccgucgaggaacugccugagacaauggaaacccugcuccuucugggccugaugauccuccugacagggggagcuaugcuuuuucugauuagcggcaaagggaucggaaagaccuccaucggccucauuugugugaucgccucuagcgggaugcuguggauggcggagauuccccugcaauggaucgccuccgcuauuguucucgaguucuuuaugauggugcuucugaucccugaacccgagaagcagagaacaccgcaggauaaucaacuggccuauguggucauuggaauccucacccuggcugccaucauugcggccaacgaaaugggccuucuggagacaaccaaacgggaccucggcaugagcaaggaaccugggguugugucucccacguccuaccuggauguggaccugcaccccgcuagcgccuggacacucuacgcugucgccaccacagugaucaccccuaugcuucgccauaccauugaaaauucuacagcuaacguuagccuggccgcgaucgccaaccaggcugugguccugaugggacucgacaaaggcuggccgauuuccaagauggaucugggggugccccuucuggcccucggaugcuauucucaggucaauccucugacgcugaccgcugccgugcuccuucugaucacacacuacgccaucauuggccccgggcugcaggcgaaagcuaccagagaggcccaaaagcggacagcugccggaaucaugaagaacccuaccguugacggcauuaugacgaucgaucucgaccccgugauuuaugauagcaaauucgagaagcagcugggccaggucaugcuucuggugcucugugccguucagcugcugcucaugagaacauccugggcucuuugcgaggcccugacccuggcgaccgggccuaucacaacccucugggaaggaucuccgggcaaauuuuggaauacaacgaucgccgugagcauggcuaacauuuuccgcggguccuaccuggccggagcuggccuugccuuuagcaucaugaagucugucgggaccggaaaacggggcacaggcucccaaggggagacccugggagaaaaguggaagaaaaagcucaaucagcugagcagaaaagaguucgaccuguauaagaaauccggcauuacagagguggaucgcaccgaagcgaaggaggggcucaaacggggagaaaucacgcaucacgccgugucuagaggcagcgcuaaacuucagugguuuguugagcggaacauggucauucccgaagggcgcgugaucgaccugggauguggcagaggcgggugguccuacuauugcgccggacugaagaaagugaccgagguccggggcuacacaaaagggggaccuggccaugaggaacccguuccuaugucuaccuacggguggaauauugugaaacucaugagcggaaaggauguguucuaucugcccccggagaaaugugacacacuucugugcgauaucggcgaauccagcccuucucccaccgucgaggagucccgcacaaucagagugcucaagaugguugaacccuggcugaagaacaaucaguucuguauuaaagugcugaacccuuacaugcccaccgucguggagcaccucgaacggcuucaacgcaagcacggcgggaugcugguuagaaauccucugagccggaacucuacgcaugagauguauuggaucuccaauggaacaggcaacauuguggcuagcgucaauauggugucucgccuccugcuuaacagauuuaccaugacccaccggagaccgacaaucgaaaaagacguggaucugggggccggaacgcgccaugucaacgcugagcccgagaccccuaauauggacguuauuggcgaacggaucaagagaaucaaagaggaacacaacagcacauggcacuacgacgaugagaaucccuauaagaccugggccuaccauggguccuaugaagugaaggcgacaggaucugccagcuccaugauuaacggcguggucaaacuccugaccaagccuugggacgugguucccauggugacacagauggcuaugaccgauacgaccccguucggccagcaacgcgucuuuaaagagaagguggacacacggaccccuagaagcaugcccgggacacgccggguuaugggaaucaccgccgaguggcuguggagaacgcucggccgcaauaaaaagccucggcugugcacaagagaagaguucaccaagaaagugcgcacaaacgcugccaugggggccgucuuuaccgaagagaaucagugggauuccgcgaaggcugccguggaagacgaggauuucuggaaacuuguugaccgggagagagaacugcacaagcucggaaaauguggcucuugcguguacaacaugauggggaagcgcgagaaaaagcugggcgaauuuggaaaggccaaaggcagcagagcuauuugguacauguggcuuggggcccgguaucuggaguucgaggcucucggauuucugaaugaagaucauugguucucccgcgagaacucuuacagcggcgucgaaggggagggacugcacaagcucggcuauauccugagagacauuuccaaaauccccgggggcgccauguacgcggaugacacggccggaugggacacccggaucacagaagaugaccuucauaaugaggagaagauuacccagcagauggauccugaacacagacaacuggcuaacgccaucuuuaaacucacauaucagaauaagguggucaaggugcagcggcccaccccgacaggcaccguuauggacauuaucucucgcaaagaucagagagggagcggacaagugggcacguacgggcugaacacauucaccaauauggaggcucagcuuauucggcagauggaaggagagggcguccuguccaaggccgaccucgaaaacccucgccugcccgagaaaaagaucacccaguggcuggagacaaaagggguggaaagacucaagcggauggcgaucagcggcgaugacugcgugguuaagcccauugaugaccgcuuugccaacgcucugcuugcccugaaugauaugggaaaagugagaaaggacaucccucaauggcagccgucuaaaggcuggcacgauuggcagcagguccccuucuguucccaucacuuccaugagcucauuaugaaggacgggcggaaacuggugguuccuugccgcccccaagacgaacuuaucggacgggcucggauuagccagggcgccggguggucucugcgcgagaccgcuugucucggaaaggccuaugcgcagauguggucccugauguacuuucacagacgggaucugcgccucgccagcaacgcuaucugcucugccgugccuguccacugggugcccacauccagaacgaccuggagcauucaugcccaccaucaauggaugacaaccgaagacaugcugacagucuggaaucggguguggaucgaggauaacccuuggauggaggacaagacccccaucacgaccugggaaaauguuccguaccuuggcaaaagagaggaucaguggugugggucccugauuggccucacaagccgcgcuaccugggcccagaacaucccuacagcgauucagcaagugcggucucugaucggaaaugaagaguuccuugacuauaugcccagcaugaagagauuucgcaaagaggaagaguccgaaggcgcuauuugguga

SEQ ID NO: 20807 - RNA, 9873 nt, Artificial Sequence
  derived and/or modified CDS sequence (opt5) from DENV-3__GQ252678__SS-prME
accagccugugccucaugaugauccugcccgccgcucuugccuuccaccugacaucccgggacggcgagccucggaugauuguggggaagaacgaacgcggaaagucucuccuguuuaagacggcgagcggcaucaauauguguacccuuauugcuauggaucugggggaaaugugcgacgauacagugaccuacaaguguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacgcacaacggcaagcgccucgagccgaauugggcuuccgucaaaaaggaccugauuagcuacggcgggggauggagacuuucugcccaguggcaaaaaggcgaagagguccaggugaucgcggucgaaccugggaagaaccccaaaaauuuccagaccaugccuggaacauuccagaccaccacaggcgagauuggggcuaucgcccuggauuuuaagcccggaacguccggcagccccaucauuaaccgggagggcaaggugguugggcuguauggaaauggcguggucaccaaaaacgggggauacguguccggcaucgcccaaacaaaugcugaaccugacgggccgacccccgagcucgaagaggaaauguucaagaaacgcaaccugacaauuauggaucuucauccuggcagcggaaagaccagaaaauaucugcccgccaucguucgggaggcuauuaagcgcagacuccggacgcugauccucgccccuacaagaguggucgcggccgagauggaagaggcucugaagggccuucccauccgcuaccagaccaccgccacaaaaucugaacacaccgggcgggagauuguggaccugaugugccaugcuacauuuaccaugagacugcucagcccuguucgcgugccgaauuauaaccugaucauuauggaugaagcccacuucacggaccccgccuccaucgcugcgcggggauacauuucuacaagagucggcaugggggaggccgcugccaucuuuaugaccgccacaccucccggaaccgcugaugccuucccucagagcaaugcgcccauccaggacgaggaacgcgacauuccggagcgguccuggaacucuggcaaugaauggaucacggauuuugcugggaagaccgugugguucgugccuagcauuaaagccggcaacgacaucgccaacugucuuagaaagaauggcaaaaaggucauucaacugucccgcaagacauuugauaccgaguaccagaaaacaaagcucaacgacugggauuucguugugaccacagacaucucugagaugggagcuaauuuuaaagccgaucgggugauugaccccagacggugccugaagcccgucauccugaccgaugggccugaacgcgugauccucgcgggacccaugccuguuacggccgcuagcgccgcucagagacggggccgcguggggagaaacccgcagaaagagaaugaccaauauauuuucacaggacagccccuuaacaaugaugaagaccaugcccacuggaccgaggcuaagaugcugcuggacaacaucaauaccccugaaggcauuauccccgcccucuucgagccugagcgggaaaaguccgcggccauugauggggaguacagacugaaaggcgaaagccgcaagacauuugucgagcuuaugcggagaggagaccugcccguguggcucgcucacaaaguugccucugaaggcaucaaguauaccgaucgcaaauggugcuucgacgggcagcggaacaaucagauccuggaggagaacauggauguggaaauuuggacaaaggagggagagaagaagaagcugagaccgcgcuggcucgacgcucggacguacuccgauccucuugcccugaaagaguuuaaggacuucgccgcuggcagaaaaagcaucgcgcuggaucucgucaccgaaauugggcgcgugcccacacaucuggcccacagaacccggaaugcucuugacaaccuggucaugcuccauacaucugagcacggaggcaaggccuaucgccacgccguggaggaacugccugagaccauggaaacgcugcuccuucugggccugaugauccuccugaccgggggagcuaugcuuuuucugauuuccggcaaagggaucggaaagacaagcaucggccucauuuguguuaucgccuccucugggaugcuguggauggcggagauuccccugcaauggaucgccagcgcuauugugcucgaguucuuuaugauggugcuucugaucccugaacccgagaagcagagaaccccgcaggauaaucaacuggccuacgucguuauuggaauccucacacuggcugccaucauugcggccaacgaaaugggccuucuggagaccacgaaacgggaccucggcauguccaaggaaccugggguggugagccccacaucuuaucuggaugucgaccugcaucccgcuuccgccuggacccucuacgcuguggccacaaccguuaucaccccuaugcuucgccacacaauugagaauagcacggcuaacgugucucuggccgcgaucgccaaccaggcugucgugcugaugggacucgacaaaggcuggccgauuagcaagauggaucugggggucccccuucuggcccucggaugcuacucccaggugaauccucugacccugacagcugccguucuccuucugaucacccauuaugccaucauuggccccgggcugcaggcgaaagcuacaagagaggcccaaaagcggaccgcugccggaaucaugaagaacccuacgguggacggcauuaugacaaucgaucucgaccccgucauuuacgauucuaaauucgaaaagcagcugggccaggugaugcuucugguucucugugccgugcagcugcugcucaugagaaccagcugggcucuuugcgaggcccugacccuggcgacagggccuaucaccacacucugggaaggauccccgggcaaauuuuggaauacgaccaucgccgucucuauggcuaacauuuuccgcgggagcuaucuggccggagcuggccuugccuuuuccaucaugaaaagcguggggacaggaaaacggggcaccggcucucaaggggagacacugggagaaaaguggaagaaaaagcucaaucagcuguccagaaaagaguucgaccuguacaagaaaagcggcauuaccgagguggaucgcacggaagcgaaggaggggcucaaacggggagaaaucacccaccaugccguuuccagaggcucugcuaaacuucagugguuugucgagcggaacauggugauucccgaagggcgcgugaucgaccugggauguggcagaggcggguggagcuauuacugcgccggacugaagaaagucacagagguucggggcuauaccaaagggggaccuggccacgaggaacccgugccuauguccacauacggguggaauauugugaaacucaugucuggaaaggaugucuucuaccugcccccggagaaaugugacacccuucugugcgauaucggcgaaagcuccccuagccccacaguggaggagucucgcaccaucagaguucucaagaugguggaacccuggcugaagaacaaucaguucuguauuaaaguccugaacccuuauaugcccacggugaucgagcaccucgaacggcuucaacgcaagcauggcgggaugcugguuagaaauccucugucccggaacagcacacacgagauguacuggauuucuaauggaaccggcaacaucguggcuuccgucaauauggugagccgccuccugcuuaacagauuuaccaugacacaucggagaccgacgauugaaaaagacguggaucugggggccggaacccgccacgucaacgcugagcccgagacaccuaauauggacguuaucggcgaacggaucaagagaauuaaagaggaacacaacucuaccuggcauuaugacgaugagaaucccuacaagacaugggccuaucacgggagcuacgaagugaaggcgaccggauccgccucuagcaugaucaacggcguggucaaacuccugacaaagccuugggacgugguucccauggugacccagauggcuaugacggauaccacaccguucggccagcaacgcgucuuuaaagagaagguggacacccggacaccuagauccaugcccgggacccgccggguuaugggaauuacggccgaguggcuguggagaacacucggccgcaauaaaaagccucggcugugcaccagagaagaguucacaaagaaagugcgcaccaacgcugccaugggggccgucuuuacggaagagaaucagugggauagcgcgaaggcugccguggaagacgaggauuucuggaaacuuguugaccgggagagagaacugcauaagcucggaaaauguggcuccugcguguauaacaugauggggaagcgcgagaaaaagcugggcgaauuuggaaaggccaaaggcucuagagcuaucugguacauguggcuuggggcccgguaccuggaguucgaggcucucggauuucugaaugaagaucacugguucagccgcgagaacuccuauucuggcgucgaaggggagggacugcauaagcucggcuacauucugagagacaucagcaaaauccccgggggcgccauguaugcggaugacaccgccggaugggacacacggauuaccgaagaugaccuucacaaugaggagaagaucacacagcagauggauccugaacacagacaacuggcuaacgccauuuuuaaacucaccuaccagaauaagguggucaaggugcagcggcccacaccgaccggcacgguuauggacaucauuucccgcaaagaucagagagggucuggacaagugggcacauaugggcugaacaccuucaccaauauggaggcucagcuuauccggcagauggaaggagagggcguccugagcaaggccgaccucgaaaacccucaucugcccgagaaaaagaucacacaguggcuggagaccaaagggguggaacgccucaagagaauggcgauuuccggcgaugacugcgugguuaagcccaucgaugaccgguuugccaacgcucugcuugcccugaaugauaugggaaaagugcgcaaggacauuccucaauggcagccgagcaaaggcuggcacgauuggcagcagguccccuucuguucucaucacuuccacgagcucaucaugaaggacgggagaaaacuggugguuccuugccggccccaagacgaacuuauuggacgcgcuagaaucucccagggcgccggguggagccugcgggagacagcuugucucggaaaggccuacgcgcagauguggucucugauguauuuucaucgcagagaucugcggcucgccuccaacgcuauuugcagcgccgugccuguccacugggugcccacgucucgcaccacaugguccauccaugcccaccaucaauggaugaccacagaagacaugcugaccgucuggaauagaguguggaucgaggauaacccuuggauggaggacaagacgcccguuaccacaugggaaaaugugccguaccuuggcaaacgggaggaucaguggugugggagccugauuggccucaccuccagagcuacaugggcccagaacaucagcaccgcgauucagcaaguccgcucucugaucggaaaugaagaguuccuugacuacaugccuagcaugaagcgguuuagaaaagaggaagaguccgaaggcgcuauuugguga

SEQ ID NO: 20808 - RNA, 9873 nt, Artificial Sequence
  derived and/or modified CDS sequence (opt5) from DENV-3__FJ850098__SS-prME
accagccugugccucaugaugauccugcccgccgcucuugccuuccaccugacguccagagacggcgaaccucggaugauuguggggaagaacgaacgcggaaaaucucuccuguuuaagacggcgagcggcaucaauauguguacccuuauugcuauggaucugggggaaaugugcgacgauacagucaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucaugucgggaugggacuggauaccagaacacagaccuggaugagcgccgaaggcgcuuggcggcaggucgaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaucccgugaacauugaagcugagccuccguucggcgaauccaauaucgugauugggaucggcgacaacgcccugaaaaucaauugguauaagaagggaucuagcauuggcaaaauguuugaggccacggcuagaggggcuagacgcauggcuauccuuggagauacagccugggacuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugauauggggugugucaucaauuggaaaggaaaggaacugaagugcggcagcgggauuuucgugacaaacgagguucauacguggaccgagcaguacaaauuucaagccgacucccccaagcggcuggcgacagccaucgcuggcgccugggaaaauggaguguguggcauuagaagcaccacacgcauggagaaccuucucuggaaacagaucgcuaaugaacugaacuauauccugugggagaauaacauuaagcucaccgucgugguuggggaugugaucggaguccuggaacagggcaaacggacgcuuacccugcagccuauggagcucaaguacucuuggaaaacaugggggaaggccaagauugugaccgccgagacacaaaacuccagcuucaucauugacggacccaauaccccugaaugccccucugcuuccagagcguggaacgugugggaggucgaagacuauggcuuuggcguuuucacaaccaauaucuggcugaaacugcgcgagguguacacgcagcuuugugaucaccggcucaugagcgccgcugugaaggacgaaagagccguccacgccgauaugggguacuggaucgagucccagaaaaacggaucuuggaagcuggagaaagcuagccugauugaagugaagacaugcaccuggccgaagucccauacccucuggucuaauggcguucuggagagcgacaugaucauuccuaaaucccuugccgggcccaucagccagcacaacuaucgcccuggauaccauacacaaaccgcgggccccuggcaccuggggaagcucgaacuggauuuuaauuauugcgagggaacgacaguggucauuaccgagaacuguggcacacggggcccuucucugagaaccacaaccguguccgggaaacuuauccacgaauggugcugucgcagcugcacgcugcccccgcugcgguacaugggagaggacggcuguugguaugggauggaaaucagaccuauuucugagaaggaagagaauaugguuaaaucccuggugagcgcuggaucuggcgaggucgauaacuucaccaugggggugcucugccuggccauccuuuuugaagagguuaugcggggaaaguucggcaagaaacauaugauugccggcguguucuuuacauucguccugcuccugagcgggcagaucaccuggcgcgacauggcucacacacugauuaugaucggauccaaugccagcgauagaaugggcaugggggugaccuaccuugcgcugauugcuacguuuaagauccagcccuuccucgcccugggauuuuuccuccggaaacugacaucuagagaaaaccuucugcucggcguggggcuggccauggcuaccacacugcaacuucccgaggacaucgaacagauggccaauggaauugcucugggccucauggcccugaagcucaucacccaguuugagaccuaucagcuguggacagcgcuuauuucccugacguguagcaacaccaucuucacacucaccgucgccuggcgcacagcuacccugauucuggccggcguuucccuucugccugugugccaaucuagcuccaugcggaaaacggauuggcucccgaugacaguggcugccaugggggugcccccucugccccucuuuaucuucucucugaaggacacccuuaagagacgcagcuggccucugaaugagggagugauggccguuggccugguguccauccucgcuucuagccugcuuagaaacgauguccccauggcggggccucugguggccggaggccuccugauugcuuguuacguuaucaccgggacauccgccgaccucaccguggaaaaagccgcugacgucacaugggaggaagaggccgaacagacgggagugagccauaaccugaugauuaccgucgaugacgauggcacaaugcggaucaaggacgaugagaccgagaauauucuuacagugcugcugaaaaccgcgcuccugaucguuucuggcaucuuucccuacuccauuccggcuacgcuucugguguggcacaccuggcagaagcagacacaacgcagcgggguccucugggacgugccuucucccccugaaacccagaaagccgagcuggaagagggaguuuauagaaucaagcagcagggcauuuucgggaaaacacaagugggagucggcgugcagaaggaggggguguuucauaccauguggcacguuacacggggagccguccucacguacaacggcaagcgccuggaacccaauugggcuuccgugaaaaaggaucuuaucagcuauggcgggggauggagacugucugcccaguggcaaaaaggcgaggaagugcaggucauugcgguggagccggggaagaacccuaaaaauuuccagaccaugcccggaacauuccagaccaccacaggcgaaaucggggcuauugcccuggacuuuaagccuggaacguccggcagccccaucaucaaccgggagggcaagguuguggggcucuacggaaauggcgucgugaccaaaaacgggggauauguuuccggcauugcccaaacaaaugcugagcccgaugggccuaccccggaacuggaggaagagauguucaagaaacgcaaccuuacaaucauggaccugcaccccggcagcggaaagaccagaaaauaccucccugccauugugcgggaagcuaucaagcgcagacugcggacgcucauucuggcccccacaagagucguggcggccgagauggaggaagcucuuaagggccugccuauccgcuaucagaccaccgccacaaaaucugagcauaccgggcgggaaaucguugaucugaugugccacgcuacauuuaccaugagacuccugagccccgugcgcgucccuaauuacaaccuuauuaucauggacgaggcccauuucacggauccggccuccauugcugcgcggggauacaucucuacaagagugggcaugggggaagccgcugccauuuuuaugaccgccacacccccuggaaccgcugacgccuucccccagagcaaugcgccuauccaggacgaggagcgcgauauccccgaacgguccuggaacucuggcaaugaguggauuacggacuuugcugggaagaccgugugguucgucccgagcaucaaagccggcaacgauauugccaacugucugagaaagaauggcaaaaagguuauccaacucucccgcaagacauuugacaccgaauaucagaaaacaaagcugaacgauugggacuucguggugaccacagauauuucugagaugggagcuaauuuuaaagccgaccgggucaucgauccuagacggugccugaagcccgugauucucaccgacgggcccgagcgcguuauccuugcgggaccuaugcccgugacggccgcuagcgccgcucagagacggggccgcgucgggagaaacccucagaaagaaaaugaucaauacaucuucacaggacagccgcugaacaaugacgaggaccacgcccauuggaccgaagcuaagaugcugcucgauaacauuaauacccccgagggcaucauuccugcccuguucgaacccgagcgggagaaguccgcggccaucgacggggaauauagacuuaaaggcgagagccgcaagacauuuguggaacugaugcggagaggagaucucccuguuuggcuggcucacaaaguggccucugagggcauuaaguacaccgaccgcaaauggugcuucgaugggcagcggaacaaucagauccuggaagagaacauggacgucgagaucuggacaaaggaaggagagaaaaagaagcucagaccccgcuggcuugaugcucggacguauuccgacccgcuggcccugaaagaauuuaaggauuucgccgcuggcagaaaaagcauugcgcucgaccuggugaccgagaucgggcgcgucccuucucaccuugcccauagaacacggaaugcucuggauaaccucgugaugcugcacaccuccgaacauggaggcaaggccuaccgccacgccguugaggagcugcccgaaacaauggagacccuccuucugcugggccucaugauucugcuuacagggggagcuaugcuguuucucaucagcggcaaagggauuggaaagaccuccaucggccugaucugugugauugccucuagcgggaugcuguggauggcggaaaucccucuccaauggauugccuccgcuaucgugcuugaguucuuuaugaugguccugcugauucccgagccugaaaagcagagaacaccccaggacaaucaacucgccuauguugugaucggcauucucacccuugcugccaucaucgcggccaacgagaugggacugcucgaaacaaccaaacgggaucugggcaugagcaaggagccggggguggucucuccuacguccuaccuggacguggaccuccaccccgcuagcgccuggacacuuuacgcuguugccaccacagugauuacccccaugcugcgccauaccaucgaaaauucuacagcuaacgucagccuggccgcgauugccaaccaggcugugguccucaugggacuggauaaaggcuggccuaucuccaagauggaccuuggggugccgcugcucgcccugggaugcuauucucagguuaauccccugacgcucaccgcugccgugcuucugcugauuacacacuacgccaucaucggcccugggcuccaggcgaaagcuaccagagaggcccaaaagcggacagcugccggaauuaugaagaaccccaccgucgauggcaucaugacgauugaccuggauccugugaucuaugacagcaaauucgagaagcagcuuggccagguuaugcugcucgugcugugugccguccagcugcuccuuaugagaacauccugggcucugugcgaagcccugacccucgcgaccgggcccauuacaacccugugggagggaucuccuggcaaauuuuggaauacaacgaucgccgugagcauggcuaacaucuuccgcggguccuaccuugccggagcuggccuggccuuuagcauuaugaagucuguggggaccggaaaacggggcacaggcucccaaggggaaacccucggagagaaguggaagaaaaagcugaaucagcugagcagaaaagaguucgaucucuauaagaaauccggcaucacagagguugaccgcaccgaggcgaaggaagggcuuaaacggggagagauuacgcaucacgccgucucuagaggcagcgcuaagcugcagugguuuguggaacggaacauggugaucccggaggggcgcgucauugaucugggauguggcagaggcgggugguccuacuauugcgccggacucaagaaaguuaccgaagugcggggcuacacaaaagggggacccggccaugaggagccugugcccaugucuaccuacggguggaauaucgucaaacugaugagcggaaaggacguguucuaucuuccucccgaaaaaugugauacacugcucugcgacauuggcgaguccagcccgucuccuaccguugaagagucccgcacaaucagagugcugaagauggucgagcccuggcugaagaacaaucaguucuguaucaaagugcucaaccccuacaugccuaccguuguggaacaccuugagcggcugcaacgcaagcacggcgggaugcuggucagaaauccccucagccggaacucuacgcaugaaauguauuggauuuccaauggaacaggcaacaucguggcuagcgugaauauggucucucgccugcuucugaacagauuuaccaugacccaccggagaccuacaauugagaaagauguugaccucggggccggaacgcgccaugugaacgcugaaccggagacccccaauauggacgugaucggcgagcggauuaagagaaucaaagaagaacacaacagcacauggcacuacgaugacgaaaauccuuauaagaccugggccuaccauggguccuaugaggucaaggcgacaggaucugccagcuccaugaucaacggcgugguuaaacugcugaccaagcccugggauguggucccuauggugacacagauggcuaugaccgacacgacccccuucggccagcaacgcguuuuuaaagaaaagguggauacacggaccccgagaagcaugccugggacacgccgggucaugggaauuaccgccgaguggcucuggagaacgcugggccgcaauaaaaagccccggcuuugcacaagagaggaguucaccaagaaagugcgcacaaacgcugccaugggggccguuuuuaccgaggaaaaucagugggacuccgcgaaggcugccguggaggaugaagacuucuggaaacuggucgaucgggagagagagcuccacaagcugggaaaauguggcucuugcguguacaacaugauggggaagcgcgagaagaaacuuggcgaguuuggaaaggccaaaggcagcagagcuaucugguacauguggcugggggcccgguaucucgaguucgaggcucugggauuucugaaugaggaccauugguucucccgcgaaaacucuuacagcggcgucgagggggaaggacuccacaagcugggcuauauucuuagagauaucuccaaaauuccugggggcgccauguacgcggacgacacggccggaugggauacccggaucacagaggacgaucugcauaaugaagagaagaucacccagcagauggaccccgagcacagacaacucgcuaacgccauuuuuaaacugacauaucagaauaaggugguuaaggugcagcggccuacccccacaggcaccgucauggauaucauuucucgcaaagaccagagagggagcggacaagugggcacguacgggcuuaacacauucaccaauauggaagcucagcugauccggcagauggagggagaaggcgugcucuccaaggccgaucuggagaacccgcgccugccugagaagaagauuacccaguggcucgagacaaaagggguugagagacugaagcggauggcgaucagcggcgacgauugcguggucaagcccaucgacgaucgcuuugccaacgcccuucuggcccucaaugacaugggaaaagugagaaaggauauuccccaauggcagccuucuaaaggcuggcacgacuggcagcagguuccguucuguucccaucacuuccaugaacugaucaugaaggacgggcggaaacuugugguccccugccgcccucaagaugagcugauuggacgggcucggaucagccagggcgccggguggucucuccgcgaaaccgcuugucugggaaaggccuaugcgcagauguggucccugauguacuuucacagacgggaccuccgccuggccagcaacgcuauuugcucugccgugcccguccacugggugccuacauccagaacgaccuggagcauccaugcccaccaucaauggaugacaaccgaggauaugcuuacaguuuggaaucggguguggauugaagacaaccccuggauggaggauaagaccccugucacgaccugggagaaugugcccuaccugggcaaaagagaagaccaguggugugggucccucaucggccugacaagccgcgcuaccugggcccagaacaucccgacagcgauucagcaaguucggucucuuaucggaaaugaggaguuccuggauuauaugccuagcaugaagagauuucgcaaagaggaggaauccgagggcgcuauuugguga

SEQ ID NO: 20809 - RNA, 9873 nt, Artificial Sequence
  derived and/or modified CDS sequence (opt5) from DENV-3__KF955479__SS-prME
accagccucugccucaugaugauccugcccgccgcucuugccuuccaccugacgucccgggacggcgaaccucggaugauuguggggaagaacgaacgcggaaagucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucauguugggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagcuuuaucgaggucaagacaugcaccuggccuaagucccauacccuguggucuaauggcgugcuggaaagcgauaugauuauccccaaaucccucgccgggccuauuagccagcacaacuaucgccccggauaccauacacaaaccgcgggcccuuggcaccuggggaaacuugagcuggacuucaauuauugcgagggaacgacaguugugaucaccgaaaacuguggcacacggggccccucucucagaaccacaaccgucuccgggaaacugauccacgaguggugcugucgcagcugcacgcugccgccucuucgguacaugggagaagauggcuguugguaugggauggagauuagacccaucucugaaaaggaggagaauauggugaaaucccucguuagcgcuggaucuggcgaaguggacaacuuuaccauggggguccugugccuggccauucucuucgaggaagugaugcggggaaaguucggcaagaaacauaugaucgccggcgucuuuuucacauuugugcugcuucugagcgggcagauuaccuggcgcgauauggcucacacacucaucaugauuggauccaaugccagcgacagaaugggcaugggggucaccuaccuggcgcugaucgcuacguucaagauccagcccuuucuugcccugggauucuuucuccggaaacugacaucuagagagaaccuccugcuuggcguggggcuggccauggcuaccacacuccaacugccugaagauauugagcagauggccaauggaaucgcucugggccuuauggcccugaagcucauuacccaguucgagaccuaucagcuguggacagcgcucaucucccugacguguagcaacaccauuuuuacacuuaccguggccuggcgcacagcuacccugauccucgccggcgucucccugcugccgguuugccaaucuagcuccaugcggaaaacggacuggcuucccaugacaguggcugccaugggggugccuccccugccucucuucaucuuuucucugaaggauacccucaagagacgcagcuggccccugaaugaaggagucauggccgugggccuuguuuccauucuggcuucuagccugcucagaaacgacgugccuauggcggggccccuggucgccggaggccuucugaucgcuuguuacgugauuaccgggacauccgccgaucucaccguugagaaagccgcugacgugacaugggaagaggaagccgagcagacgggagucagccauaaccugaugaucaccguggacgaugacggcacaaugcggauuaaggaugacgagaccgaaaauauccucacaguccugcuuaaaaccgcgcugcugaucgugucuggcauuuucccguacuccaucccugcuacgcuccugguuuggcacaccuggcagaagcagacacaacgcagcggggugcuuugggauguccccucuccucccgagacccagaaagccgaacuggaggagggaguguauagaauuaagcagcagggcaucuuugggaaaacacaaguuggagugggcguccagaaggaagggguguuccauaccauguggcacgugacacggggagccguucucacguacaacggcaagcgccuggagccgaauugggcuuccgucaaaaaggaccucauuagcuauggcgggggauggagacugucugcccaguggcaaaaaggcgaagagguccaggugaucgcggucgaaccugggaagaaccccaaaaauuuccagaccaugccuggaacauuucagaccaccacaggcgagauuggggcuaucgcccuugauuucaagcccggaacguccggcagccccaucauuaaccgggagggcaaggugguugggcuguacggaaauggcguggucaccaaaaacgggggauauguguccggcaucgcccaaacaaaugcugaaccugacgggccgacccccgagcuggaagaggaaauguuuaagaaacgcaaccucacaauuauggaucugcacccuggcagcggaaagaccagaaaauaccuucccgccaucguucgggaggcuauuaagcgcagacugcggacgcucauccuggccccuacaagaguggucgcggccgagauggaagaggcucucaagggccugcccauccgcuaucagaccaccgccacaaaaucugaacauaccgggcgggagauuguggaccuuaugugccacgcuacauucaccaugagacugcugagcccuguucgcgugccgaauuacaaccucaucauuauggaugaagcccauuuuacggaccccgccuccaucgcugcgcggggauacauuucuacaagagucggcaugggggaggccgcugccaucuucaugaccgccacaccucccggaaccgcugaugccuuuccucagagcaaugcgcccauccaggacgaggaacgcgacauuccggagcgguccuggaacucuggcaaugaauggaucacggauuucgcugggaagaccgugugguuugugccuagcauuaaagccggcaacgacaucgccaacugucugagaaagaauggcaaaaaggucauucaacuuucccgcaagacauucgauaccgaguaucagaaaacaaagcugaacgacugggauuuuguugugaccacagacaucucugagaugggagcuaauuucaaagccgaucgggugauugaccccagacggugccucaagcccgucauccugaccgaugggccugaacgcgugauccuggcgggacccaugccuguuacggccgcuagcgccgcucagagacggggccgcguggggagaaacccgcagaaagagaaugaccaauacauuuucacaggacagccccucaacaaugaugaagaccacgcccauuggaccgaggcuaagaugcuucuggacaacaucaauaccccugaaggcauuauccccgcccuguuugagccugagcgggaaaaguccgcggccauugauggggaguauagacucaaaggcgaaagccgcaagacauucgucgagcugaugcggagaggagaccuucccguguggcuggcucacaaaguugccucugaaggcaucaaguacaccgaucgcaaauggugcuuugacgggcagcggaacaaucagauccucgaggagaacauggauguggaaauuuggacaaaggagggagagaagaagaagcugagaccgcgcuggcuggacgcucggacguauuccgauccucucgcccuuaaagaguucaaggacuuugccgcuggcagaaaaagcaucgcgcuggaucuggucaccgaaauugggcgcgugcccucucaccucgcccauagaacacggaaugcucuggacaaccuugucaugcugcacaccuccgagcauggaggcaaggccuaccgccacgccguggaggaacucccugagacaauggaaacccugcugcuccuuggccugaugauccugcucacagggggagcuaugcuguuccuuauuagcggcaaagggaucggaaagaccuccaucggccugauuuguguuaucgccucuagcgggaugcucuggauggcggagauuccccugcaauggaucgccuccgcuauugugcuggaguuuuucaugauggugcuccuuaucccugaacccgagaagcagagaacaccgcaggauaaucaacuggccuaugucguuauuggaauccugacccucgcugccaucauugcggccaacgaaaugggccugcuugagacaaccaaacgggaccugggcaugagcaaggaaccugggguggugucucccacguccuaccucgaugucgaccugcaccccgcuagcgccuggacacuguacgcuguggccaccacaguuaucaccccuaugcuccgccauaccauugaaaauucuacagcuaacgugagccuugccgcgaucgccaaccaggcugucgugcugaugggacuggacaaaggcuggccgauuuccaagauggaucucggggucccccugcuugcccugggaugcuauucucaggugaauccucucacgcugaccgcugccguucugcuccuuaucacacacuacgccaucauuggccccgggcugcaggcgaaagcuaccagagaggcccaaaagcggacagcugccggaaucaugaagaacccuaccguggacggcauuaugacgaucgaucuggaccccgucauuuaugauagcaaauuugaaaagcagcucggccaggugaugcugcuuguucugugugccgugcagcuccugcugaugagaacauccugggcucucugcgaggcccuuacccuggcgaccgggccuaucacaacccugugggaaggaucuccgggcaaauucuggaauacaacgaucgccgucagcauggcuaacauuuuucgcggguccuaccucgccggagcuggccuggccuucagcaucaugaagucuguggggaccggaaaacggggcacaggcucccaaggggagacccuuggagaaaaguggaagaaaaagcugaaucagcucagcagaaaagaguuugaccuguauaagaaauccggcauuacagagguggaucgcaccgaagcgaaggaggggcugaaacggggagaaaucacgcaucacgccguuucuagaggcagcgcuaagcuccagugguucgucgagcggaacauggugauucccgaagggcgcgugaucgaccuuggauguggcagaggcgggugguccuacuauugcgccggacugaagaaagucaccgagguucggggcuacacaaaagggggaccuggccaugaggaacccgugccuaugucuaccuacggguggaauauugugaaacugaugagcggaaaggaugucuucuaucugcccccggagaaaugugacacacugcuuugcgauaucggcgaauccagcccuucucccaccguggaggagucccgcacaaucagaguucugaagaugguggaacccuggcucaagaacaaucaguuuuguauuaaaguccugaacccuuacaugcccaccgugaucgagcaccuggaacggcuccaacgcaagcacggcgggaugcuuguuagaaauccucugagccggaacucuacgcaugagauguauuggauuuccaauggaacaggcaacaucguggcuagcgucaauauggugucucgccugcuccugaacagauucaccaugacccaccggagaccgacaauugaaaaagacguggaucuuggggccggaacgcgccaugucaacgcugagcccgagaccccuaauauggacguuaucggcgaacggaucaagagaauuaaagaggaacacaacagcacauggcacuacgacgaugagaaucccuauaagaccugggccuaccauggguccuaugaagugaaggcgacaggaucugccagcuccaugaucaacggcguggucaaacugcucaccaagccuugggacgugguucccauugugacacagauggcuaugaccgauacgaccccguuuggccagcaacgcgucuucaaagagaagguggacacacggaccccuagaagcaugcccgggacacgccggguuaugggaaucaccgccgaguggcuguggagaacgcugggccgcaauaaaaagccucggcucugcacaagagaagaguuuaccaagaaagugcgcacaaacgcugccaugggggccgucuucaccgaagagaaucagugggauuccgcgaaggcugccguggaagacgaggauuuuuggaaacugguugaccgggagagagaacuucacaagcugggaaaauguggcucuugcguguacaacaugauggggaagcgcgagaaaaagcucggcgaguucggaaaggccaaaggcagcagagcuauuugguacauguggcugggggcccgguaucuugaguuugaggcucugggauuccucaaugaagaucauugguuuucccgcgagaacucuuacagcggcgucgaaggggagggacugcacaagcugggcuauauccucagagacaucuccaaaauucccgggggcgccauguacgcggaugacacggccggaugggacacccggaucacagaagaugaccugcauaaugaggagaagauuacccagcagauggauccugaacacagacaacuugcuaacgccaucuucaaacugacauaucagaauaagguggucaaggugcagcggcccaccccgacaggcaccguuauggacauuaucucucgcaaagaucagagagggagcggacaagugggcacguacgggcucaacacauuuaccaauauggaggcucagcugauccggcagauggaaggagagggcguccuuuccaaggccgaccuggaaaacccucaccuccccgagaaaaagauuacccaguggcuggagacaaaagggguggaacgccugaagagaauggcgaucagcggcgaugacugcgugguuaagcccauugaugaccgguucgccaacgcucuccuggcccuuaaugauaugggaaaagugcgcaaggacaucccucaauggcagccgucuaaaggcuggcaugauuggcagcagguccccuucuguucccaccauuuucacgagcugauuaugaaggacgggagaaaacucgugguuccuugccggccccaagacgaacugaucggacgcgcuagaauuagccagggcgccggguggucucuucgggagaccgcuugucugggaaaggccuaugcgcagauguggucccucauguacuuccaccgcagagaucugcggcuggccagcaacgcuaucugcucugccgugccuguccauugggugcccacaucccgcacgaccuggagcauccacgcccaucaccaauggaugacaaccgaagacaugcucacagucuggaauagaguguggauugaggauaacccuuggauggaggacaagacccccguuacgaccugggaaaaugugccguaccugggcaaacgggaggaucaguggugugggucccuuaucggccugacaagcagagcuaccugggcccagaacauuccuacagcgauccagcaaguccgcucucucauuggaaaugaagaguuucuggacuauaugcccagcaugaagcgguucagaaaagaggaagaguccgaaggcgcuaucugguga

SEQ ID NO: 20810 - RNA, 9873 nt, Artificial Sequence
  derived and/or modified CDS sequence (opt5) from DENV-3__FJ850109__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacacggggacaucccucacccagaagguggucaucuucauucugcuuaugcuggugacaccuucuaugaccaugagauguguuggagugggcaaccgggacuuugucgaagggcucagcggagcuaccuggguggaugugguccuggagcacggcgggugcguuacaacgauggccaagaauaaacccacccuggacaucgagcuccagaagacagaagcuacccaacuggccacacuucgcaaacuguguauugagggaaagaucaccaacauuacgacagauuccagaugcccuacccagggcgaagcggugcucccggaggaacaggaccagaauuauguguguaaacacaccuacgucgaucggggcugggggaacggaugcggccuguucgggaagggaagccuugugacaugcgccaaguuucaaugucuggagcccaucgagggcaaaguugugcaguaugaaaaucucaaguacaccgucauuaucacagugcauacgggggaccagcaccagguuggaaacgagacccaaggcgugacagcugaaaucaccccucaggccucuacaaccgaggcuauucugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucagaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagauguucccuguaaaaucccuuucagcacagaggacggccaagggaaggcccauaacggaagacugauuaccgcgaaucccguggucacgaaaaaggaggaacccgugaacaucgaggcugaaccuccguucggcgaguccaauauugugaucgggauuggcgauaacucucugaaaaucaauugguauaagaagggaagcuccaucggcaaaauguuugaagccacagcccggggggcuagacgcauggccauucuuggagacaccgcuugggauuucggcagcguugggggaguccucaacucucugggcaagauggugcaccagaucuuuggguccgccuacaccgcgcuguucagcggcgugucuugggucaugaaaauuggaaucggcgugcuccugacauggauugggcuuaauagcaagaacaccuccaugucuuuuagcugcaucgccauuggaaucaucacacuguaucucggcgcuguugugcaggccgacacggggugugucauuaauuggaaaggaaaggagcugaagugcggcuccgggaucuucgugaccaacgagguucauacauggaccgaacaguacaaauuucaagcugauagccccaagcggcuggccacagcgauugccggcgcuugggagaauggaguguguggcaucagaucuaccacgcgcauggaaaaccuucucuggaaacagauugccaaugagcugaacuauauccugugggaaaauaacaucaagcucaccgucgugguuggggacauuaucggagugcuggagcagggcaaacggacacuuaccccucagcccauggagcugaaguacuccuggaaaacaugggggaaggcuagaauugucaccgccgaaacacaaaacagcucuuucaucauugauggaccuaauacccccgagugcccgaacacgucccgcgccuggaaugugugggaaguggaggacuauggcuuuggcgucuucacaaccaacaucuggcucaagcugcgggaaguuuacacccagcugugugaccacagacuuaugagcgcugcggugaaagaugagcgcgccgugcacgcugacaugggguacuggaucgagucccagaagaauggaucuuggaaacucgaaaaggccagccugauugaggucaaaacaugcaccuggccuaagucccauacgcuguggucuaacggcgugcucgaaagcgauaugaucauucccaagucccuggccgggccuaucagccagcacaauuaucggcccggauaccauacacaaaccgcuggcccuuggcaccuugggaaacuggagcucgacuuuaacuauugcgagggaacaaccguugugauuacagaaaauuguggcaccagaggccccucucugcgcacgaccacagucuccgggaagcugauccacgaguggugcugucggagcugcacccuuccgccucucagauacaugggagaagauggcuguugguaugggauggagauccggcccauuucugaaaaagaggagaacauggugaagucccugguuagcgccggaucuggcgaaguggacaauuucacaauggggguccugugccucgcgauccuguuugaggaagugaugcgcggaaaauucggcaagaagcauaugauugcuggcguuuucuuuaccuucgugcuucugcucagcgggcagaucacguggagagauauggcccacacacugauuaugaucggauccaacgccaccgaccggaugggcaugggggucacauaccuggcucuuauugccaccuuuaaaauccagcccuuccuggcgcucggauuuuuccugagaaagcucaccagccgcgagaaucugcuucugggcguggggcucgcuauggccacaacgcugcaacugccugaagauaucgagcagauggccaacggaauugcucuuggccugauggcccucaaacugaucacccaguuugagacauaucagcucuggaccgcucugauuucucuuacauguuccaauaccaucuucacgcugacaguggccuggcggaccgcgacccucauucuggccggcgucagccugcuuccgguuugccaauccucuagcaugagaaagacagacuggcugcccaugaccguggcugccaugggggugccuccccucccucuguuuaucuucucccucaaagauacacugaagcgcagaucuuggccccuuaacgaaggagucauggcugugggccugguuagcauccuggccuccucucuccugcggaacgacgugccuauggccgggccccuugucgcuggaggccugcucauugcguguuacgugaucacggggaccagcgccgaucugacaguugagaaggcugccgacgugaccugggaagaggaagccgagcagacaggagucucccauaaucucaugauuaccguggacgaugacggcacgaugcgcaucaaagaugacgagaccgaaaacauucugacaguccuucugaagaccgcucugcucaucgugagcggcaucuuuccguacucuauuccugccacacugcuuguuuggcacaccuggcagaaacagacacaaagauccggggugcugugggauguccccagcccucccgagacgcagaaggcggaacucgaggagggaguguaucggaucaaacagcagggcauuuucgggaagacccaaguuggagugggcguccagaaagaagggguguuucauacaauguggcacgugacccgcggagcuguucugaccuacaauggcaagagacucgagccgaacugggccucugucaagaaagaccugaucuccuauggcgggggauggcggcuuagcgcccaguggcaaaagggcgaagaggugcaggugauugcugucgaaccugggaaaaaucccaagaacuuccagacaaugccuggaacguuccagaccacaaccggcgagaucggggccauugcgcuggauuuuaaacccggaacaucuggcucccccaucaucaaucgcgagggcaaggugguugggcuguacggaaacggcguggucaccaagaaugggggauaugugagcggcauugcucaaacgaacgccgaaccugacgggccgacacccgagcucgaagaggaaauguucaaaaagagaaaucugaccaucauggaucuucacccuggcuccggaaaaacccggaaguaccugcccgccauuguucgcgaggcuaucaaaagacggcucagaacacugauucucgccccuacccgcguggucgcugccgagauggaagaggcgcugaagggccuucccauccgguaucagacaaccgccacgaagagcgaacauacagggagagagaucguggaccugaugugccacgcuaccuuuacaaugcgccugcucucuccuguucgggugccgaacuacaaucugauuaucauggaugaagcccauuucaccgaccccgcuagcauugccgccagaggauacaucuccacgcgcgucggcaugggggaggcugcggccauuuuuaugaccgcuacaccucccggaaccgccgaugccuucccucagucuaacgcucccauccaggacgaggaacgggacaucccggagagaagcuggaauuccggcaacgaauggauuacagauuuugccgggaaaaccgugugguucgugccuucuaucaaggcgggcaacgacauugcuaauugucuucgcaaaaacggaaagaaagucauccaacugagccggaagacauuugauaccgaguaucagaagacgaaacucaaugacugggauuucguugugacaaccgacauuuccgagaugggcgccaacuuuaaggccgauagagugaucgacccccggcgcugccugaaacccgucauucugaccgaugggccugaaagagugauccucgcuggacccaugccuguuacagccgcgucugccgcucagcggcgcggcagaguggggcggaauccgcagaaggagaacgaccaauacaucuucaccggacagccccuuaauaacgaugaagaccacgcccauuggacagaggcuaaaaugcugcuggacaauauuaacacgccugaaggcaucauucccgcccucuucgagccugagagagaaaagagcgcugccaucgauggggaguaucgccugaagggcgaaucccggaaaaccuuugucgagcuuaugagacgcggagaccugcccguguggcucgcgcacaagguugccagcgaaggcauuaaauacacagaucggaaguggugcuucgacgggcagagaaauaaccagauccuggaggagaauauggauguggaaaucuggaccaaagagggagaaaagaaaaagcugcgcccgcgguggcucgacgcuagaacauauucugauccucuugcccugaaggaguuuaaagacuucgcugccggccgcaaguccauugcccuggaucucgucaccgaaaucgggagagugcccacgcaccuggcucaucggacccgcaacgcgcuugacaaucuggucaugcuccacacaagcgagcauggaggcaaagccuacagacacgcuguggaggaacugccugagaccauggaaacacugcuccuucugggccugaugauucuccugaccgggggagccaugcuuuuucugaucucuggcaaggggauuggaaaaacguccaucggccucaucuguguuauugccagcuccgggaugcuguggauggcugagaucccccugcaauggauugccucugcgaucgugcucgaguucuuuaugauggugcuucugauuccugaacccgagaagcagcggacaccgcaggauaaccaacuggccuaugucguuaucggaauucucacccuggcugccaucaucgcugccaaugaaaugggccuucuggagacaaccaagcgcgaccucggcaugagcaaagaaccugggguggugucccccaccagcuaccuggaugucgaccugcaccccgcgucugccuggacacucuacgcuguggccacgaccguuauuacaccuaugcuuagacauaccaucgagaacuccacagcuaacgugagccuggccgcuauugccaaucaggcggucgugcugaugggacucgacaagggcuggccgaucucuaaaauggaucugggggucccccuucuggcccucggaugcuauagccaggugaacccucugacccugacggcugccguucuccuucugauuacacacuacgcuaucaucggccccgggcugcaggccaaggccacccgggaggcgcaaaaaagaaccgcugccggaauuaugaagaauccuacaguggacggcaucaugaccauugaucucgaccccgucaucuaugauuccaaguucgaaaaacagcugggccaggugaugcuucugguucucugugcugugcagcugcugcucaugcgcacaucuugggcccuuugcgaggcccugacgcuggcuaccgggccuauuacaacccucugggaaggaagcccgggcaaguuuuggaacacaaccaucgccgucuccauggcgaauaucuuccgggggucuuaccuggccggagcuggccuugccuuuagcauuaugaaauccguggggacgggaaagagaggcaccggcagccaaggggagacacugggagaaaaauggaagaagaaacucaaccagcugucucgcaaggaguucgaccuguauaaaaaguccggcaucaccgagguggaucggacagaagcuaaagaggggcucaagagaggagaaauuacccaucacgccguuagccggggcuccgcgaaacuucagugguuugucgagcgcaauauggugauccccgaagggagagugauugaccugggauguggccggggcggguggucuuacuauugcgccggacugaagaaggucacagagguucgcggcuacaccaaagggggaccuggccaugaggaacccgugccuaugagcacguacggguggaacaucgugaagcucauguccggaaaagaugucuucuaucugcccccggagaagugugacacacuucugugcgauauuggcgaaucuagcccuucccccaccguggaggagagcagaaccauccggguucucaaaaugguggaacccuggcugaagaauaaccaguucuguaucaagguccugaauccuuacaugcccgcugugauugagcaccucgaacgccuucaaagaaaacacggcgggaugcugguucggaacccucugucucgcaauuccacacaugagauguauuggaucagcaacggaacgggcaauauuguggccucugucaacaugguguccagacuccugcuuaaccgguuuaccaugacacacagacgcccgaccaucgaaaaggacguggaucugggggcuggaacacggcaugucaaugccgagcccgagaccccuaacauggacguuauuggcgaaagaaucaaacgcaucaaggaggaacacaauagcacauggcacuacgacgaugagaaccccuauaaaaccugggcuuaccaugggucuuaugaagugaaggccacgggaagcgcguccucuaugauuaauggcguggucaagcuccugaccaaaccuugggacgugguucccauggugauccagauggccaugacagauaccacaccguucggccagcaacgggucuuuaaggagaaaguggacaccagaacgccucgcagcaugcccgggacacggagaguuauggagauuaccgcugaauggcuguggcgcacacucggacggaacaagaaaccuagacugugcacccgcgaggaauucacgaagaaggugcggaccaaugccgcuaugggcgccgucuuuacagaggaaaaccagugggauuccgccaaagcggcuguggaggacgaggauuucuggaagcuuguugacagagaacgcgagcugcacaaacucgggaaguguggaagcugcguguacaauaugaugggcaaaagagaaaagaaacugggggaguuuggcaaggccaagggaucccgggccaucugguacauguggcuuggcgcucgcuaucuggaguucgaagcccucggguuucugaacgaggaucauugguucucuagagaaaauagcuacuccggagucgagggcgaagggcugcacaaacucggauauauucugcgggacaucucuaagauccccggcggggcuauguacgccgaugacaccgcgggcugggacacaagaauuaccgaggaugaccuucauaacgaggaaaaaaucacacagcagauggauccugagcaccggcaacuggccaaugcuauuuuuaagcucaccuaucagaacaaaguggucaaggugcagcgccccacgccgacaggaaccguuauggacaucauuagcagaaaggaucagcggggcuccgggcaagugggaaccuacggccugaauacauucaccaacauggaagcccagcuuauccgccagauggagggggaaggaguccugucuaaagcugaccucgagaacccucaccugcccgagaagaaaaucacacaguggcuggaaacgaagggcguggagagacucaaacggauggccauuagcggggaugacugcgugguuaagcccaucgaugaccgcuuugcgaaugcccugcuugcucugaacgauaugggcaaggugagaaaagacauuccucaauggcagccguccaagggauggcaugauuggcagcagguccccuucuguagccaccauuuccacgaacucaucaugaaagacggccggaagcuggugguuccuugccgcccccaagacgagcuuauugggagagcccggaucucucagggagcuggcuggucccugcgcgaaaccgccugucucgggaaagcuuaugcccagauguggagccugauguacuuucacagacgggaucugcgccucgcgucuaaugccauuugcuccgcugugccuguccauugggugcccacaagcagaaccacauggucuauccacgcccaucaccaauggaugaccacggaggacaugcugaccgucuggaaccggguguggaucgaggauaauccuuggauggaagacaagacacccguuaccacaugggagaacgugccguaccuuggaaagagagaagaucagugguguggcucccugauugggcucaccagccgcgccacgugggcucagaauaucccuacagccauucagcaaguccggucccugaucggcaacgaggaguuccuugacuauaugcccagcaugaaaagauuucgcaaggaagaggaaucugagggagcgauuugguga

SEQ ID NO: 20811 - RNA, 9873 nt, Artificial Sequence
  derived and/or modified CDS sequence (opt5) from DENV-3__GQ868586__SS-prME
acaagccucugccucaugaugauccugcccgccgcucuugccuuccaccugacaucccgggacggcgaaccucggaugauuguggggaagaacgaacgcggaaagucucuccuguuuaagacggcgagcggcaucaauauguguacccuuauugcuauggaucugggggagaugugcgacgauacagugaccuacaaguguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggauuacaagggagaggacguucccuguaaaauuccuuucagcaccgaagauggccaagggaaggcccauaacggaagacugaucacagcgaaucccguggucaccaaaaaggaggagcccgugaacauugaagcugagccuccguucggcgaauccaauaucgugauugggaucggcgacaacgcccugaaaaucaauugguauaagaagggaucuagcauuggcaaaauguuugaggccacggcuagaggggccagacgcauggcuauccuuggagauacagccugggacuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugauacagggugugucaucaauuggaaaggaaaggaacugaagugcggcagcgggauuuucgugacgaacgagguucauaccuggacagagcaguacaaauuucaagccgacucccccaagcggcuggcgaccgccaucgcuggcgccugggaaaauggaguguguggcauuagaagcacaacccgcauggagaaccuucucuggaaacagaucgcuaaugaacugaacuauauccugugggagaauaacauuaagcucacggucgugguuggggauaucauuggagugcuggaacagggcaaacggacccuuacaccucagcccauggagcugaaguacucuuggaaaaccugggggaaggccaagaucgucacagccgagacccaaaacuccagcuucauuaucgacggaccuaauacacccgaaugcccgucugcuuccagagcguggaacgugugggagguggaagacuauggcuuuggcgucuucaccacgaauaucuggcucaaacugcgcgagguuuacacacagcagugugaucaccggcugaugagcgccgcugugaaggacgaaagagccgugcacgccgauaugggguacuggauugagucccagaaaaacggaucuuggaaacuugagaaagcuagccucaucgaagucaagaccugcaccuggccuaagucccauacacuguggucuaauggcgugcuggagagcgacaugauuauccccaaaucccucgccgggccuauuagccaacacaacuaucgccccggauaccauacccagacggcgggcccuuggcaccuggggaaacuugaacuggauuuuaauuauugcgagggaacaaccguugugaucacagagaacuguggcacccggggccccucucucagaacaaccacggucuccgggaaacugauccacgaauggugcugucgcagcugcacccugccgccucuucgguacaugggagaggacggcuguugguaugggauggaaauuagacccaucucugagaaggaagagaauauggugaaaucccucguuagcgcuggaucuggcgagguggauaacuucacaauggggguccugugccuggccauucucuuugaagaggugaugcggggaaaguucggcaagaaacauaugaucgccggcguuuucuuuaccuucgugcugcuucugagcgggcagauuacauggcgcgacauggcucacacccucaucaugauuggauccaaugccagcgauagaaugggcaugggggucacguaccuggcgcugaucgcuacauuuaagauccaacccuuccuugcccugggauuuuuccuccggaaacugaccucuagagaaaaccuccugcuuggcguggggcuggccauggcuacaacccuccagcugccugaggacauugaacagauggccaauggaaucgcucugggccuuauggcccugaagcucauuacccaguuugagacauaucaacuguggacggcgcucaucucccugaccuguagcaacacaauuuucacccuuacaguggccuggcgcaccgcuacgcugauccucgccggcgucucccugcugccgguuugccagucuagcuccaugcggaaaacagauuggcuucccaugaccguggcugccaugggggugccuccccugccucucuuuaucuucucucugaaggacacccucaagagacgcagcuggccccugaaugagggagucauggccgugggccuuguuuccauucuggcuucuagccugcucagaaacgaugugccuauggcggggccccuggucgccggaggccuucugaucgcuuguuacgugauuacagggaccuccgccgaccucacaguugaaaaagccgcugacgugacgugggaggaagaggccgaacagaccggagucagccauaaccugaugaucacaguggaugacgauggcaccaugcggauuaaggacgaugagacagagaauauccucaccguccugcuuaaaacggcgcugcugaucgugucuggcauuuuuccguacuccaucccugcuacccuccugguuuggcacacauggcagaagcaaacccagcgcagcggggugcuuugggacguccccucuccucccgaaacacagaaagccgagcuggaagagggaguguauagaauuaagcagcaaggcaucuucgggaaaacccagguuggagugggcguccagaaggaggggguguuucauacaauguggcacgugacgcggggagccguucucaccuacaacggcaagcgccuggaaccgaauugggcuuccgucaaaaaggaucucauuagcuauggcgggggauggagacugucugcccaauggcagaaaggcgaggaaguccaggugaucgcggucgagccugggaagaaccccaaaaauuuccagacaaugccuggaaccuuccaaaccacaacgggcgaaauuggggcuaucgcccuugacuuuaagcccggaaccuccggcagccccaucauuaaccgggagggcaaggugguugggcuguacggaaauggcguggucaccaagaacgggggauauguguccggcaucgcccagaccaaugcugagccugaugggccgacacccgaacuggaggaagagauguucaagaaacgcaaccucaccauuauggaccugcacccuggcagcggaaagacgagaaaauaccuucccgccaucguucgggaagcuauuaagcgcagacugcggacacucauccuggccccuaccagaguggucgcggccgagauggaggaagcucucaagggccugcccauccgcuaucagaccacagccaccaaaucugagcauacagggcgggaaauuguggaucuuaugugccacgcuaccuuuacgaugagacugcugagcccuguucgcgugccgaauuacaaccucaucauuauggacgaggcccauuucacagaucccgccuccaucgcugcgcggggauacauuucuaccagagucggcaugggggaagccgcugccaucuuuaugacagccaccccucccggaacggcugacgccuucccucagagcaaugcgcccauccaagacgaggagcgcgauauuccggaacgguccuggaacucuggcaaugaguggaucaccgacuuugcugggaagacagugugguucgugccuagcauuaaagccggcaacgauaucgccaacugucugagaaagaauggcaaaaaggucauucagcuuucccgcaagaccuuugacacagaauaucagaaaaccaagcugaacgauugggacuucguugugacaaccgauaucucugagaugggagcuaauuuuaaagccgaccgggugauugaucccagacggugccucaagcccgucauccugacggacgggccugagcgcgugauccuggcgggacccaugccuguuacagccgcuagcgccgcucagagacggggccgcguggggagaaacccgcaaaaagaaaaugaucaguacauuuucaccggacagccccucaacaaugacgaggaccacgcccauuggaccgaagcuaagaugcuucuggauaacaucaauacaccugagggcauuauccccgcccuguucgaaccugagcgggagaaguccgcggccauugacggggaauauagacucaaaggcgagagccgcaagaccuuugucgaacugaugcggagaggagaucuucccguguggcuggcucacaaaguugccucugagggcaucaaguacacagaccgcaaauggugcuucgaugggcagcggaacaaucaaauccucgaagagaacauggacguggagauuuggacgaaggaaggagagaaaaagaagcugagaccgcgcuggcuggaugcucggaccuauuccgacccucucgcccuuaaagaauuuaaggauuucgccgcuggcagaaaaagcaucgcgcuggaccuggucacagagauugggcgcgugcccucucaccucgcccauagaacccggaaugcucuggauaaccuugucaugcugcacacauccgaacauggaggcaaggccuaccgccacgccguggaggagcucccugaaaccauggagacgcugcugcuccuuggccugaugauccugcucaccgggggagcuaugcuguuucuuauuagcggcaaagggaucggaaagacauccaucggccugauuuguguuaucgccucuagcgggaugcucuggauggcggaaauuccccugcaguggaucgccuccgcuauugugcuggaguucuuuaugauggugcuccuuaucccugagcccgaaaagcagagaaccccgcaagacaaucagcuggccuaugucguuauuggaauccugacacucgcugccaucauugcggccaacgagaugggccugcuugaaaccacgaaacgggaucugggcaugagcaaggagccugggguggugucucccacauccuaccucgacgucgaccugcaccccgcuagcgccuggacccuguacgcuguggccacaaccguuaucaccccuaugcuccgccauacaauugaaaauucuacggcuaacgugagccuugccgcgaucgccaaccaggcugucgugcugaugggacuggauaaaggcuggccgauuuccaagauggaccucggggucccccugcuugcccugggaugcuauucucaggugaauccucucacccugacagcugccguucugcuccuuaucacccacuacgccaucauuggccccgggcugcaagcgaaagcuacaagagaggcccagaagcggaccgcugccggaaucaugaagaacccuacgguggauggcauuaugacaaucgaccuggaucccgucauuuaugacagcaaauucgagaagcagcucggccaggugaugcugcuuguucugugugccgugcaacuccugcugaugagaaccuccugggcucucugcgaagcccuuacccuggcgacagggccuaucaccacacugugggagggaucuccgggcaaauuuuggaauacgaccaucgccgucagcauggcuaacauuuuccgcggguccuaccucgccggagcuggccuggccuuuagcaucaugaagucuguggggacaggaaaacggggcaccggcucccagggggaaacacuuggagagaaguggaagaaaaagcugaaucagcucagcagaaaagaguucgaucuguauaagaaauccggcauuaccgagguggaccgcacggaggcgaaggaagggcugaaacggggagagguuacccaucacgccgucucuagaggcagcgcuaagcuccagugguuuguggaacggaacauggugauccccgaggggcgcgucauugaucuuggauguggcagaggcgggugguccuacuauugcgccggacugaagaaaguuacagaagugcggggcuacaccaaagggggaccuggccaugaggagcccgugccuaugucuacauacggguggaauaucgucaaacugaugagcggaaaggacguguucuaucugcccccggaaaaaugugauacccugcuuugcgacauuggcgaguccagcccuucucccacaguugaagagucccgcaccaucagagugcugaagauggucgagcccuggcucaagaacaaucaauucuguaucaaagugcugaacccuuacaugcccacgguuauugaacaccuggagcggcuccagcgcaagcacggcgggaugcuugugagaaauccucugagccggaacucuacacaugaaauguauuggaucuccaauggaaccggcaacauugucgcuagcgugaauauggugucucgccugcuccugaacagauuuaccaugacacaccggagaccgacgaucgagaaagaugucgaccuuggggccggaacccgccauguuaacgcugaacccgagacaccuaauauggacgugauuggcgagcggaucaagagaaucaaagaagaacacaacagcaccuggcacuacgaugacgaaaaucccuauaagacaugggccuaccauggguccuaugaggugaaggcgaccggaucugccagcuccaugauuaacggcgucgugaaacugcucacaaagccuugggauguugugcccauggucacccagauggcuaugacggacaccacaccguucggccaacagcgcguguuuaaagaaaagguugauacccggacaccuagaagcaugcccgggacccgccgggugaugggaaucacggccgaguggcuguggagaacacugggccgcaauaaaaagccucggcucugcaccagagaggaguucacaaagaaaguccgcaccaacgcugccaugggggccguguuuacggaggaaaaucagugggacuccgcgaaggcugccguugaggaugaagacuucuggaaacugguggagcgggagagagaacuucacaagcugggaaaauguggcucuugcgucuacaacaugauggggaagcgcgagaaaaagcucggcgaauuuggaaaggccaaaggcagcagagcuauuugguacauguggcugggggcccgguaucuugaguucgaggcucugggauuucucaaugaagaucauugguucucccgcgagaacucuuacagcggcguggaaggggagggacugcacaagcugggcuauauccucagagacauuuccaaaauccccgggggcgccauguacgcggaugacaccgccggaugggacacacggaucaccgaagaugaccugcauaaugaggagaagauuacacagcaaauggauccugaacacaaacagcuugcuaacgccaucuuuaagcugaccuaucagaauaaggucgugaaaguucagagacccacaccgaccggcacggugauggacauuaucucucggaaggaucaacgcgggagcggacaggucggcacauacgggcucaacaccuucaccaauauggaggcucagcugauuagacagauggaaggagagggcgugcuuuccaaagccgaccuggaaaacccucaccuccccgagaagaaaaucacacaauggcuggagaccaaggggguggaacggcugaagcgcauggcgaucagcggcgaugacugcguugugaaacccauugaugacagauuugccaacgcucuccuggcccuuaaugauaugggaaagguccggaaagacaucccucaguggcagccgucuaagggcuggcaugauuggcagcaagugcccuucuguucccaccauuuccacgagcugauuaugaaagacgggcgcaagcucguugugccuugcagaccccaggacgaacugaucggacgggcucgcauuagccagggcgccggguggucucuuagagagacagcuugucuggccaaggcguaugcccaaauguggucccucauguacuuucaccggcgcgaucugagacuggcuagcaacgccaucugcucugccgucccugugcauuggguccccacgucccggaccacauggagcauucacgcucaucaccaguggaugaccacagaagacaugcucaccguguggaaucgcguuuggaucgaggauaacccuuggauggaggacaaaacgcccgugaccacaugggaaaaugucccguaccugggaaagagagaggaucagugguguggcucccuuaucgggcugaccagccgggccacaugggcgcagaacauuccuaccgcuauccaacaggugagaucucucauuggcaaugaagaguuccuggacuauaugcccagcaugaaacgcuuucggaaggaggaagaguccgaaggagccaucugguga

SEQ ID NO: 20812 - RNA, 9873 nt, Artificial Sequence
  derived and/or modified CDS sequence (opt5) from DENV-3__FJ850110__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcucggggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacacagggugugucaucaauuggaaaggaaaggagcugaagugcggcagcgggauuuucgugacgaacgagguucauaccuggacagaacaguacaaauuucaagccgauucccccaagcggcuggcgaccgccaucgcuggcgccugggagaauggaguguguggcauuagaagcacaacccgcauggaaaaccuucucuggaaacagaucgcuaaugagcugaacuauauccugugggaaaauaacauuaagcucacggucgugguuggggacaucauuggagugcuggagcagggcaaacggacccuuacaccucagcccauggagcugaaguacucuuggaaaaccugggggaaggccagaaucgucacagccgaaacccaaaacuccagcuucauuaucgauggaccuaauacacccgagugcccgaacaccucucgcgcuuggaaugugugggaaguggaggacuauggcuuuggcgucuucacgacaaacaucuggcucaagcugcgggaaguuuacacccagcugugugaccacagacuuauguccgcggccgugaaagaugagcgcgcugugcacgccgacaugggguacuggauugagagccagaagaauggauccuggaaacucgaaaaggccucucugaucgaggucaaaaccugcacauggccuaagagccauacccugugguccaacggcgugcucgaaucugauaugauuauccccaagagccuggcugggccuauuucccagcacaauuaucggcccggauaccauacgcaaacagccggcccuuggcaccuugggaaacuggagcucgacuuuaacuauugcgagggaaccacaguugugaucaccgaaaauuguggcacaagaggccccagccugcgcaccacgaccgucucugggaagcugauccacgaguggugcugucgguccugcacacuuccgccucucagauacaugggagaagauggcuguugguaugggauggagauucggcccaucaacgaaaaagaggagaauauggugaagagccugguuucugcgggauccggcgaaguggacaacuucaccauggggguccugugccucgcuauucuguuugaggaagugaugcgcggaaaauucggcaagaagcauaugaucgccggcguuuucuuuacauucgugcuucugcucagcgggcagauuaccuggagagauauggcccacacgcugaucaugauuggaucuaaugcuacagaccggaugggcaugggggucaccuaccuggcccuuaucgcgacauuuaaaauccagcccuuccuggcucucggauuuuuccugagaaagcucaccagccgcgagaaccugcuucugggcguggggcucgccauggccaccacacugcaacugccugaagauauugagcagauggcuaauggaaucgcccuuggccugauggcucucaaacugauuacgcaguuugagaccuaucagcucuggacagcccugaucucccuuaccuguagcaacacaauuuucacccugacgguggcguggcggacagccacccucauccuggcuggcgucucucugcuuccgguuugccaauccagcuccaugagaaagaccgacuggcugcccaugacaguggccgcuaugggggugccuccccucccucuguuuaucuucucucucaaagauacccugaagcgcagaagcuggccccuuaacgaaggagucauggccgugggccugguuuccauucuggccucuagccuccugcggaaugacgugccuauggcugggccccuugucgcgggaggccugcucaucgccuguuacgugauuacagggacguccgcugaucugaccguugagaaggccgccgacgugacaugggaagaggaagcugagcagaccggagucucucauaaccucaugaucacaguggacgaugacggcaccaugcgcauuaaagaugacgagacggaaaauauccugaccguccuucugaagacagcccugcucaucgugagcggcauuuuuccguacuccaucccugcgacccugcuuguuuggcacacauggcagaaacagacccaaagaagcggggugcugugggauguccccucuccucccgagacacagaaggcugaacucgaggagggaguguaucggauuaaacagcagggcaucuucgggaagacgcaaguuggagugggcguccagaaagaagggguguuucauaccauguggcacgugacacgcggagccguucugaccuacaacggcaagagacucgagccgaauugggccuccgucaagaaagaccugauuagcuauggcgggggauggcggcuuucugcucaguggcaaaagggcgaagaggugcaggugaucgccgucgaaccugggaaaaaccccaagaauuuccagaccaugccuggaacauuccagacgaccacaggcgagauuggggcgaucgcucuggauuuuaaacccggaaccuccggcagccccaucauuaaccgcgagggcaaggugguugggcuguacggaaauggcguggucacaaagaacgggggauaugugucuggcaucgcccaaaccaaugccgaaccugacgggccgacgcccgagcucgaagaggaaauguucaaaaagagaaaccugacaauuauggaucuucacccuggcuccggaaaaacccggaaguaccugcccgcuaucguucgcgaggccauuaaaagacggcucagaacccugauccucgcuccuacacgcguggucgccgcggagauggaagaggcccugaagggccuucccauccgguaucagaccacagcuaccaagagcgaacauacggggagagagauuguggaccugaugugccacgccacauuuaccaugcgccugcucuccccuguucgggugccgaauuacaaccugaucauuauggaugaagcucauuucacagaccccgccagcaucgccgcuagaggauacauuucuacccgcgucggcaugggggaggcggccgcuaucuuuaugacggccaccccucccggaacagccgaugcuuucccucagagcaaugcccccauccaggacgaggaacgggacauuccggagagauccuggaacucuggcaacgaauggaucaccgauuuugcggggaaaacagugugguucgugccuagcauuaaggcuggcaaugacaucgccaacugucuucgcaaaaauggaaagaaagucauucaacugucccggaagaccuuugauacagaguaucagaagaccaaacucaacgacugggauuucguugugacgacagacaucucugagaugggcgccaauuuuaaggcugauagagugauugacccccggcgcugccugaaacccgucauccugaccgaugggccugaaagagugauccucgccggacccaugccuguuaccgcggccagcgcugcccagcggcgcggcagaguggggcggaacccgcagaaggagaaugaccaauacauuuucacaggacagccccuuaacaaugaugaagaccacgcucauuggaccgaggccaaaaugcugcuggacaacaucaauacaccugaaggcauuauccccgcucucuucgagccugagagagaaaaguccgccgcgauugauggggaguaucgccugaagggcgaaucucggaaaacguuugucgagcuuaugagacgcggagaccugcccguguggcucgcccacaagguugcuagcgaaggcaucaaauacaccgaucggaaguggugcuucgacgggcagagaaacaaucagauccuggaggagaacauggauguggaaauuuggacaaaagagggagaaaagaaaaagcugcgcccgcgguggcucgacgccagaaccuauuccgauccucuugcucugaaggaguuuaaagacuucgccgccggccgcaagagcaucgcucuggaucucgucacagaaauugggagagugcccacccaccuggcgcaucggacgcgcaaugcccuugacaaccuggucaugcuccacaccucugagcauggaggcaaagcuuacagacacgccguggaggaacugccugagacaauggaaacccugcuccuucugggccugaugauccuccugacagggggagccaugcuuuuucugauuuccggcaaggggaucggaaaaaccagcaucggccucauuuguguuaucgcuucuuccgggaugcuguggauggccgagauuccccugcaauggaucgcgagcgccauugugcucgaguucuuuaugauggugcuucugaucccugaacccgagaagcagcggacgccgcaggauaaucaacuggcuuaugucguuauuggaauccucacacuggccgcuaucauugccgcgaacgaaaugggccuucuggagaccacaaagcgcgaccucggcauguccaaagaaccugggguggugucucccaccagcuaccuggaugucgaccugcaccccgccuccgcuuggacccucuacgccguggcuacaacgguuaucaccccuaugcuuagacauacaauugagaacagcaccgccaaugugucucuggcugccaucgcgaaccaggccgucgugcugaugggacucgacaagggcuggccgauuuccaaaauggaucugggggucccccuucuggcucucggaugcuauagccaggugaauccucugacacugaccgccgcuguucuccuucugaucacgcacuacgccaucauuggccccgggcugcaggccaaggcgacacgggaggcucaaaaaagaaccgccgcuggaaucaugaagaacccuaccguggacggcauuaugacaaucgaucucgaccccgucauuuaugauucuaaguucgaaaaacagcugggccaggugaugcuucugguucucugugccgugcagcugcugcucaugcgcaccagcugggcccuuugcgaggcucugacacuggccacggggccuaucaccacacucugggaaggauccccgggcaaguuuuggaauaccacaaucgcggucucuauggccaacauuuuccgggggagcuaccuggcuggagccggccuugcuuuuuccaucaugaaaucuguggggaccggaaagagaggcacgggcagccaaggggagacccugggagaaaaauggaagaagaaacucaaucagcugucccgcaaggaguucgaccuguauaaaaagagcggcauuacagagguggaucggaccgaagccaaagaggggcucaagagaggagaaaucacacaucacgcgguuucucggggcuccgccaaacuucagugguuugucgagcgcaacauggugauucccgaagggagagugaucgaccugggauguggccggggcggguggagcuacuauugcgcuggacugaagaaggucaccgagguucgcggcuacacaaaagggggaccuggccaugaggaacccgugccuauguccaccuacggguggaauauugugaagcucaugucuggaaaagaugucuucuaucugcccccggagaagugugacacgcuucugugcgauaucggcgaaagcuccccuucucccacaguggaggagagcagaaccauccggguucucaaaaugguggaacccuggcugaagaacaaucaguucuguauuaagguccugaacccuuacaugcccgccgugaucgagcaccucgaacgccuucaaagaaaacacggcgggaugcugguucggaauccucugucccgcaacagcacccaugagauguauuggauuucuaauggaacaggcaacaucguggcuuccgucaacauggugagcagacuccugcuuaaucgguuuacgaugacccacagacgcccgacaauugaaaaggacguggaucugggggccggaacccggcaugucaacgcugagcccgagacaccuaauauggacguuaucggcgaaagaaucaaacgcauuaaggaggaacacaacucuaccuggcacuacgacgaugagaaucccuauaaaacaugggccuaccauggguccuaugaagugaaggcgaccggaagcgccucuagcaugaucaacggcguggucaagcuccugacgaaaccuugggacgugguucccauggugacccagauggcuaugacagauaccacaccguucggccagcaacgggucuuuaaggagaaaguggacaccagaacgccucgcuccaugcccgggacacggagaguuauggagauuaccgccgaauggcuguggcgcacacucggacggaauaagaaaccuagacugugcacccgcgaggaauucacgaagaaggugcggaccaacgcugccaugggcgccgucuuuacagaggaaaaucagugggauucugcgaaagcugccguggaggacgaggauuucuggaagcuuguugacagagaacgcgagcugcacaaacucgggaaguguggaagcugcguguacaacaugaugggcaaaagagaaaagaaacugggggaguuuggcaaggccaagggaucccgggcuaucugguacauguggcuuggcgcccgcuaucuggaguucgaagcucucggguuucugaaugaggaucauugguucagcagagaaaacuccuacucuggagucgagggcgaagggcugcacaaacucggauauauucugcgggacaucagcaagauccccggcggggccauguacgcggaugacaccgccggcugggacacaagaauuaccgaggaugaccuucauaaugaggaaaaaaucacacagcagauggauccugagcaccggcaacuggcuaacgccauuuuuaagcucaccuaucagaauaaaguggucaaggugcagcgccccacgccgacaggaaccguuauggacaucauuuccagaaaggaucagcggggcucugggcaagugggaaccuacggccugaacacauucaccaacauggaagcucagcuuauccgccagauggagggggaaggaguccugagcaaagccgaccucgagaauccucaccugcccgagaagaaaaucacacaguggcuggaaacgaagggcguggagagacucaaacggauggcgauuuccggggaugacugcgugguuaagcccaucgaugaccgcuuugccaacgcucugcuugcccugaaugauaugggcaaggugagaaaagacauuccucaauggcagccgucuaagggauggcaugauuggcagcagguccccuucuguagccaccauuuccacgaacucaucaugaaagacggccggaagcuggugguuccuugccgcccccaagacgagcuuauugggagagcucggaucucccagggagccggcuggagccugcgcgaaaccgcuugucucgggaaagccuaugcgcagauguggucucugauguacuuucacagacgggaucugcgccucgccuccaacgcuauuugcagcgccgugccuguccauugggugcccacaucuagaaccacaugguccauccacgcccaucaccaauggaugaccacggaggacaugcugaccgucuggaaucggguguggaucgaggauaacccuuggauggaagacaagacacccguuaccacaugggagaaugugccguaccuuggaaagagagaagaucagugguguggcagccugauugggcucaccucucgcgcuacgugggcccagaacaucccuacagcgauucagcaaguccggucccugaucggcaaugaggaguuccuugacuauaugcccagcaugaaaagauuucgcaaggaagaggaauccgagggagcuauuugguga

SEQ ID NO: 20813 - RNA, 9873 nt, Artificial Sequence
  derived and/or modified CDS sequence (opt5) from DENV-3__FJ850111__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacucucugaaaaucaauugguauaagaagggaagcuccauuggcaaaauguuugaagccacggcccggggggcuagacgcauggccauccuuggagacacagcuugggauuucggcagcguugggggaguccucaacucucugggcaagauggugcaccagauuuuuggguccgccuacaccgcgcuguucagcggcgugucuugggucaugaaaaucggaauuggcgugcuccugaccuggaucgggcuuaauagcaagaacacauccaugucuuuuagcugcauugccaucggaaucauuacccuguaucucggcgcuguugugcaggccgacacagggugugucaucaauuggaaaggaaaggagcugaagugcggcuccgggauuuucgugacgaacgagguucauaccuggacagaacaguacaaauuucaagcugauagccccaagcggcuggccaccgcgaucgccggcgcuugggagaauggaguguguggcauuagaucuacaacccgcauggaaaaccuucucuggaaacagaucgccaaugagcugaacuauauccugugggaaaauaacauuaagcucacggucgugguuggggacaucauuggagugcuggagcagggcaaacggacccuuacaccucagcccauggagcugaaguacuccuggaaaaccugggggaaggcuagaaucgucacagccgaaacccaaaacagcucuuucauuaucgauggaccuaauacacccgagugcccgaacaccucccgcgccuggaaugugugggaaguggaggacuauggcuuuggcgucuucacgacaaacaucuggcucaagcugcgggaaguuuacacccagcugugugaccacagacuuaugagcgcugcggugaaagaugagcgcgccgugcacgcugacaugggguacuggauugagucccagaagaauggaucuuggaaacucgaaaaggccagccugaucgaggucaaaaccugcacauggccuaagucccauacccuguggucuaacggcgugcucgaaagcgauaugauuauccccaagucccuggccgggccuauuagccagcacaauuaucggcccggauaccauacgcaaacagcuggcccuuggcaccuugggaaacuggagcucgacuuuaacuauugcgagggaaccacaguugugaucaccgaaaauuguggcacaagaggccccucucugcgcaccacgaccgucuccgggaagcugauccacgaguggugcugucggagcugcacacuuccgccucucagauacaugggagaagauggcuguugguaugggauggagauucggcccaucucugaaaaagaggagaacauggugaagucccugguuagcgccggaucuggcgaaguggacaauuucaccauggggguccugugccucgcgauucuguuugaggaagugaugcgcggaaaauucggcaagaagcauaugaucgcuggcguuuucuuuacauucgugcuucugcucagcgggcagauuaccuggagagauauggcccacacgcugaucaugauuggauccaacgccacagaccggaugggcaugggggucaccuaccuggcucuuaucgccacauuuaaaauccagcccuuccuggcgcucggauuuuuccugagaaagcucaccagccgcgagaaucugcuucugggcguggggcucgcuauggccaccacacugcaacugccugaagauauugagcagauggccaacggaaucgcucuuggccugauggcccucaaacugauuacgcaguuugagaccuaucagcucuggacagcucugaucucucuuaccuguuccaauacaauuuucacccugacgguggccuggcggacagcgacccucauccuggccggcgucagccugcuuccgguuugccaauccucuagcaugagaaagaccgacuggcugcccaugacaguggcugccaugggggugccuccccucccucuguuuaucuucucccucaaagauacccugaagcgcagaucuuggccccuuaacgaaggagucauggcugugggccugguuagcauucuggccuccucucuccugcggaacgacgugccuauggccgggccccuugucgcuggaggccugcucaucgcguguuacgugauuacagggacgagcgccgaucugaccguugagaaggcugccgacgugacaugggaagaggaagccgagcagaccggagucucccauaaucucaugaucacaguggacgaugacggcaccaugcgcauuaaagaugacgagacggaaaacauccugaccguccuucugaagacagcucugcucaucgugagcggcauuuuuccguacucuaucccugccacccugcuuguuuggcacacauggcagaaacagacccaaagauccggggugcugugggauguccccagcccucccgagacacagaaggcggaacucgaggagggaguguaucggauuaaacagcagggcaucuucgggaagacgcaaguuggagugggcguccagaaagaagggguguuucauaccauguggcacgugacacgcggagcuguucugaccuacaauggcaagagacucgagccgaacugggccucugucaagaaagaccugauuuccuauggcgggggauggcggcuuagcgcccaguggcaaaagggcgaagaggugcaggugaucgcugucgaaccugggaaaaaucccaagaacuuccagaccaugccuggaacauuccagacgaccacaggcgagauuggggccaucgcgcuggauuuuaaacccggaaccucuggcucccccaucauuaaucgcgagggcaaggugguugggcuguacggaaacggcguggucacaaagaaugggggauaugugagcggcaucgcucaaaccaacgccgaaccugacgggccgacgcccgagcucgaagaggaaauguucaaaaagagaaaucugacaauuauggaucuucacccuggcuccggaaaaacccggaaguaccugcccgccaucguucgcgaggcuauuaaaagacggcucagaacccugauccucgccccuacacgcguggucgcugccgagauggaagaggcgcugaagggccuucccauccgguaucagaccacagccaccaagagcgaacauacggggagagagauuguggaccugaugugccacgcuacauuuaccaugcgccugcucucuccuguucgggugccgaacuacaaucugaucauuauggaugaagcccauuucacagaccccgcuagcaucgccgccagaggauacauuuccacccgcgucggcaugggggaggcugcggccaucuuuaugacggcuaccccucccggaacagccgaugccuucccucagucuaacgcucccauccaggacgaggaacgggacauuccggagagaagcuggaauuccggcaacgaauggaucaccgauuuugccgggaaaacagugugguucgugccuucuauuaaggcgggcaacgacaucgcuaauugucuucgcaaaaacggaaagaaagucauucaacugagccggaagaccuuugauacagaguaucagaagaccaaacucaaugacugggauuucguugugacgacagacaucuccgagaugggcgccaacuuuaaggccgauagagugauugacccccggcgcugccugaaacccgucauccugaccgaugggccugaaagagugauccucgcuggacccaugccuguuaccgccgcgucugccgcucagcggcgcggcagaguggggcggaauccgcagaaggagaacgaccaauacauuuucacaggacagccccuuaauaacgaugaagaccacgcccauuggaccgaggcuaaaaugcugcuggacaauaucaacacaccugaaggcauuauccccgcccucuucgagccugagagagaaaagagcgcugccauugauggggaguaucgccugaagggcgaaucccggaaaacguuugucgagcuuaugagacgcggagaccugcccguguggcucgcgcacaagguugccagcgaaggcaucaaauacaccgaucggaaguggugcuucgacgggcagagaaauaaccagauccuggaggagaauauggauguggaaauuuggacaaaagagggagaaaagaaaaagcugcgcccgcgguggcucgacgcuagaaccuauucugauccucuugcccugaaggaguuuaaagacuucgcugccggccgcaaguccaucgcccuggaucucgucacagaaauugggagagugcccacccaccuggcucaucggacgcgcaacgcgcuugacaaucuggucaugcuccacaccagcgagcauggaggcaaagccuacagacacgcuguggaggaacugccugagacaauggaaacccugcuccuucugggccugaugauccuccugacagggggagccaugcuuuuucugauuucuggcaaggggaucggaaaaaccuccaucggccucauuuguguuaucgccagcuccgggaugcuguggauggcugagauuccccugcaauggaucgccucugcgauugugcucgaguucuuuaugauggugcuucugaucccugaacccgagaagcagcggacgccgcaggauaaccaacuggccuaugucguuauuggaauccucacacuggcugccaucauugcugccaaugaaaugggccuucuggagaccacaaagcgcgaccucggcaugagcaaagaaccugggguggugucccccaccagcuaccuggaugucgaccugcaccccgcgucugccuggacccucuacgcuguggccacaacgguuaucaccccuaugcuuagacauacaauugagaacuccaccgcuaacgugagccuggccgcuaucgccaaucaggcggucgugcugaugggacucgacaagggcuggccgauuucuaaaauggaucugggggucccccuucuggcccucggaugcuauagccaggugaacccucugacacugaccgcugccguucuccuucugaucacgcacuacgcuaucauuggccccgggcugcaggccaaggccacacgggaggcgcaaaaaagaaccgcugccggaaucaugaagaauccuaccguggacggcauuaugacaaucgaucucgaccccgucauuuaugauuccaaguucgaaaaacagcugggccaggugaugcuucugguucucugugcugugcagcugcugcucaugcgcaccucuugggcccuuugcgaggcccugacacuggcuacggggccuaucaccacacucugggaaggaagcccgggcaaguuuuggaacaccacaaucgccgucuccauggcgaauauuuuccgggggucuuaccuggccggagcuggccuugccuuuagcaucaugaaauccguggggaccggaaagagaggcacgggcagccaaggggagacccugggagaaaaauggaagaagaaacucaaccagcugucucgcaaggaguucgaccuguauaaaaaguccggcauuacagagguggaucggaccgaagcuaaagaggggcucaagagaggagaaaucacacaucacgccguuagccggggcuccgcgaaacuucagugguuugucgagcgcaauauggugauucccgaagggagagugaucgaccugggauguggccggggcggguggucuuacuauugcgccggacugaagaaggucaccgagguucgcggcuacacaaaagggggaccuggccaugaggaacccgugccuaugagcaccuacggguggaacauugugaagcucauguccggaaaagaugucuucuaucugcccccggagaagugugacacgcuucugugcgauaucggcgaaucuagcccuucccccacaguggaggagagcagaaccauccggguucucaaaaugguggaacccuggcugaagaauaaccaguucuguauuaagguccugaauccuuacaugcccgcugugaucgagcaccucgaacgccuucaaagaaaacacggcgggaugcugguucggaacccucugucucgcaauuccacccaugagauguauuggauuagcaacggaacaggcaauaucguggccucugucaacaugguguccagacuccugcuuaaccgguuuacgaugacccacagacgcccgacaauugaaaaggacguggaucugggggcuggaacccggcaugucaaugccgagcccgagacaccuaacauggacguuaucggcgaaagaaucaaacgcauuaaggaggaacacaauagcaccuggcacuacgacgaugagaaccccuauaaaacaugggcuuaccaugggucuuaugaagugaaggccaccggaagcgcguccucuaugaucaauggcguggucaagcuccugacgaaaccuugggacgugguucccauggugauucagauggccaugaccgauacaaccccguucggccagcaacgggucuuuaaggagaaaguggacacaagaaccccucgcagcaugcccgggacgcggagaguuauggagaucacagcugaauggcuguggcgcacccucggacggaacaagaaaccuagacugugcacacgcgaggaauucaccaagaaggugcggacgaaugccgcuaugggcgccgucuuuaccgaggaaaaccagugggauuccgccaaagcggcuguggaggacgaggauuucuggaagcuuguugacagagaacgcgagcugcacaaacucgggaaguguggaagcugcguguacaauaugaugggcaaaagagaaaagaaacugggggaguuuggcaaggccaagggaucccgggccauuugguacauguggcuuggcgcucgcuaucuggaguucgaagcccucggguuucugaacgaggaucauugguucucuagagaaaauagcuacuccggagucgagggcgaagggcugcacaaacucggauauauccugcgggacaucucuaagauucccggcggggcuauguacgccgaugacacagcgggcugggacaccagaaucacagaggaugaccuucauaacgaggaaaaaauuacccagcagauggauccugagcaccggcaacuggccaaugcuaucuuuaagcucacauaucagaacaaaguggucaaggugcagcgccccaccccgacgggaacaguuauggacauuaucagcagaaaggaucagcggggcuccgggcaagugggaaccuacggccugaauaccuucacaaacauggaagcccagcuuauccgccagauggagggggaaggaguccugucuaaagcugaccucgagaacccucaccugcccgagaagaaaauuacccaguggcuggaaacaaagggcguggagagacucaaacggauggccaucagcggggaugacugcgugguuaagcccauugaugaccgcuuugcgaaugcccugcuugcucugaacgauaugggcaaggugagaaaagacaucccucaauggcagccguccaagggauggcaugauuggcagcagguccccuucuguagccaccauuuccacgaacucauuaugaaagacggccggaagcuggugguuccuugccgcccccaagacgagcuuaucgggagagcccggauuucucagggagcuggcuggucccugcgcgaaacggccugucucgggaaagcuuaugcccagauguggagccugauguacuuucacagacgggaucugcgccucgcgucuaaugccaucugcuccgcugugccuguccauugggugcccaccagcagaacaaccuggucuauccacgcccaucaccaauggaugacaaccgaggacaugcugacggucuggaaccggguguggauugaggauaauccuuggauggaagacaagacccccguuacaaccugggagaacgugccguaccuuggaaagagagaagaucagugguguggcucccugaucgggcucacaagccgcgccaccugggcucagaauauuccuacggccauccagcaaguccggucccugauuggcaacgaggaguuccuugacuauaugcccagcaugaaaagauuucgcaaggaagaggaaucugagggagcgaucugguga

SEQ ID NO: 20814 - RNA, 9873 nt, Artificial Sequence
  derived and/or modified CDS sequence (opt5) from DENV-3__KF955486__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucacccugcuuaugcuggugacaccuucuaugaccaugagauguguuggagugggcaaccgggacuuugucgaagggcucagcggagcuaccuggguggaugugguccuggagcacggcgggugcguuacaacgauggccaagaauaaacccacccuggacaucgagcuccagaagacagaagcuacccaacuggccacacuucgcaaacuguguauugagggaaagaucaccaacauuacgacagauuccagaugcccuacccagggcgaagcggugcucccggaggaacaggaccagaauuauguguguaaacacaccuacgucgaucggggcugggggaacggaugcggccuguucgggaagggaagccuugugacaugcgccaaguuucaaugucuggagcccaucgagggcaaaguugugcaguaugaaaaucucaaguacaccgucauuaucacagugcauacgggggaccagcaccagguuggaaacgagacccaaggcgugacagcugaaaucaccccucaggccucuacaaccgaggcuauucugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucagaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagauguucccuguaaaaucccuuucagcacagaggacggccaagggaaggcccauaacggaagacugauuaccgcgaaucccguggucacgaaaaaggaggaacccgugaacaucgaggcugaaccuccguucggcgaguccaauauugugaucgggauuggcgauaacgcccugaaaaucaauugguauaagaagggaucuagcaucggcaaaauguuugaagccacagcucggggggccagacgcauggcuauucuuggagacaccgccugggauuucggcuccguugggggaguccucaacagccugggcaagauggugcaccagaucuuugggucugcguacaccgcccuguucuccggcgugagcugggucaugaaaauuggaaucggcgugcuccugacauggauugggcuuaauucuaagaacaccagcauguccuuuucuugcaucgcuauuggaaucaucacacuguaucucggcgccguugugcaggcugacauggggugugucauuaauuggaaaggaaaggagcugaagugcggcagcgggaucuucgugacgaacgagguucauaccuggacagaacaguacaaauuucaagccgauucccccaagcggcuggcgaccgccauugcuggcgccugggagaauggaguguguggcaucagaagcacaacccgcauggaaaaccuucucuggaaacagauugcuaaugagcugaacuauauccugugggaaaauaacaucaagcucacggucgugguuggggacauuaucggagugcuggagcagggcaaacggacccuuacaccucagcccauggagcugaaguacucuuggaaaaccugggggaaggccaagauugucacagccgaaacccaaaacuccagcuucaucauugauggaccuaauacacccgagugcccgucugcuuccagagcguggaacgugugggaaguggaggacuauggcuuuggcgucuucaccacgaauaucuggcucaaacugcgcgaaguuuacacacagcugugugaccaccggcuuaugagcgccgcugugaaggaugagagagccgugcacgccgacaugggguacuggaucgagucccagaaaaacggaucuuggaagcucgaaaaagcuagccugauugaggucaagaccugcaccuggccuaagucccauacacuguggucuaauggcgugcucgaaagcgauaugaucauucccaaaucccuggccgggccuaucagccagcacaacuaucgccccggauaccauacccaaacggcgggcccuuggcaccuugggaagcuggagcucgacuuuaauuauugcgagggaacaaccguugugauuacagaaaacuguggcacccggggccccucucugagaacaaccacggucuccgggaaacugauccacgaguggugcugucgcagcugcacccuuccgccucuccgguacaugggagaagauggcuguugguaugggauggagaucagacccauuucugaaaaggaggagaauauggugaaaucccugguuagcgcuggaucuggcgaaguggacaacuucacaauggggguccugugccucgccauccuguuugaggaagugaugcggggaaaguucggcaagaaacauaugauugccggcguuuucuuuaccuucgugcuucugcucagcgggcagaucacauggcgcgauauggcucacacccugauuaugaucggauccaaugccagcgacagaaugggcaugggggucacguaccuggcgcuuauugcuacauuuaagauccagcccuuccuggcccucggauuuuuccugcggaaacucaccucuagagagaaccugcuucugggcguggggcucgccauggcuacaacccugcaacugccugaagauaucgagcagauggccaauggaauugcucuuggccugauggcccucaagcugaucacccaguuugagacauaucagcucuggacggcgcugauuucccuuaccuguagcaacacaaucuucacccugacaguggccuggcgcaccgcuacgcucauucuggccggcgucucccugcuuccgguuugccaaucuagcuccaugcggaaaacagacuggcugcccaugaccguggcugccaugggggugccuccccucccucuguuuaucuucucucucaaggauacccugaagagacgcagcuggccccuuaaugaaggagucauggccgugggccugguuuccauccuggcuucuagccuccugagaaacgacgugccuauggcggggccccuugucgccggaggccugcucauugcuuguuacgugaucacagggaccuccgccgaucugacaguugagaaagccgcugacgugacgugggaagaggaagccgagcagaccggagucagccauaaccucaugauuacaguggacgaugacggcaccaugcggaucaaggaugacgagacagaaaauauucugaccguccuucugaaaacggcgcugcucaucgugucuggcaucuuuccguacuccauuccugcuacccugcuuguuuggcacacauggcagaagcagacccaacgcagcggggugcugugggauguccccucuccucccgagacacagaaagccgaacucgaggagggaguguauagaaucaagcagcagggcauuuucgggaaaacccaaguuggagugggcguccagaaggaagggguguuucauacaauguggcacgugacgcggggagccguucugaccuacaacggcaagcgccucgagccgaauugggcuuccgucaaaaaggaccugaucagcuauggcgggggauggagacuuucugcccaguggcaaaaaggcgaagaggugcaggugauugcggucgaaccugggaagaaccccaaaaauuuccagacaaugccuggaaccuuccagaccacaacgggcgagaucggggcuauugcccuggauuuuaagcccggaaccuccggcagccccaucaucaaccgggagggcaaggugguugggcuguacggaaauggcguggucacaaaaaacgggggauauguguccggcauugcccaaaccaaugcugaaccugacgggccgacacccgagcucgaagaggaaauguucaagaaacgcaaccugaccaucauggaucuucacccuggcagcggaaagacgagaaaauaccugcccgccauuguucgggaggcuaucaagcgcagacuccggacacugauucucgccccuaccagaguggucgcggccgagauggaagaggcucugaagggccuucccauccgcuaucagaccacagccaccaaaucugaacauacagggcgggagaucguggaccugaugugccacgcuaccuuuacgaugagacugcucagcccuguucgcgugccgaauuacaaccugauuaucauggaugaagcccauuucacagaccccgccuccauugcugcgcggggauacaucucuaccagagucggcaugggggaggccgcugccauuuuuaugacagccaccccucccggaacggcugaugccuucccucagagcaaugcgcccauccaggacgaggaaaaggacaucccggagcgcuccuggaacucuggcaaugaauggauuaccgauuuugcugggaaaacagugugguucgugccuagcaucaaggccggcaacgacauugccaacugucuucggaaaaauggaaagaaggucauccaacuguccagaaaaaccuuugauacagaguaucagaagaccaaacucaacgacugggauuucguugugacaaccgacauuucugagaugggcgcuaauuuuaaggccgaucgcgugaucgacccccggagaugccugaaacccgucauucugacggaugggccugaacgggugauccucgcgggacccaugccuguuacagccgcuagcgccgcucagcgcagaggccggguggggcgcaacccgcagaaggagaaugaccaauacaucuucaccggacagccccuuaacaaugaugaagaccacgcccauuggaccgaggcuaagaugcugcuggacaacauuaauacaccugaaggcaucauucccgcccucuucgagccugagagagaaaaauccgcggccaucgauggggaguaucggcugaagggcgaaagcagaaaaaccuuugucgagcuuaugcgccggggagaccugcccguguggcucgcucacaagguugccucugaaggcauuaaauacacagauagaaaguggugcuucgacgggcagcgcaacaaucagauccuggaggagaacauggauguggaaaucuggacgaaagagggagaaaagaagaaacugcggccgagauggcucgacgcucgcaccuauuccgauccucuugcccugaaggaguuuaaagacuucgccgcuggccggaagagcauugcgcuggaucucgucacagaaaucgggagagugcccacccaccuggcccaucgcacaagaaaugcucuugacaaccuggucaugcuccacaccucugagcauggaggcaaagccuaccggcacgccguggaggaacugccugagacgauggaaacccugcuccuucugggccugaugauucuccugacagggggagcuaugcuuuuucugaucuccggcaaggggauuggaaagaccagcaucggccucaucuguguuauugccuccucugggaugcuguggauggcggagaucccccugcaauggauugccagcgcuaucgugcucgaguucuuuaugauggugcuucugauuccugaacccgagaaacagcgcacaccgcaggauaaucaacuggccuaugucguuaucggaauucucacccuggcugccaucaucgcggccaacgaaaugggccuucuggagacgacaaagagagaccucggcauguccaaagaaccugggguggugagccccaccucuuaccuggaugucgaccugcaccccgcuuccgccuggacacucuacgcuguggccaccaccguuauuacaccuaugcuucggcauacgaucgagaauagcaccgcuaacgugucucuggccgcgauugccaaccaggcugucgugcugaugggacucgacaagggcuggccgaucagcaaaauggaucugggggucccccuucuggcccucggaugcuauucccaggugaauccucugacacugaccgcugccguucuccuucugauuacacacuacgccaucaucggccccgggcugcaggcgaaggcuacccgcgaggcccaaaagagaacggcugccggaauuaugaaaaacccuacaguggacggcaucaugaccauugaucucgaccccgucaucuaugauucuaaguucgaaaaacagcugggccaggugaugcuucugguucucugugccgugcagcugcugcucaugcggaccagcugggcucuuugcgaggcccugacacuggcgaccgggccuauuacaacgcucugggaaggauccccgggcaaguuuuggaauaccacaaucgccgucucuauggcuaacaucuucagagggagcuaccuggccggagcuggccuugccuuuuccauuaugaaaagcguggggaccggaaagcgcggcacaggcucucaaggggagacccugggagaaaaguggaaaaagaaacucaaucagcugucccggaaggaguucgaccuguauaaaaagagcggcaucacggagguggauagaaccgaagcgaaagaggggcucaagcgcggagaaauuacacaucacgccguuucccggggcucugcuaagcuucagugguuugucgagagaaacauggugauccccgaagggcgggugauugaccugggauguggccgcggcggguggagcuacuauugcgccggacugaaaaaggucaccgagguuagaggcuacacaaaagggggaccuggccaugaggaacccgugccuauguccaccuacggguggaauaucgugaagcucaugucuggaaaagaugucuucuaucugcccccggagaagugugacacacuucugugcgauauuggcgaaagcuccccuagccccaccguggaggagucucggacgauccgcguucucaagaugguggaacccuggcugaaaaacaaucaguucuguaucaagguccugaacccuuacaugcccacagugauugagcaccucgaaagacuucaacggaaacacggcgggaugcugguucgcaauccucuguccagaaacagcacccaugagauguauuggaucucuaauggaaccggcaacauuguggcuuccgucaauauggugagccggcuccugcuuaaccgcuuuacaaugacgcacagacggccgaccaucgaaaaggacguggaucugggggccggaacaagacaugucaacgcugagcccgagaccccuaauauggacguuauuggcgaacgcaucaaacggaucaaggaggaacacaacucuacauggcacuacgacgaugagaaucccuauaagaccugggccuaccaugggagcuaugaagugaaagcgacaggauccgccucuagcaugauuaacggcguggucaagcuccugaccaaaccuugggacgugguucccauggugacgcagauggcuaugaccgauacaaccccguucggccagcaaagagucuuuaaggagaaaguggacacacgcaccccucgguccaugcccgggacgagacgcguuaugggaaucacagccgaguggcuguggcggacccucggcagaaauaagaagccucgccugugcacacgggaagaguucaccaaaaaggugagaacgaacgcugccaugggggccgucuuuaccgaagagaaucagugggauagcgcgaaagcugccguggaagacgaggauuucuggaagcuuguugaccgcgagcgggaacugcacaaacucggaaaguguggcuccugcguguacaacaugauggggaaaagagagaagaagcugggcgaauuuggaaaagccaagggcucucgcgcuauuugguacauguggcuuggggccagauaucuggaguucgaggcucucggauuucugaaugaagaucauugguucagccgggagaacuccuacucuggcgucgaaggggagggacugcacaaacucggcuauauccugcgcgacauuagcaagauccccgggggcgccauguacgcggaugacacagccggaugggacaccagaaucacagaagaugaccuucauaaugaggagaaaauuacccagcagauggauccugaacaccggcaacuggcuaacgccaucuuuaagcucacauaucagaauaagguggucaaagugcagagacccaccccgacgggcacaguuauggacauuaucucccggaaggaucagcgcgggucuggacaagugggcaccuacgggcugaacaccuucacaaauauggaggcucagcuuauuagacagauggaaggagagggcguccugagcaaagccgaccucgaaaacccucaccugcccgagaagaaaaucacccaguggcuggagacaaaggggguggaacggcucaagcgcauggcgaucuccggcgaugacugcgugguuaaacccauugaugacagauuugccaacgcucugcuugcccugaaugauaugggaaaggugcggaaagacaucccucaauggcagccgagcaagggcuggcaugauuggcagcagguccccuucuguucucaccauuuccacgagcucauuaugaaagacgggcgcaagcuggugguuccuugcagaccccaagacgaacuuaucggacgggcucgcauuucccagggcgccggguggagccugagagagacggcuugucucggaaaggccuaugcgcagauguggucucugauguacuuucaccggcgcgaucugagacucgccuccaacgcuaucugcagcgccgugccuguccauugggugcccaccucucggacaaccugguccauucacgcccaucaccaauggaugacaaccgaagacaugcugacggucuggaaucgcguguggaucgaggauaacccuuggauggaggacaaaacccccguuacaaccugggaaaaugugccguaccuuggcaagagagaggaucaguggugugggagccugaucggccucacaucccgggcuaccugggcccagaacauuccuacggcgauccagcaagucagaagccugauuggaaaugaagaguuccuugacuauaugcccucuaugaaacgcuuucggaaggaggaagagagcgaaggcgcuaucugguga

SEQ ID NO: 20815 - RNA, 9873 nt, Artificial Sequence
  derived and/or modified CDS sequence (opt5) from DENV-3__FJ898468__SS-prME
accagccugugccucaugaugauccugcccgccgcucuugccuuccaccugacgucccgggacggagaaccucggaugauuguggggaagaacgaacgcggaaagucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacgugaucggaguccuggagcagggcaaacggacgcuuaccccucagcccauggagcugaaguacucuuggaaaacaugggggaaggccaagauugugaccgccgaaacacaaaacuccagcuucaucauugauggaccuaauacccccgagugcccgucugcuuccagagcguggaacgugugggaagucgaggacuauggcuuuggcguuuucacaaccaauaucuggcucaaacugcgcgaaguguacacgcagcugugugaccaccggcuuaugagcgccgcugugaaggaugagagagccguccacgccgacaugggguacuggaucgagucccagaaaaacggaucuuggaagcucgaaaaagcuagccugauugaggugaagacaugcaccuggccuaagucccauacccuguggucuaauggcguucucgaaagcgauaugaucauucccaaaucccuggccgggccuaucagccagcacaacuaucgccccggauaccauacacaaaccgcgggcccuuggcaccuugggaagcuggagcucgacuuuaauuauugcgagggaacgacaguggucauuaccgaaaacuguggcacacggggccccucucugagaaccacaaccguguccgggaaacugauccacgaguggugcugucgcagcugcacgcuuccgccucuccgguacaugggagaagauggcuguugguaugggauggagaucagacccauuucugaaaaggaggagaauaugguuaaaucccuggugagcgcuggaucuggcgaagucgacaacuucaccaugggggugcugugccucgccauccuguuugaggaaguuaugcggggaaaguucggcaagaaacauaugauugccggcguguucuuuacauucguccuucugcucagcgggcagaucaccuggcgcgauauggcucacacacugauuaugaucggauccaaugccagcgacagaaugggcaugggggugaccuaccuggcgcuuauugcuacguuuaagauccagcccuuccuggcccucggauuuuuccugcggaaacucacaucuagagagaaccugcuucugggcguggggcucgccauggcuaccacacugcaacugccugaagauaucgagcagauggccaauggaauugcucuuggccugauggcccucaagcugaucacccaguuugagaccuaucagcucuggacagcgcugauuucccuuacguguagcaacaccaucuucacacugaccgucgccuggcgcacagcuacccucauucuggccggcguuucccugcuuccggugugccaaucuagcuccaugcggaaaacggacuggcugcccaugacaguggcugccaugggggucccuccccucccucuguuuaucuucucucucaaggauacccugaagagacgcagcuggccccuuaaugaaggagugauggccguuggccugguguccauccuggcuucuagccuccugagaaacgacgucccuauggcggggccccuuguggccggaggccugcucauugcuuguuacguuaucaccgggacauccgccgaucugaccguggagaaagccgcugacgucacaugggaagaggaagccgagcagacgggagugagccauaaccucaugauuaccgucgacgaugacggcacaaugcggaucaaggaugacgagaccgaaaauauucugacagugcuucugaaaaccgcgcugcucaucguuucuggcaucuuuccguacuccauuccugcuacgcugcuuguguggcacaccuggcagaagcagacacaacgcagcgggguccugugggaugugcccucuccucccgagacccagaaagccgaacucgaggagggaguuuauagaaucaagcagcagggcauuuucgggaaaacacaagugggagucggcgugcagaaggaagggguguuucauaccauguggcacguuacacggggagccguccugacguacaacggcaagcgccucgagccgaauugggcuuccgugaaaaaggaccugaucagcuauggcgggggauggagacuuucugcccaguggcaaaaaggcgaagaggugcaggucauugcgguggaaccugggaagaaccccaaaaauuuccagaccaugccuggaacauuccagaccaccacaggcgagaucggggcuauugcccuggauuuuaagcccggaacguccggcagccccaucaucaaccgggagggcaagguuguggggcuguacggaaauggcgucgugaccaaaaacgggggauauguuuccggcauugcccaaacaaaugcugaaccugacgggccgacccccgagcucgaagaggaaauguucaagaaacgcaaccugacaaucauggaucuucacccuggcagcggaaagaccagaaaauaccugcccgccauugugcgggaggcuaucaagcgcagacuccggacgcugauucucgccccuacaagagucguggcggccgagauggaagaggcucugaagggccuucccauccgcuaucagaccaccgccacaaaaucugaacauaccgggcgggagaucguugaccugaugugccacgcuacauuuaccaugagacugcucagcccugugcgcgucccgaauuacaaccugauuaucauggaugaagcccauuucacggaccccgccuccauugcugcgcggggauacaucucuacaagagugggcaugggggaggccgcugccauuuuuaugaccgccacaccucccggaaccgcugaugccuucccucagagcaaugcgcccauccaggacgaggaacgcgacaucccggagcgguccuggaacucuggcaaugaauggauuacggauuuugcugggaagaccgugugguucgucccuagcaucaaagccggcaacgacauugccaacugucuuagaaagaauggcaaaaagguuauccaacugucccgcaagacauuugauaccgaguaucagaaaacaaagcucaacgacugggauuucguggugaccacagacauuucugagaugggagcuaauuuuaaagccgaucgggucaucgaccccagacggugccugaagcccgugauucugaccgaugggccugaacgcguuauccucgcgggacccaugccugugacggccgcuagcgccgcucagagacggggccgcgucgggagaaacccgcagaaagagaaugaccaauacaucuucacaggacagccccuuaacaaugaugaagaccacgcccauuggaccgaggcuaagaugcugcuggacaacauuaauaccccugaaggcaucauucccgcccucuucgagccugagcgggaaaaguccgcggccaucgauggggaguauagacugaaaggcgaaagccgcaagacauuuguggagcuuaugcggagaggagaccugcccguuuggcucgcucacaaaguggccucugaaggcauuaaguacaccgaucgcaaauggugcuucgacgggcagcggaacaaucagauccuggaggagaacauggaugucgaaaucuggacaaaggagggagagaagaagaagcugagaccgcgcuggcucgacgcucggacguauuccgauccucuugcccugaaagaguuuaaggacuucgccgcuggcagaaaaagcauugcgcuggaucucgugaccgaaaucgggcgcguccccucucaccuggcccauagaacacggaaugcucuugacaaccuggugaugcuccacaccuccgagcauggaggcaaggccuaccgccacgccguugaggaacugccugagacaauggaaacccugcuccuucugggccugaugauucuccugacagggggagcuaugcuuuuucugaucagcggcaaagggauuggaaagaccuccaucggccucaucugugugauugccucuagcgggaugcuguggauggcggagaucccccugcaauggauugccuccgcuaucgugcucgaguucuuuaugaugguccuucugauuccugaacccgagaagcagagaacaccgcaggauaaucaacuggccuauguugugaucggcauucucacccuggcugccaucaucgcggccaacgaaaugggccuucuggagacaaccaaacgggaccucggcaugagcaaggaaccugggguggucucucccacguccuaccuggauguggaccugcaccccgcuagcgccuggacacucuacgcuguugccaccacagugauuaccccuaugcuucgccauaccaucgaaaauucuacagcuaacgucagccuggccgcgauugccaaccaggcugugguccugaugggacucgacaaaggcuggccgaucuccaagauggaucugggggugccccuucuggcccucggaugcuauucucagguuaauccucugacgcugaccgcugccgugcuccuucugauuacacacuacgccaucaucggccccgggcugcaggcgaaagcuaccagagaggcccaaaagcggacagcugccggaauuaugaagaacccuaccgucgacggcaucaugacgauugaucucgaccccgugaucuaugauagcaaauucgagaagcagcugggccagguuaugcuucuggugcucugugccguccagcugcugcucaugagaacauccugggcucuuugcgaggcccugacccuggcgaccgggccuauuacaacccucugggaaggaucuccgggcaaauuuuggaauacaacgaucgccgugagcauggcuaacaucuuccgcggguccuaccuggccggagcuggccuugccuuuagcauuaugaagucuguggggaccggaaaacggggcacaggcucccaaggggagacccugggagaaaaguggaagaaaaagcucaaucagcugagcagaaaagaguucgaccuguauaagaaauccggcaucacagagguugaucgcaccgaagcgaaggaggggcucaaacggggagaaauuacgcaucacgccgucucuagaggcagcgcuaaacuucagugguuuguggagcggaacauggugauccccgaagggcgcgucauugaccugggauguggcagaggcgggugguccuacuauugcgccggacugaagaaaguuaccgaggugcggggcuacacaaaagggggaccuggccaugaggaacccgugccuaugucuaccuacggguggaauaucgucaaacucaugagcggaaaggauguguucuaucugcccccggagaaaugugacacacuucugugcgauauuggcgaauccagcccuucucccaccguugaggagucccgcacaaucagagugcucaagauggucgaacccuggcugaagaacaaucaguucuguaucaaagugcugaacccuuacaugcccaccguuguggagcaccucgaacggcuucaacgcaagcacggcgggaugcuggucagaaauccucugagccggaacucuacgcaugagauguauuggauuuccaauggaacaggcaacaucguggcuagcgugaauauggucucucgccuccugcuuaacagauuuaccaugacccaccggagaccgacaauugaaaaagacguugaucugggggccggaacgcgccaugugaacgcugagcccgagaccccuaauauggacgugaucggcgaacggauuaagagaaucaaagaggaacacaacagcacauggcacuacgacgaugagaaucccuauaagaccugggccuaccauggguccuaugaagucaaggcgacaggaucugccagcuccaugaucaacggcgugguuaaacuccugaccaagccuugggacgugguccccauggugacacagauggcuaugaccgauacgaccccguucggccagcaacgcguuuuuaaagagaagguggacacacggaccccuagaagcaugcccgggacacgccgggucaugggaauuaccgccgaguggcuguggagaacgcucggccgcaauaaaaagccucggcugugcacaagagaagaguucaccaagaaagugcgcacaaacgcugccaugggggccguuuuuaccgaagagaaucagugggauuccgcgaaggcugccguggaagacgaggauuucuggaaacuugucgaccgggagagagaacugcacaagcucggaaaauguggcucuugcguguacaacaugauggggaagcgcgagaaaaagcugggcgaauuuggaaaggccaaaggcagcagagcuaucugguacauguggcuuggggcccgguaucuggaguucgaggcucucggauuucugaaugaagaucauugguucucccgcgagaacucuuacagcggcgucgaaggggagggacugcacaagcucggcuauauucugagagacaucuccaaaauucccgggggcgccauguacgcggaugacacggccggaugggacacccggaucacagaagaugaccuucauaaugaggagaagaucacccagcagauggauccugaacacagacaacuggcuaacgccauuuuuaaacucacauaucagaauaaggugguuaaggugcagcggcccaccccgacaggcaccgucauggacaucauuucucgcaaagaucagagagggagcggacaagugggcacguacgggcugaacacauucaccaauauggaggcucagcuuauccggcagauggaaggagagggcgugcuguccaaggccgaccucgaaaacccucgccugcccgagaaaaagauuacccaguggcuggagacaaaagggguugaaagacucaagcggauggcgaucagcggcgaugacugcguggucaagcccaucgaugaccgcuuugccaacgcucugcuugcccugaaugauaugggaaaagugagaaaggacauuccucaauggcagccgucuaaaggcuggcacgauuggcagcagguucccuucuguucccaucacuuccaugagcucaucaugaaggacgggcggaaacugguggucccuugccgcccccaagacgaacuuauuggacgggcucggaucagccagggcgccggguggucucugcgcgagaccgcuugucucggaaaggccuaugcgcagauguggucccugauguacuuucacagacgggaucugcgccucgccagcaacgcuauuugcucugccgugccuguccacugggugcccacauccagaacgaccuggagcauccaugcccaccaucaauggaugacaaccgaagacaugcugacaguuuggaaucggguguggauugaggauaacccuuggauggaggacaagacccccgucacgaccugggaaaaugugccguaccuuggcaaaagagaggaucaguggugugggucccugaucggccucacaagccgcgcuaccugggcccagaacaucccuacagcgauucagcaaguucggucucugaucggaaaugaagaguuccuugacuauaugcccagcaugaagagauuucgcaaagaggaagaguccgaaggcgcuauuugguga

SEQ ID NO: 20816 - RNA, 9873 nt, Artificial Sequence
  derived and/or modified CDS sequence (opt5) from DENV-3__FJ898469__SS-prME
accagccugugccucaugaugauccugcccgccgcucuugccuuccaccugacaucccgggacggcgagccucggaugauuguggggaagaacgaacgcggaaagucucuccuguuuaagacggcgagcggcaucaauauguguacccuuauugcuauggaucugggggaaaugugcgacgauacagugaccuacaaguguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggcuagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaacggcaagcgccucgagccgaauugggcuuccgucaaaaaggaccugauuagcuauggcgggggauggagacuuucugcccaguggcaaaaaggcgaagagguccaggugaucgcggucgaaccugggaagaaccccaaaaauuuccagaccaugccuggaacauuccagaccaccacaggcgagauuggggcuaucgcccuggauuuuaagcccggaacguccggcagccccaucauuaaccgggagggcaaggugguugggcuguacggaaauggcguggucaccaaaaacgggggauauguguccggcaucgcccaaacaaaugcugaaccugacgggccgacccccgagcucgaagaggaaauguucaagaaacgcaaccugacaauuauggaucuucacccuggcagcggaaagaccagaaaauaccugcccgccaucguucgggaggcuauuaagcgcagacuccggacgcugauccucgccccuacaagaguggucgcggccgagauggaagaggcucugaagggccuucccauccgcuaucagaccaccgccacaaaaucugaacauaccgggcgggagauuguggaccugaugugccacgcuacauuuaccaugagacugcucagcccuguucgcgugccgaauuacaaccugaucauuauggaugaagcccauuucacggaccccgccuccaucgcugcgcggggauacauuucuacaagagucggcaugggggaggccgcugccaucuuuaugaccgccacaccucccggaaccgcugaugccuucccucagagcaaugcgcccauccaggacgaggaacgcgacauuccggagcgguccuggaacucuggcaaugaauggaucacggauuuugcugggaagaccgugugguucgugccuagcauuaaagccggcaacgacaucgccaacugucuuagaaagaauggcaaaaaggucauucaacugucccgcaagacauuugauaccgaguaucagaaaacaaagcucaacgacugggauuucguugugaccacagacaucucugagaugggagcuaauuuuaaagccgaucgggugauugaccccagacggugccugaagcccgucauccugaccgaugggccugaacgcgugauccucgcgggacccaugccuguuacggccgcuagcgccgcucagagacggggccgcguggggagaaacccgcagaaagagaaugaccaauacauuuucacaggacagccccuuaacaaugaugaagaccacgcccauuggaccgaggcuaagaugcugcuggacaacaucaauaccccugaaggcauuauccccgcccucuucgagccugagcgggaaaaguccgcggccauugauggggaguauagacugaaaggcgaaagccgcaagacauuugucgagcuuaugcggagaggagaccugcccguguggcucgcucacaaaguugccucugaaggcaucaaguacaccgaucgcaaauggugcuucgacgggcagcggaacaaucagauccuggaggagaacauggauguggaaauuuggacaaaggagggagagaagaagaagcugagaccgcgcuggcucgacgcucggacguauuccgauccucuugcccugaaagaguuuaaggacuucgccgcuggcagaaaaagcaucgcgcuggaucucgucaccgaaauugggcgcgugcccacacaccuggcccauagaacccggaaugcucuugacaaccuggucaugcuccacacaucugagcauggaggcaaggccuaccgccacgccguggaggaacugccugagaccauggaaacgcugcuccuucugggccugaugauccuccugaccgggggagcuaugcuuuuucugauuuccggcaaagggaucggaaagacaagcaucggccucauuuguguuaucgccuccucugggaugcuguggauggcggagauuccccugcaauggaucgccagcgcuauugugcucgaguucuuuaugauggugcuucugaucccugaacccgagaagcagagaaccccgcaggauaaucaacuggccuaugucguuauuggaauccucacacuggcugccaucauugcggccaacgaaaugggccuucuggagaccacgaaacgggaccucggcauguccaaggaaccugggguggugagccccacaucuuaccuggaugucgaccugcaccccgcuuccgccuggacccucuacgcuguggccacaaccguuaucaccccuaugcuucgccauacaauugagaauagcacggcuaacgugucucuggccgcgaucgccaaccaggcugucgugcugaugggacucgacaaaggcuggccgauuagcaagauggaucugggggucccccuucuggcccucggaugcuauucccaggugaauccucugacccugacagcugccguucuccuucugaucacccacuacgccaucauuggccccgggcugcaggcgaaagcuacaagagaggcccaaaagcggaccgcugccggaaucaugaagaacccuacgguggacggcauuaugacaaucgaucucgaccccgucauuuaugauucuaaauucgaaaagcagcugggccaggugaugcuucugguucucugugccgugcagcugcugcucaugagaaccagcugggcucuuugcgaggcccugacccuggcgacagggccuaucaccacacucugggaaggauccccgggcaaauuuuggaauacgaccaucgccgucucuauggcuaacauuuuccgcgggagcuaccuggccggagcuggccuugccuuuuccaucaugaaaagcguggggacaggaaaacggggcaccggccugcaaggggagacacucggagaaaaguggaagaaaaagcugaaucagcugucuagaaaagaguucgaccucuauaagaaauccggcauuaccgagguggaucgcacggaagcgaaggaggggcuuaaacggggagaaaucacccaucacgccguuagcagaggcuccgcuaagcugcagugguuugucgagcggaacauggugauucccgaagggcgcgugaucgaccugggauguggcagaggcggguggucuuacuauugcgccggacucaagaaagucacagagguucggggcuacaccaaagggggaccuggccaugaggaacccgugccuaugagcacauacggguggaauauugugaaacugauguccggaaaggaugucuucuaucuucccccggagaaaugugacacccugcucugcgauaucggcgaaucuagcccuucccccacaguggaggagagccgcaccaucagaguucugaagaugguggaacccuggcugaagaacaaucaguucuguauuaaaguccucaacccuuacaugcccacggugaucgagcaccuugaacggcugcaacgcaagcacggcgggaugcugguuagaaauccucucucucggaacuccacacaugagauguauuggauuagcaauggaaccggcaacaucguggcuucugucaauauggugucccgccugcuucugaacagauuuaccaugacacaccggagaccgacgauugaaaaagacguggaucucggggccggaacccgccaugucaacgcugagcccgagacaccuaauauggacguuaucggcgaacggaucaagagaauuaaagaggaacacaacagcaccuggcacuacgacgaugagaaucccuauaagacaugggccuaccaugggucuuaugaagugaaggcgaccggaagcgccuccucuaugaucaacggcguggucaaacugcugacaaagccuugggacgugguucccauggugacccagauggcuaugacggauaccacaccguucggccagcaacgcgucuuuaaagagaagguggacacccggacaccuagaagcaugcccgggacccgccggguuaugggaauuacggccgaguggcucuggagaacacugggccgcaauaaaaagccucggcuuugcaccagagaagaguucacaaagaaagugcgcaccaacgcugccaugggggccgucuuuacggaagagaaucagugggauuccgcgaaggcugccguggaagacgaggauuucuggaaacugguugaccgggagagagaacuccacaagcugggaaaauguggcagcugcguguacaacaugauggggaagcgcgagaagaaacuuggcgaauuuggaaaagccaaaggcuccagagcuaucugguacauguggcugggggcccgguaucucgaguucgaggcucugggauuucugaaugaagaucauugguucucucgcgagaacagcuacuccggcgucgaaggggagggacuccacaagcugggcuauauucuuagagacaucucuaaaauccccgggggcgccauguacgcggaugacaccgccggaugggacacacggauuaccgaagaugaccugcauaaugaggagaagaucacacagcagauggauccugaacacagacaacucgcuaacgccauuuuuaaacugaccuaucagaauaagguggucaaggugcagcggcccacaccgaccggcacgguuauggacaucauuagccgcaaagaucagagaggguccggacaagugggcacauacgggcuuaacaccuucaccaauauggaggcucagcugauccggcagauggaaggagagggcguccucucuaaggccgaccuggaaaacccucaucugcccgagaaaaagaucacacaguggcucgagaccaaagggguggaacgccugaagagaauggcgauuagcggcgaugacugcgugguuaagcccaucgaugaccgguuugccaacgcccuucuggcccucaaugauaugggaaaagugcgcaaggacauuccucaauggcagccguccaaaggcuggcaugauuggcagcagguccccuucuguagccaccauuuccacgagcugaucaugaaggacgggagaaaacuugugguuccuugccggccccaagacgaacugauuggacgcgcuagaaucucucagggcgccggguggucccuccgggagacagcuugucugggaaaggccuaugcgcagauguggagccugauguacuuucaccgcagagaucuccggcuggccucuaacgcuauuugcuccgccgugccuguccauugggugcccacgagccgcaccacauggucuauccacgcccaucaccaauggaugaccacagaagacaugcuuaccgucuggaauagaguguggaucgaggauaacccuuggauggaggacaagacgcccguuaccacaugggaaaaugugccguaccugggcaaacgggaggaucaguggugugggucccucauuggccugaccagcagagcuacaugggcccagaacaucccuaccgcgauucagcaaguccgcucccuuaucggaaaugaagaguuccuggacuauaugcccagcaugaagcgguuuagaaaagaggaagagucugaaggcgcuauuugguga

SEQ ID NO: 20817 - RNA, 9873 nt, Artificial Sequence
  derived and/or modified CDS sequence (opt5) from DENV-3__FJ898470__SS-prME
accagccugugccucaugaugauccugcccgccgcucuugccuuccaccugacaucccgggacggcgagccucggaugauuguggggaagaacgaacgcggaaagucucuccuguuuaagacggcgagcggcaucaauauguguacccuuauugcuauggaucugggggaaaugugcgacgauacagugaccuacaaguguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaacggcaagcgccucgagccgaauugggcuuccgucaaaaaggaccugauuagcuauggcgggggauggagacuuucugcccaguggcaaaaaggcgaagagguccaggugaucgcggucgaaccugggaagaaccccaaaaauuuccagaccaugccuggaacauuccagaccaccacaggcgagauuggggcuaucgcccuggauuuuaagcccggaacguccggcagccccaucauuaaccgggagggcaaggugguugggcuguacggaaauggcguggucaccaaaaacgggggauauguguccggcaucgcccaaacaaaugcugaaccugacgggccgacccccgagcucgaagaggaaauguucaagaaacgcaaccugacaauuauggaucuucacccuggcagcggaaagaccagaaaauaccugcccgccaucguucgggaggcuauuaagcgcagacuccggacgcugauccucgccccuacaagaguggucgcggccgagauggaagaggcucugaagggccuucccauccgcuaucagaccaccgccacaaaaucugaacauaccgggcgggagauuguggaccugaugugccacgcuacauuuaccaugagacugcucagcccuguucgcgugccgaauuacaaccugaucauuauggaugaagcccauuucacggaccccgccuccaucgcugcgcggggauacauuucuacaagagucggcaugggggaggccgcugccaucuuuaugaccgccacaccucccggaaccgcugaugccuucccucagagcaaugcgcccauccaggacgaggaacgcgacauuccggagcgguccuggaacucuggcaaugaauggaucacggauuuugcugggaagaccgugugguucgugccuagcauuaaagccggcaacgacaucgccaacugucuuagaaagaauggcaaaaaggucauucaacugucccgcaagacauuugauaccgaguaucagaaaacaaagcucaacgacugggauuucguugugaccacagacaucucugagaugggagcuaauuuuaaagccgaucgggugauugaccccagacggugccugaagcccgucauccugaccgaugggccugaacgcgugauccucgcgggacccaugccuguuacggccgcuagcgccgcucagagacggggccgcguggggagaaacccgcagaaagagaaugaccaauacauuuucacaggacagccccuuaacaaugaugaagaccacgcccauuggaccgaggcuaagaugcugcuggacaacaucaauaccccugaaggcauuauccccgcccucuucgagccugagcgggaaaaguccgcggccauugauggggaguauagacugaaaggcgaaagccgcaagacauuugucgagcuuaugcggagaggagaccugcccguguggcucgcucacaaaguugccucugaaggcaucaaguacaccgaucgcaaauggugcuucgacgggcagcggaacaaucagauccuggaggagaacauggauguggaaauuuggacaaaggagggagagaagaagaagcugagaccgcgcuggcucgacgcucggacguauuccgauccucuugcccugaaagaguuuaaggacuucgccgcuggcagaaaaagcaucgcgcuggaucucgucaccgaaauugggcgcgugcccacacaccuggcccauagaacccggaaugcucuugacaaccuggucaugcuccacacaucugagcauggaggcaaggccuaccgccacgccguggaggaacugccugagaccauggaaacgcugcuccuucugggccugaugauccuccugaccgggggagcuaugcuuuuucugauuuccggcaaagggaucggaaagacaagcaucggccucauuuguguuaucgccuccucugggaugcuguggauggcggagauuccccugcaauggaucgccagcgcuauugugcucgaguucuuuaugauggugcuucugaucccugaacccgagaagcagagaaccccgcaggauaaucaacuggccuaugucguuauuggaauccucacacuggcugccaucauugcggccaacgaaaugggccuucuggagaccacgaaacgggaccucggcauguccaaggaaccugggguggugagccccacaucuuaccuggaugucgaccugcaccccgcuuccgccuggacccucuacgcuguggccacaaccguuaucaccccuaugcuucgccauacaauugagaauagcacggcuaacgugucucuggccgcgaucgccaaccaggcugucgugcugaugggacucgacaaaggcuggccgauuagcaagauggaucugggggucccccuucuggcccucggaugcuauucccaggugaauccucugacccugacagcugccguucuccuucugaucacccacuacgccaucauuggccccgggcugcaggcgaaagcuacaagagaggcccaaaagcggaccgcugccggaaucaugaagaacccuacgguggacggcauuaugacaaucgaucucgaccccgucauuuaugauucuaaauucgaaaagcagcugggccaggugaugcuucugguucucugugccgugcagcugcugcucaugagaaccagcugggcucuuugcgaggcccugacccuggcgacagggccuaucaccacacucugggaaggauccccgggcaaauuuuggaauacgaccaucgccgucucuauggcuaacauuuuccgcgggagcuaccuggccggagcuggccuugccuuuuccaucaugaaaagcguggggacaggaaaacggggcaccggcucucaaggggagacacugggagaaaaguggaagaaaaagcucaaucagcuguccagaaaagaguucgaccuguauaagaaaagcggcauuaccgagguggaucgcacggaagcgaaggaggggcucaaacggggagaaaucacccaucacgccguuuccagaggcucugcuaaacuucagugguuugucgagcggaacauggugauucccgaagggcgcgugaucgaccugggauguggcagaggcggguggagcuacuauugcgccggacugaagaaagucacagagguucggggcuacaccaaagggggaccuggccaugaggaacccgugccuauguccacauacggguggaauauugugaaacucaugucuggaaaggaugucuucuaucugcccccggagaaaugugacacccuucugugcgauaucggcgaaagcuccccuagccccacaguggaggagucucgcaccaucagaguucucaagaugguggaacccuggcugaagaacaaucaguucuguauuaaaguccugaacccuuacaugcccacggugaucgagcaccucgaacggcuucaacgcaagcacggcgggaugcugguuagaaauccucugucccggaacagcacacaugagauguauuggauuucuaauggaaccggcaacaucguggcuuccgucaauauggugagccgccuccugcuuaacagauuuaccaugacacaccggagaccgacgauugaaaaagacguggaucugggggccggaacccgccaugucaacgcugagcccgagacaccuaauauggacguuaucggcgaacggaucaagagaauuaaagaggaacacaacucuaccuggcacuacgacgaugagaaucccuauaagacaugggccuaccaugggagcuaugaagugaaggcgaccggauccgccucuagcaugaucaacggcguggucaaacuccugacaaagccuugggacgugguucccauggugacccagauggcuaugacggauaccacaccguucggccagcaacgcgucuuuaaagagaagguggacacccggacaccuagauccaugcccgggacccgccggguuaugggaauuacggccgaguggcuguggagaacacucggccgcaauaaaaagccucggcugugcaccagagaagaguucacaaagaaagugcgcaccaacgcugccaugggggccgucuuuacggaagagaaucagugggauagcgcgaaggcugccguggaagacgaggauuucuggaaacuuguugaccgggagagagaacugcacaagcucggaaaauguggcuccugcguguacaacaugauggggaagcgcgagaaaaagcugggcgaauuuggaaaggccaaaggcucuagagcuaucugguacauguggcuuggggcccgguaucuggaguucgaggcucucggauuucugaaugaagaucauugguucagccgcgagaacuccuacucuggcgucgaaggggagggacugcacaagcucggcuauauucugagagacaucagcaaaauccccgggggcgccauguacgcggaugacaccgccggaugggacacacggauuaccgaagaugaccuucauaaugaggagaagaucacacagcagauggauccugaacacagacaacuggcuaacgccauuuuuaaacucaccuaucagaauaagguggucaaggugcagcggcccacaccggcuggcaccguuauggacaucauuucccgcaaagaucagagagggucuggacaagugggcacguacgggcugaacacauucaccaauauggaggcccagcuuauccggcagauggaaggagagggcguccugagcaaggcggaccucgaaaacccucaucugcccgagaaaaagaucacccaguggcuggagacaaaagggguggaacgccucaagagaauggccauuuccggcgaugacugcgugguuaagcccaucgaugaccgguuugcuaacgcccugcuugcucugaaugauaugggaaaagugcgcaaggacauuccucaauggcagccgagcaaaggcuggcaugauuggcagcagguccccuucuguucucaccauuuccacgagcucaucaugaaggacgggagaaaacuggugguuccuugccggccccaagacgaacuuauuggacgcgccagaaucucccagggcgcuggguggagccugcgggagaccgccugucucggaaaggcguaugcccagauguggucucugauguacuuucaccgcagagaucugcggcucgcuuccaacgccauuugcagcgccgugccuguccauugggugcccacaucucgcacgaccugguccauccacgcucaucaccaauggaugacaaccgaagacaugcugacagucuggaauagaguguggaucgaggauaacccuuggauggaggacaagacccccguuacgaccugggaaaaugugccguaccuuggcaaacgggaggaucaguggugugggagccugauuggccucacauccagagccaccugggcgcagaacaucccuacagcuauucagcaaguccgcagccugaucggaaaugaagaguuccuugacuauaugcccucuaugaagcgguuuagaaaagaggaagagagcgaaggcgccauuugguga

SEQ ID NO: 20818 - RNA, 9873 nt, Artificial Sequence
  derived and/or modified CDS sequence (opt5) from DENV-3__FJ898471__SS-prME
acaagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggagaugugcgacgauacagucaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucauucagaagguggucaucuucauucugcuuaugcuggugacaccuucuaugaccaugagauguguuggagugggcaaccgggacuuugucgaagggcucagcggagcuacauggguggaugugguccuggagcacggcgggugcguuaccaccauggccaagaauaaacccacacuggacaucgagcuccagaagacggaagcuacccaacuggccacacuucgcaaacuguguauugagggaaagaucaccaacauuacaaccgauuccagaugcccuacgcagggcgaagcggugcucccggaggaacaggaccagaauuauguguguaaacacacauacgucgaucggggcugggggaacggaugcggccuguucgggaagggaagccuugugaccugcgccaaguuucaaugucuggagcccaucgagggcaaaguugugcaguaugaaaaucucaaguacaccgucaucauuacagugcauaccggggaccagcaccagguuggaaacgagacacaaggcgugacggcugaaaucaccccucaggccucuacaaccgaggcuauucugcccgaauauggcacacuggggcucgagugcuccccucgcaccggacuggacuucaaugagaugauccuucugacgaugaaaaacaaggccuggaugguccauagacagugguuuuucgaucucccccugccguggaccagcggcgccacaaccgaaacaccuaccuggaaucggaaagagcuucuggugacguuuaagaacgcucacgcgaaaaagcaagaagucgugguucucgggucucaggagggagccaugcacacagcucugaccggcgccacagaaauucaaaauuccgggggcaccagcaucuucgccggacaucugaagugucgccucaaaauggacaagcuggagcuuaaaggcaugucuuacgcuaugugcaccaacacauuugugcugaagaaagaggucuccgaaacgcagcacgggaccauccucauuaagguggaguacaagggagaagauguucccuguaaaaucccuuucagcacagaggacggccaagggaaggcccauaacggaagacugauuaccgcgaaucccguggucaccaagaaggaggaacccgugaacaucgaggcugaaccuccguucggcgaguccaauauugugaucgggaucggcgauaacgcccugaaaauuaauugguauaagaagggaucuagcaucggcaaaauguuugaagccaccgcuagaggggccagacgcauggcuauucuuggagacacggccugggauuucggcuccguugggggaguccucaacagccugggcaagauggugcaccagaucuuugggucugcguacacagcccuguucuccggcgugagcugggucaugaaaauuggaaucggcgugcuccugaccuggauugggcuuaauucuaagaacaccagcauguccuuuucuugcaucguuaucggaauuaucacacuguaucucggcgcugugguccaggccgacauggggugugugauuaauuggaaaggaaaggagcugaagugcggcagcgggaucuucguuaccaacgaggugcauacauggacggaacaguacaaauuucaagcugauucccccaagcggcuggccaccgcgauugccggcgcuugggagaauggagucuguggcaucagaagcacaacccgcauggaaaaccuucucuggaaacagaucgccaaugagcugaacuauauucugugggaaaauaacaucaagcucacagugguugugggggacauuaucggaguccuggagcagggcaaacggacccuuacgccucagcccauggagcugaaguacucuuggaaaaccugggggaaggcuaagauugugacagccgaaacccaaaacuccagcuucaucaucgauggaccuaauacacccgagugcccgucugccuccagagcuuggaacgugugggaagucgaggacuauggcuuuggcguuuucaccacaaauauuuggcucaaacugcgcgaaguguacacccagcugugugaccaccggcuuaugagcgcggccgugaaggaugagagagcuguccacgccgacaugggguacuggaucgagucccagaaaaacggaucuuggaagcucgaaaaagccagccugauugaggugaagacgugcacauggccuaagucccauacccuguggucuaauggcguucucgaaagcgauaugaucauucccaaaucccuggcugggccuaucagccagcacaacuaucgccccggauaccauacccaaacagccggcccuuggcaccuugggaagcuggagcucgacuuuaauuauugcgagggaaccacgguggucaucacagaaaacuguggcacccggggccccucucugagaacaaccacaguguccgggaaacugauucacgaguggugcugucgcagcugcacccuuccgccucuccgguacaugggagaagauggcuguugguaugggauggagaucagacccauuucugaaaaggaggagaauaugguuaaaucccuggugagcgcgggaucuggcgaagucgacaacuucacgaugggggugcugugccucgcuauccuguuugaggaaguuaugcggggaaaguucggcaagaaacauaugauugccggcguguucuuuaccuucguccuucugcucagcgggcagaucacauggcgcgauauggcccacacccugauuaugaucggauccaaugcuagcgacagaaugggcaugggggugacauaccuggcccuuaucgcgaccuuuaagauucagcccuuccuggcucucggauuuuuccugcggaaacucacgucuagagagaaccugcuucugggcguggggcucgccauggccacaacccugcaacugccugaagauaucgagcagauggcuaauggaauugcccuuggccugauggcucucaagcugaucacacaguuugagaccuaucagcucuggaccgcccuggucucccuuacauguagcaacacgauuuucacccugacaguugcguggcgcaccgccacacucauccuggcuggcgugucccugcuuccggugugccaaucuagcuccaugcggaaaaccgacuggcugcccaugacggucgccgcuaugggggugccuccccucccucuguuuaucuucucucucaaggauacacugaagagacgcagcuggccccuuaaugaaggaguuauggccgugggccuggucuccauucuggccucuagccuccugagaaacgacgugccuauggcugggccccuuguugcgggaggccugcucaucgccuguuacgugauuaccgggaccuccgcugaucugacagucgagaaagccgccgacgugaccugggaagaggaagcugagcagacaggagucagccauaaccucaugaucacgguggacgaugacggcaccaugcggauuaaggaugacgagacagaaaauauccugaccguucuucugaaaacagcccugcucaucgugucuggcauuuuuccguacuccaucccugcgacccugcuugucuggcacacguggcagaagcagacccaacgcagcggggugcugugggauguucccucuccucccgagacacagaaagcugaacucgaggagggaguguauagaauuaagcagcagggcaucuucgggaaaacccaagucggagugggcgugcagaaggaagggguuuuucauacaauguggcacgucacccggggagccgugcugacauacaacggcaagcgccucgagccgaauugggccuccgugaaaaaggaccugauuagcuauggcgggggauggagacuuucugcucaguggcaaaaaggcgaagagguccaggugaucgccguugaaccugggaagaaccccaaaaauuuccagacgaugccuggaaccuuccagacaaccaccggcgagauuggggcgaucgcucuggauuuuaagcccggaacauccggcagccccaucauuaaccgggagggcaagguggucgggcuguacggaaauggcgugguuacgaaaaacgggggauauguguccggcaucgcccaaaccaaugccgaaccugacgggccgacacccgagcucgaagaggaaauguucaagaaacgcaaccugaccauuauggaucuucacccuggcagcggaaagacaagaaaauaccugcccgcuaucguccgggaggccauuaagcgcagacuccggacccugauccucgcuccuacgagagugguugccgcggagauggaagaggcccugaagggccuucccauccgcuaucagacaaccgcuaccaaaucugaacauacagggcgggagauuguggaccugaugugccacgccaccuuuacaaugagacugcucagcccuguccgcgugccgaauuacaaccugaucauuauggaugaagcucauuucaccgaccccgccuccaucgccgcucggggauacauuucuacgagagugggcaugggggaggcggccgcuaucuuuaugacagccaccccucccggaacagccgaugcuuucccucagagcaaugcccccauccaggacgaggaacgcgacauuccggagcgguccuggaacucuggcaaugaauggaucaccgauuuugcggggaagacggucugguucguuccuagcauuaaagcuggcaacgacaucgccaacugucuuagaaagaauggcaaaaaggugauucaacugucccgcaagaccuuugauacagaguaucagaaaaccaagcucaacgacugggauuucguggucacaaccgacaucucugagaugggagccaauuuuaaagcugaucgggugauugaccccagacggugccugaagcccguuauccugacagaugggccugaacgcgugauccucgccggacccaugccugucaccgcggccagcgcugcccagagacggggccgcguggggagaaacccgcagaaagagaaugaccaauacauuuucacgggacagccccuuaacaaugaugaagaccacgcucauuggacagaggccaagaugcugcuggacaacaucaauaccccugaaggcauuauccccgcucucuucgagccugagcgggaaaaguccgccgcgauugauggggaguauagacugaaaggcgaaagccgcaagaccuuuguugagcuuaugcggagaggagaccugcccguguggcucgccuacaaagucgcuucugaaggcaucaaguauacagaucgcaaauggugcuucgacgggcagcggaacaaucagauccuggaggagaacauggauguggaaauuuggaccaaggagggagagaagaagaagcugagaccgcgcuggcucgacgcccggacauacuccgauccucuugcucugaaagaguuuaaggacuucgccgccggcagaaaaagcaucgcucuggaucucgucacggaaauugggcgcgugcccucucaccuggcgcacagaacccggaaugcccuugacaaccugguuaugcuccauacauccgagcacggaggcaaggcuuaucgccaugccguggaggaacugccugagaccauggaaacacugcuccuucugggccugaugauccuccugaccgggggagccaugcuuuuucugauuagcggcaaagggaucggaaagacguccaucggccucauuugugugaucgcuucuagcgggaugcuguggauggccgagauuccccugcaauggaucgcguccgccauuguccucgaguucuuuaugaugguucuucugaucccugaacccgagaagcagagaaccccgcaggauaaucaacuggcuuacguggugauuggaauccucacacuggccgcuaucauugccgcgaacgaaaugggccuucuggagaccacaaaacgggaccucggcaugagcaaggaaccuggggucgugucucccaccuccuaccuggauguugaccugcaccccgccagcgcuuggacgcucuaugccguggcuacaaccgucaucacaccuaugcuucgccacaccauugaaaauucuaccgccaacgugagccuggcugccaucgcgaaccaggccgucgugcugaugggacucgacaaaggcuggccgauuuccaagauggaucuggggguuccccuucuggcucucggaugcuacucucaggugaauccucugacacugacggccgcuguccuccuucugaucacccauuaugccaucauuggccccgggcugcaggccaaagcgacaagagaggcucaaaagcggaccgccgcuggaaucaugaagaacccuacaguggacggcauuaugaccaucgaucucgaccccguuauuuacgauagcaaauucgagaagcagcugggccaggugaugcuucugguccucugugccgugcagcugcugcucaugagaacguccugggcccuuugcgaggcucugacacuggccaccgggccuaucaccacacucugggaaggaucuccgggcaaauuuuggaauaccacaaucgcggugagcauggccaacauuuuccgcggguccuaucuggcuggagccggccuugcuuuuagcaucaugaagucuguugggacgggaaaacggggcaccggcucccaaggggagacacugggagaaaaguggaagaaaaagcucaaucagcugagcagaaaagaguucgaccuguacaagaaauccggcauuaccgaggucgaucgcacagaagccaaggaggggcucaaacggggagaaaucacccaccaugcggugucuagaggcagcgccaaacuucagugguuuguggagcggaacauggucauucccgaagggcgcguuaucgaccugggauguggcagaggcgggugguccuauuacugcgcuggacugaagaaagugacggaggugcggggcuacaccaaagggggaccuggccacgaggaacccgucccuaugucuacauauggguggaauauugugaaacucaugagcggaaaggauguuuucuaccugcccccggagaaaugugacacccuucugugcgauaucggcgaauccagcccuucucccacaguggaggagucccgcaccaucagaguccucaagaugguggaacccuggcugaagaacaaucaguucuguauuaaaguucugaacccuuauaugcccacagugaucgagcaucucgaacggcuucaacgcaagcacggcgggaugcuggucagaaauccucugagccggaacucuacccacgagauguacuggauuuccaauggaacgggcaacaucguggccagcgugaauauggucucucgccuccugcuuaacagauuuacaaugacccaucggagaccgaccauugaaaaagacguugaucugggggcuggaacacgccacgugaacgccgagcccgagacgccuaauauggacgugaucggcgaacggaucaagagaauuaaagaggaacauaacagcaccuggcacuaugacgaugagaaucccuacaagacaugggcuuaucacggguccuacgaagucaaggccaccggaucugcgagcuccaugaucaacggcgugguuaaacuccugacaaagccuugggacgugguccccauggugacccagauggccaugacagauaccacgccguucggccagcaacgcguuuuuaaagagaagguggacacccggacaccuagaagcaugcccgggacccgccgggucaugggaauuacagcugaguggcuguggagaacccucggccgcaauaaaaagccucggcugugcacgagagaagaguucacaaagaaagugcgcaccaacgccgcuaugggggccguuuuuacagaagagaaucagugggauuccgccaaggcggcuguggaagacgaggauuucuggaaacuugucgaccgggagagagaacugcauaagcucggaaaauguggcucuugcguguacaacaugauggggaagcgcgagaaaaagcugggcgaauuuggaaaggccaaaggcagcagagccaucugguauauguggcuuggggcucgguaccuggaguucgaggcccucggauuucugaaugaagaucacugguucucccgcgagaacucuuauagcggcgucgaaggggagggacugcauaagcucggcuacauucugagagacaucuccaaaauccccgggggcgcuauguaugccgaugacaccgcgggaugggacacgcggauuaccgaagaugaccuucacaaugaggagaagaucacacagcagauggauccugaacauagacaacuggccaacgcuauuuuuaaacucaccuaccagaauaaggugguuaaggugcagcggcccacaccgaccggcacagucauggacaucauuucucgcaaagaucagagagggagcggacaagugggcaccuaugggcugaacacguucacaaauauggaggcccagcuuauccggcagauggaaggagagggcgugcuguccaaggcugaccucgaaaacccucaucugcccgagaaaaagaucacccaguggcuggagaccaaagggguugaacgccucaagagaauggccauuagcggcgaugacugcguggucaagcccaucgaugaccgguuugcgaacgcccugcuugcucugaaugauaugggaaaagugcgcaaggacauuccucaauggcagccgucuaaaggcuggcacgauuggcagcagguucccuucuguucccaucacuuccaugagcucaucaugaaggacgggagaaaacugguggucccuugccggccccaagacgaacuuauuggacgcgccagaaucagccagggcgcuggguggucucugcgggagacagccugucucggaaaggcuuacgcccagauguggucccugauguacuuucaccgcagagaucugcggcucgcgagcaacgccauuugcucugcugugccuguccacugggugcccaccucccgcacaacguggagcauccaugcccaccaucaauggaugaccacagaagacaugcugaccguuuggaauagaguguggaucgaggauaacccuuggauggaggacaagacacccgucaccacgugggaaaaugugccguaucuuggcaaacgggaggaucaguggugugggucccugauuggccucaccagcagagccacaugggcucagaacaucccuaccgccauucagcaaguucgcucucugaucggaaaugaagaguuccuugacuacaugcccagcaugaagcgguuuagaaaagaggaagaguccgaaggcgcgauuugguga

SEQ ID NO: 20819 - RNA, 9873 nt, Artificial Sequence
  derived and/or modified CDS sequence (opt5) from DENV-3__FJ898472__SS-prME
accagccugugccucaugaugauccugcccgccgcucuugccuuccaccugacaucccgggacggcgaaccucggaugauuguggggaagaaugaacgcggaaagucucuccuguuuaagacggcgagcggcaucaauauguguacccuuauugcuauggaucugggggaaaugugcgacgauacagugaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggcuagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuuccuuacauuugugcugcuccugagcgggcagauuaccuggcgcgauauggcucacacacugaucaugauuggauccaaugccagcgacagaaugggcaugggggucaccuaccuugcgcugaucgcuacguucaagauccagcccuuucucgcccugggauucuuucuccggaaacugacaucuagagagaaccuucugcucggcguggggcuggccauggcuaccacacugcaacuuccugaagauauugagcagauggccaauggaaucgcucugggccucauggcccugaagcucauuacccaguucgagaccuaucagcuguggacagcgcuuaucucccugacguguagcaacaccauuuuuacacucaccguggccuggcgcacagcuacccugauccuggccggcgucucccuucugccgguuugccaaucuagcuccaugcggaaaacggacuggcuccccaugacaguggcugccaugggggugccuccccugccucucuucaucuuuaaucugaaggauacccuuaagagacgcucuuggccccugaacgaaggagucauggccgugggccugguuagcauucucgcuuccucucugcuuagaaacgacgugccuauggcggggccccuggucgccggaggccuccugaucgcuuguuacgugauuaccgggacaagcgccgaucucaccguugagaaagccgcugacgugacaugggaagaggaagccgagcagacgggagucucccauaaucugaugaucaccguggacgaugacggcacaaugcggauuaaggaugacgagaccgaaaacauccuuacaguccugcugaaaaccgcgcuccugaucgugagcggcauuuucccguacucuaucccugcuacgcuucugguuuggcacaccuggcagaagcagacacaacgcuccggggugcucugggauguccccagcccucccgagacccagaaagccgaacuggaggagggaguguauagaauuaagcagcagggcaucuuugggaaaacacaaguuggagugggcguccagaaggaagggguguuccauaccauguggcacgugacacggggagccguucucacguacaauggcaagcgccuggagccgaacugggcuucugucaaaaaggaccuuauuuccuauggcgggggauggagacugagcgcccaguggcaaaaaggcgaagagguccaggugaucgcggucgaaccugggaagaaucccaaaaacuuucagaccaugccuggaacauuccagaccaccacaggcgagauuggggcuaucgcccuggauuucaagcccggaacgucuggcucccccaucauuaaucgggagggcaaggugguugggcucuacggaaacggcguggucaccaaaaaugggggauaugugagcggcaucgcccaaacaaacgcugaaccugacgggccgacccccgagcuggaagaggaaauguuuaagaaacgcaaucuuacaauuauggaucugcacccuggcuccggaaagaccagaaaauaccuccccgccaucguucgggaggcuauuaagcgcagacugcggacgcucauccuggccccuacaagaguggucgcggccgagauggaagaggcucuuaagggccugcccauccgcuaucagaccaccgccacaaaaagcgaacauaccgggcgggagauuguggaccugaugugccacgcuacauucaccaugagacuccugucuccuguucgcgugccgaacuacaaucuuaucauuauggaugaagcccauuuuacggaccccgccagcaucgcugcgcggggauacauuuccacaagagucggcaugggggaggccgcugccaucuucaugaccgccacaccucccggaaccgcugaugccuuuccucagucuaacgcgcccauccaggacgaggaacgcgacauuccggagcggagcuggaacuccggcaacgaauggaucacggauuucgcugggaagaccgugugguuugugccuucuauuaaagccggcaacgacaucgccaauugucugagaaagaacggcaaaaaggucauucaacucagccgcaagacauucgauaccgaguaucagaaaacaaagcugaaugacugggauuuuguugugaccacagacaucuccgagaugggagcuaacuucaaagccgaucgggugauugaccccagacggugccugaagcccgucauccucaccgaugggccugaacgcgugauccuugcgggacccaugccuguuacggccgcuucugccgcucagagacggggccgcguggggagaaauccgcagaaagagaacgaccaauacauuuuuacaggacagccccugaauaacgaugaagaccacgcccauuggaccgaggcuaagaugcugcucgacaauaucaacaccccugaaggcauuauccccgcccuguucgagccugagcgggaaaagagcgcggccauugauggggaguauagacuuaaaggcgaaucccgcaagacauucgucgagcugaugcggagaggagaccuccccguguggcuggcucacaaaguugccagcgaaggcaucaaguacaccgaucgcaaauggugcuuugacgggcagcggaauaaccagauccuggaggagaauauggauguggaaauuuggacaaaggagggagagaagaagaagcucagaccgcgcuggcuugacgcucggacguauucugauccucuggcccugaaagaguucaaggacuuugccgcuggcagaaaauccaucgcgcucgaucuggucaccgaaauugggcgcgugcccacacaccuugcccauagaacccggaacgcucuggacaaucucgucaugcugcacacaagcgagcauggaggcaaggccuaccgccacgccguggaggaacugccugagaccauggaaacgcuccuucugcugggccucaugauccugcuuaccgggggagcuaugcuguuccucauuucuggcaaagggaucggaaagacauccaucggccugauuuguguuaucgccagcuccgggaugcuguggauggcggagauuccccuccaauggaucgccucugcuauugugcuugaguuuuucaugauggugcugcugaucccugaacccgagaagcagagaaccccgcaggauaaccaacucgccuaugucguuauuggaauccugacacuugcugccaucauugcggccaaugaaaugggccugcucgagaccacgaaacgggaccugggcaugagcaaggaaccugggguggugucccccacaagcuaccuggaugucgaccuccaccccgcuucugccuggacccuuuacgcuguggccacaaccguuaucaccccuaugcugcgccauacaauugagaacuccacggcuaacgugagccuggccgcgaucgccaaucaggcugucgugcucaugggacuggacaaaggcuggccgauuucuaagauggaucuuggggucccccugcucgcccugggaugcuauagccaggugaacccucugacccucacagcugccguucuucugcugaucacccacuacgccaucauuggccccgggcuccaggcgaaagcuacaagagaggcccaaaagcggaccgcugccggaaucaugaagaauccuacgguggacggcauuaugacaaucgaucuggaccccgucauuuaugauuccaaauuugaaaagcagcuuggccaggugaugcugcucguucugugugccgugcagcugcuccuuaugagaaccucuugggcucugugcgaggcccugacccucgcgacagggccuaucaccacacugugggaaggaagcccgggcaaauucuggaacacgaccaucgccgucuccauggcuaauauuuuucgcgggucuuaccuugccggagcuggccuggccuucagcaucaugaaguccguggggacaggaaaacggggcaccggcagccaaggggagacacucggagaaaaguggaagaaaaagcugaaccagcugucuagaaaagaguuugaccucuauaagaaauccggcauuaccgagguggaucgcacggaagcgaaggaggggcuuaaacggggagaaaucacccaucacgccguuagcagaggcuccgcuaagcugcagugguucgucgagcggaauauggugauucccgaagggcgcgugaucgaccugggauguggcagaggcggguggucuuacuauugcgccggacucaagaaagucacagagguucggggcuacaccaaagggggaccuggccaugaggaacccgugccuaugagcacauacggguggaacauugugaaacugauguccggaaaggaugucuuuuaucuucccccggagaaaugugacacccugcucugcgauaucggcgaaucuagcccuucccccacaguggaggagagccgcaccaucagaguucugaagaugguggaacccuggcugaagaauaaccaguucuguauuaaaguccucaauccuuacaugcccacggugaucgagcaccuugaacggcugcaacgcaagcacggcgggaugcugguuagaaacccucucucuagaaauuccacacaugagauguauuggauuagcaacggaaccggcaauaucguggcuucugucaacauggugucccgccugcuucugaacagauucaccaugacacaccggagaccgacgauugaaaaagacguggaucucggggccggaacccgccaugucaaugcugagcccgagacaccuaacauggacguuaucggcgaacggaucaagagaauuaaagaggaacacaauagcaccuggcacuacgacgaugagaaccccuauaagacaugggccuaccaugggucuuaugaagugaaggcgaccggaagcgccuccucuaugaucaauggcguggucaaacugcugacaaagccuugggacgugguucccauggugacccagauggcuaugacggauaccacaccguuuggccagcaacgcgucuucaaagagaagguggacacccggacaccuagaagcaugcccgggacccgccggguuaugggaauuacggccgaguggcucuggagaacacugggccgcaacaaaaagccucggcuuugcaccagagaagaguuuacaaagaaagugcgcaccaaugcugccaugggggccgucuucacggaagagaaccagugggauuccgcgaaggcugccguggaagacgaggauuuuuggaaacugguugaccgggagagagaacuccacaagcugggaaaauguggcagcugcguguacaauaugauggggaagcgcgagaagaaacuuggcgaguucggaaaagccaaaggcuccagagcuaucugguacauguggcugggggcccgguaucucgaguuugaggcucugggauuccugaacgaagaucauugguuuucucgcgagaauagcuacuccggcgucgaaggggagggacuccacaagcugggcuauauucuuagagacaucucuaaaauccccgggggcgccauguacgcggaugacaccgccggaugggacacacggauuaccgaagaugaccugcauaacgaggagaagaucacacagcagauggauccugaacacagacaacucgcuaaugccauuuucaaacugaccuaucagaacaagguggucaaggugcagcggcccacaccgaccggcacgguuauggacaucauuagccgcaaagaucagagaggguccggacaagugggcacauacgggcuuaauaccuuuaccaacauggaggcucagcugauccggcagauggaaggagagggcguccucucuaaggccgaccuggaaaacccucaucugcccgagaaaaagaucacacaguggcucgagaccaaagggguggaacgccugaagagaauggcgauuagcggcgaugacugcgugguuaagcccaucgaugaccgguucgccaaugcccuucuggcccucaacgauaugggaaaagugcgcaaggacauuccucaauggcagccguccaaaggcuggcaugauuggcagcagguccccuuuuguagccaccauuuccacgagcugaucaugaaggacgggagaaaacuugugguuccuugccggccccaagacgaacugauuggacgcgcuagaaucucucagggcgccggguggucccuccgggagacagcuugucugggaaaggccuaugcgcagauguggagccugauguacuuccaccgcagagaucuccggcuggccucuaaugcuauuugcuccgccgugccuguccauugggugcccacgagccgcaccacauggucuauccacgcccaucaccaauggaugaccacagaagacaugcuuaccgucuggaacagaguguggaucgaggauaauccuuggauggaggacaagacgcccguuaccacaugggaaaacgugccguaccugggcaaacgggaggaucaguggugugggucccucauuggccugaccagcagagcuacaugggcccagaauaucccuaccgcgauucagcaaguccgcucccuuaucggaaacgaagaguuucuggacuauaugcccagcaugaagcgguucagaaaagaggaagagucugaaggcgcuauuugguga

SEQ ID NO: 20820 - RNA, 9873 nt, Artificial Sequence
  derived and/or modified CDS sequence (opt5) from DENV-3__FJ898474__SS-prME
accagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauacccggacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggcccucccggaggaacaggaccagaauuauguguguaaacacaccuacguggaucggggcugggggaacggaugcggccuguucgggaagggaagccuugugaccugcgcuaaguuucaaugucuggagcccauugagggcaaagugguucaguaugaaaaucucaaguacacagugaucaucaccguccauacaggggaccagcaccaggugggaaacgagacgcaaggcguuaccgccgaaauuacaccucaggcuucuaccacagaggccauccugcccgaauauggcacccuggggcucgagugcuccccucgcacgggacuggacuucaaugagaugauucuucugaccaugaaaaacaaggccuggauggugcauagacagugguuuuucgaucucccccugccguggacaagcggcgcuaccacagaaaccccuacguggaaucggaaagagcuucuggucacauuuaagaacgcgcacgccaaaaagcaagaaguggucgugcucgggucucaggagggagcuaugcacaccgcccugacaggcgccaccgaaauccaaaauuccgggggcaccagcauuuucgcuggacaucugaagugucgccucaaaauggacaagcuggagcuuaaaggcaugucuuacgccaugugcacaaacacguuuguucugaagaaagagguguccgaaacccagcacgggacaauccucaucaaggucgaguacaagggagaagaugugcccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucggcgggguucucaacagccuggggaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacaucauuggaguucuggagcagggcaaacggacgcuuaccccucagcccauggagcugaaguacucuuggaaaacaugggggaaggccaagaucaugaccgcugaaacacaaaacuccagcuucauuaucgauggaccuaauacccccgagugcccgucugcguccagagccuggaacgugugggaagucgaggacuauggcuuuggcguguucacaaccaauaucuggcucaaacugcgcgaaguguacacgcagcugugugaccaccggcuuaugagcgcugccauuaaggaugagagagccguccacgcugacaugggguacuggaucgagucccagaaaaacggaucuuggaagcucgaaaaagccagccugauugagguuaagacaugcaccuggccuaagucccauacccuguggucuaauggcgugcucgaaagcgauaugaucauucccaaagggcuggcgggaccuaucucccagcacaaccaucgccccggcuaucacacacaaaccgcugggccuuggcaccuuggaaagcuggagcucgacuuuaauuacugcgagggcacgacaguggucaucaccgaaaacuguggcacacgggggcccagccugagaaccacaaccgugucuggaaaacugauucaugaguggugcugucgcuccugcacgcuuccgccucuccgguauaucggcgaagauggguguugguacggaauggagauuagacccaucagcgaaaaggaggagaauaugguuaaaucucugguguccgccggcagcgggaaggucgacaacuucaccaugggagugcugugccucgccauucuguuugaagagguuaugcggggcaaguucggcaaaaagcacaugaucgcugggguguucuuuacauucguccuucugcucucuggacagauuaccuggcgcgauauggcccauacacugaucaugaucggcagcaaugcguccgacagaauggggaugggagugaccuaucuggcucuuauugccacguuuaaaauccagcccuuccuggcccucggcuuuuuccugcggaagcucacaagcagagaaaaccugcuucuggggguuggacucgcuauggccaccacacugcaacugccugaggauauugaacagauggcuaauggcaucgcccuuggccugauggcgcucaaacugauuacccaguuugagaccuaccagcucuggacagcccugaucucucuuacguguuccaacaccaucuucacacugaccguggcuuggcgcacagccacccucauucuggcuggggucagccugcuuccggugugccaauccucuagcaugcggaagacggacuggcugcccauggccguggccgcuaugggagucccuccccucccucuguuuaucuucucccucaaggauacacugaaaagacgcucuuggccccuuaaugagggcguuauggcgguggggcuggugagcauucuggccuccucucuccugagaaacgacgucccuauggcuggaccccuuguggccggcgggcugcucaucgccuguuauguuauuaccggaaccagcgcugaucugacaguggaaaaggccgcggacaucaccugggaggaagaggcugaacagacaggcgucucccacaaccucaugaucacgguggacgaugacggcaccaugcggauuaaagaugacgagacagagaauauccugaccguucuucugaagacagcccugcucauugugagcgggaucuuuccguacucuauuccugccacccugcuugucuggcauacguggcagaaacagacccaacgcuccggagugcugugggauguccccagcccucccgaaacacagaaggcugagcucgaagagggcguguacagaaucaaacagcaggggauuuucggaaagacccaaguuggcguggggguccagaaggagggaguguuucacacaauguggcacguuacccggggcgccgugcugacauauaacggcaaacgccucgaaccgaauugggcgucugucaagaaagaccugaucuccuacgggggaggcuggagacuuagcgcucaguggcaaaagggggaggaaguccaggugaucgccguugagccuggcaagaaccccaagaauuuccagacgaugccuggcaccuuccagacaauuaccggggaaaucggagccauugcucuggauuuuaagcccggcaccucuggcucccccaucauuaaccgggaggggaaagucgugggacuguauggcaaugggguggucacaaagaacggaggcuacgugagcgggaucgcccaaacgaaugcugagccugacggcccgacccccgaacucgaggaagagauguucaaaaagcgcaaccugacaaucauggaucuucauccuggauccggcaaaaccagaaaguaucugcccgccauuguucgggaagcgaucaagcgcagacuccggacacugauucucgccccuaccagaguggucgcugccgagauggaggaagcucugaaagggcuucccauccgcuaccagacgacagccaccaagagcgagcacaccggacgggaaauuguggaccugaugugccaugccacauuuaccaugagacugcucucuccuguucgcgugccgaauuauaaccugaucaucauggaugaggcucacuucacagaccccgcgagcauugccgcucggggcuacaucuccaccagagucgggaugggagaagccgccgcuauuuuuaugacggccacaccucccggcaccgcggaugcuuucccucagucuaaugcccccauccaggacgaggagcgcgacauuccggaacggagcuggaacuccgggaaugaguggaucacagauuuugccggcaaaaccgugugguucguuccuucuauuaaggcuggaaacgacaucgccaacugucuucgcaaaaauggcaagaaggugauccaacugagcagaaaaacguuugauaccgaauaccagaagacaaaacucaacgacugggauuucgucgugaccacagacauuuccgagaugggggcgaauuuuaaggccgaucgggugaucgaccccagacggugccugaaacccgucauucugaccgauggaccugagcgcguuauccucgcuggccccaugccugugacagccgcuucugccgcucagagacgggggcgcgugggaagaaacccgcagaaggaaaaugaccaauauauuuucaccggccagccccuuaacaaugaugaggaccaugcccacuggacggaagcgaagaugcugcuggacaacaucaauacaccugaggggaucauucccgcccucuucgaaccugagcgggagaaaagcgcugccaucgauggcgaauacagacugaagggagagucccgcaaaaccuuugucgaacuuaugcggagaggcgaccugcccguguggcucgcucacaagguugccagcgaggggauuaaauauaccgaucgcaaguggugcuucgacggacagcggaacaaucagauccuggaagagaacauggauguggagauuuggacaaaagaaggcgagaagaagaaacugagaccgcgcuggcucgacgcccggaccuacucugauccucuugcucugaaggaauuuaaagacuucgcggccgggagaaaguccaucgcucuggaucucgucacagagaucggacgcgugcccagccaucuggcccacagaacgcggaaugcccuugacaaccugguuaugcuccauaccucugaacacggcggccgcgcuuauagacacgccguggaggagcugccugaaacaauggagacccugcuccuucuggggcugaugauucuccugacaggaggcgcgaugcuuuuucugaucuccgggaaaggaauuggcaagaccagcaucgggcucauuugugucaucgccuccucuggaaugcuguggauggcugaaauuccccugcaauggaucgccagcgcuaucgugcucgaguucuuuaugaugguccuucugauuccugagcccgaaaagcagcggacgccgcaggauaaucaacuggccuacgugguuaucggcauucucacccuggcggccaucauugcugccaacgagaugggccuucuggaaacaaccaaacgcgaccucgggauguccaaggagccuggaguggugagccccacaucuuaucuggaugucgaccugcaucccgcuuccgccuggacccucuacgcuguugccacgacagugaucaccccuaugcuuagacacacaaucgaaaauagcaccgcgaacgugucucuggccgcuauugccaaccaggcugucgugcugaugggccucgacaaaggguggccgaucagcaagauggaucugggaguuccccuucuggcccucggcugcuacucccaggugaauccucugacccugacagccgcgguccuccuucugauuacgcauuaugcuaucauugggcccggacugcaggccaaagcuacccgggaggcccaaaagagaacagccgcuggcaucaugaagaacccuaccguggacggcaucaugacaauugaucucgaccccgucaucuacgauucuaaauucgagaagcagcugggacaggugaugcuucugguucucugugccgugcagcugcugcucaugcgcaccagcugggcgcuuugcgaagcccugacgcuggcuacaggaccuauuaccacccucugggagggcuccccggggaaauuuuggaauacaaccaucgccgucucuauggcuaacauuuuccggggaagcuaucuggccggcgcggggcuugccuuuuccaucaugaaaagcgugggaacaggcaaaagaggcacggggucucaaggagaaacccugggcgagaaguggaagaaaaagcucaaucagcugucccgcaaagaguucgaccuguacaagaaaagcgggauuacagagguugaucggaccgaggcuaaggaaggacucaaaagaggcgagacaacccaccaugccgugucccgggggucugcuaaacuucagugguuugucgaacgcaacauggugauccccgagggaagagugaucgaccugggcuguggcagagggggauggagcuauuacugcgccggccugaagaaaguuacggaaguccgcggguauaccaagggaggcccugggcacgaggagcccgugccuauguccacauacggauggaauauugugaaacucaugucuggcaaggaugucuucuaccugcccccggaaaaaugugacacccuucugugcgauaucggcgagagcuccccuagccccacaguugaagagucuagaaccauucgggugcucaagaugguggagcccuggcugaagaacaaucaguucuguaucaaaguccugaacccuuauaugcccacagugauugaacaccucgagcgccuucaaagaaagcaugggggaaugcugguucggaauccucugucccgcaacagcacccacgaaauguacuggaucucuaauggcacggggaacaucguggcuuccgucaauauggugagcagacuccugcuuaaccgguuuacaaugacccauagacgcccgaccauugagaaagacguugaucugggagccggcacacggcacgugaacgcggaacccgagacgccuaauauggacgucaucggggagagaauuaagcgcaucaaagaagaacacaacucuaccuggcauuaugacgaugaaaaucccuacaagacaugggccuaucacggaagcuacgaggugaaggcuaccggcuccgccucuagcaugauuaacggcguggucaaacuccugacaaagccuugggacguugugcccauggugacccagauggcuaugacagauaccacgccguucgggcagcaacgggucuuuaaagaaaagguggacaccagaacaccucgcuccaugcccggaacccggagaguuaugggcaucacagccgaguggcuguggcgcacccucgggcggaauaaaaagccuagacugugcacgcgcgaggaguucacaaagaaagugcggaccaacgccgcgaugggagcugucuuuacagaggaaaaucagugggauagcgccaaggccgcuguggaggacgaagauuucuggaaacuuguugacagagagcgcgagcugcauaagcucggcaaauguggguccugcguguauaacaugaugggcaagagagagaagaagcugggagaguuuggcaaggccaaagggucucgggcuaucugguacauguggcuuggagcccgcuaccuggaguucgaggcgcucggcuuucugaaugaggaucacugguucagcagagaaaacuccuauucuggggucgagggagaaggccugcauaagcucggguacauucugcgggacaucagcaaaauucccggcggagccauguaugcugaugacaccgccggcugggacacgagaaucaccgaggaugaccuucacaaugaagagaagauuacacagcagauggauccugagcaccggcaacuggcuaacgccaucuuuaaacucaccuaccagaauaaggugguuaaggugcagcgccccacaccgaccgggacagucauggacaucauuuccagaaaagaucagcggggaucuggccaaguggggaccuauggacugaacacguucacaaauauggaagcgcagcuuauccgccagauggagggcgaagggguccugagcaaggccgaccucgaguccccucaucugcccgagaaaaagauuacccaguggcuggagaccaaaggcguggagagacucaagcggauggcuaucagcggagaugacugcguugugaagcccauugaugaccgcuuugccaacgcucugcuugcccugaacgauaugggcaaagucagaaaggacaucccucaauggcagccgucuaaaggguggcacgauuggcaacaggugcccuucuguucccaucacuuccacgaacucauuaugaaggacggacggaaacuggugguuccuugccgcccccaagacgagcuuaucggcagagcucggaucagccagggggccggauggucucugcgcgaaacagcgugucucggcaaggccuacgcucagauguggucccugauguauuuucauagacgggaucugcgccucgccagcaaugccauuugcucugcugugccuguccacugggugcccaccuccagaacaacguggagcauccaugcccaccaucaauggaugaccacagaggacaugcugaccguuuggaaccggguguggauugaagauaauccuuggauggaggacaagacacccgucaccacgugggagaacgugccguaccuugggaaaagagaagaucagugguguggcucccugaucggacucaccagccgcgcgacaugggcucagaauauuccuaccgccauccagcaaguccggucucugaucggcaacgaggaguuccuugacuacaugcccagcaugaagagauuucgcaaagaggaggaauccgagggggccauuugguga

SEQ ID NO: 20821 - RNA, 9873 nt, Artificial Sequence
  derived and/or modified CDS sequence (opt5) from DENV-3__EU529688__SS-prME
acaagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggagaugugcgacgauacagugaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacacgaucggagugcuggagcagggcaaacggacccuuacaccucagcccauggagcugaaguacucuuggaaaaccugggggaaggccaagauugucacagccgaaacccaaaacuccagcuucaucauugauggaccuaauacacccgagugcccgucugcuuccagagcguggaacgugugggaaguggaggacuauggcuuuggcgucuucaccacgaauaucuggcucaaacugcgcgaaguuuacacacagcugugugaccaccggcuuaugagcgccgcugugaaggaugagagagccgugcacgccgacaugggguacuggaucgagucccagaaaaacggaucuuggaagcucgaaaaagcuagccugauugaggucaagaccugcaccuggccuaagucccauacacuguggucuaauggcgugcucgaaagcgauaugaucauucccaaaucccuggccgggccuaucagccagcacaacuaucgccccggauaccauacccaaacggcgggcccuuggcaccuugggaagcuggagcucgacuuuaauuauugcgagggaacaaccguugugauuacagaaaacuguggcacccggggccccucucugagaacaaccacggucuccgggaaacugauccacgaguggugcugucgcagcugcacccuuccgccucuccgguacaugggagaagauggcuguugguaugggauggagaucagacccauuucugaaaaggaggagaauauggugaaaucccugguuagcgcuggaucuggcgaaguggacaacuucacaauggggguccugugccucgccauccuguuugaggaagugaugcggggaaaguucggcaagaaacauaugauugccggcguuuucuuuaccuucgugcuucugcucagcgggcagaucacauggcgcgauauggcucacacccugauuaugaucggauccaaugccagcgacagaaugggcaugggggucacguaccuggcgcuuauugcuacauuuaagauccagcccuuccuggcccucggauuuuuccugcggaaacucaccucuagagagaaccugcuucugggcguggggcucgccauggcuacaacccugcaacugccugaagauaucgagcagauggccaauggaauugcucuuggccugauggcccucaagcugaucacccaguuugagacauaucagcucuggacggcgcugauuucccuuaccuguagcaacacaaucuucacccugacaguggccuggcgcaccgcuacgcucauucuggccggcgucucccugcuuccgguuugccaaucuagcuccaugcggaaaacagacuggcugcccaugaccguggcugccaugggggugccuccccucccucuguuuaucuucucucucaaggauacccugaagagacgcagcuggccccuuaaugaaggagucauggccgugggccugguuuccauccuggcuucuagccuccugagaaacgacgugccuauggcggggccccuugucgccggaggccugcucauugcuuguuacgugaucacagggaccuccgccgaucugacaguugagaaagccgcugacgugacgugggaagaggaagccgagcagaccggagucagccauaaccucaugauuacaguggacgaugacggcaccaugcggaucaaggaugacgagacagaaaauauucugaccguccuucugaaaacggcgcugcucaucgugucuggcaucuuuccguacuccauuccugcuacccugcuuguuuggcacacauggcagaagcagacccaacgcagcggggugcugugggauguccccucuccucccgagacacagaaagccgaacucgaggagggaguguauagaaucaagcagcagggcauuuucgggaaaacccaaguuggagugggcguccagaaggaagggguguuucauacaauguggcacgugacgcggggagccguucugaccuacaacggcaagcgccucgagccgaauugggcuuccgucaaaaaggaccugaucagcuauggcgggggauggagacuuucugcccaguggcaaaaaggcgaagagguccaggugauugcggucgaaccugggaagaaccccaaaaauuuccagacaaugccuggaaccuuccagaccacaacgggcgagaucggggcuauugcccuggauuuuaagcccggaaccuccggcagccccaucaucaaccgggagggcaaggugguugggcuguacggaaauggcguggucaccaagaacgggggauauguguccggcauugcccaaaccaaugcugaaccugacgggccgacacccgagcucgaagaggaaauguucaagaaacgcaaccugaccaucauggaucuucacccuggcagcggaaagacgagaaaauaccugcccgccauuguucgggaggcuaucaagcgcagacuccggacacugauucucgccccuaccagaguggucgcggccgagauggaagaggcucugaagggccuucccauccgcuaucagaccacagccaccaaaucugaacauacagggcgggagaucguggaccugaugugccacgcuaccuuuacgaugagacugcucagcccuguucgcgugccgaauuacaaccugauuaucauggaugaagcccauuucacagaccccgccuccauugcugcgcggggauacaucucuaccagagucggcaugggggaggccgcugccauuuuuaugacagccaccccucccggaacggcugaugccuucccucagagcaaugcgcccauccaggacgaggaacgcgacaucccggagcgguccuggaacucuggcaaugaauggauuaccgauuuugcugggaagacagugugguucgugccuagcaucaaagccggcaacgacauugccaacugucuuagaaagaauggcaaaaaggucauccaacugucccgcaagaccuuugauacagaguaucagaaaaccaagcucaacgacugggauuucguugugacaaccgacauuucugagaugggagcuaauuuuaaagccgaucgggugaucgaccccagacggugccugaagcccgucauucugacggaugggccugaacgcgugauccucgcgggacccaugccuguuacagccgcuagcgccgcucagagacggggccgcguggggagaaacccgcagaaagagaaugaccaauacaucuucaccggacagccccuuaacaaugaugaagaccacgcccauuggaccgaggcuaagaugcugcuggacaacauuaauacaccugaaggcaucauucccgcccucuucgagccugagcgggaaaaguccgcggccaucgauggggaguauagacugaaaggcgaaagccgcaagaccuuugucgagcuuaugcggagaggagaccugcccguguggcucgcucacaaaguugccucugaaggcauuaaguacacagaucgcaaauggugcuucgacgggcagcggaacaaucagauccuggaggagaacauggauguggaaaucuggacgaaggagggagagaagaagaagcugagaccgcgcuggcucgacgcucggaccuauuccgauccucuugcccugaaagaguuuaaggacuucgccgcuggcagaaaaagcauugcgcuggaucucgucacagaaaucgggcgcgugcccucucaccuggcccauagaacccggaaugcucuugacaaccuggucaugcuccacacauccgagcauggaggcaaggccuaccgccacgccguggaggaacugccugagaccauggaaacgcugcuccuucugggccugaugauucuccugaccgggggagcuaugcuuuuucugaucagcggcaaagggauuggaaagacauccaucggccucaucuguguuauugccucuagcgggaugcuguggauggcggagaucccccugcaauggauugccuccgcuaucgugcucgaguucuuuaugauggugcuucugauuccugaacccgagaagcagagaaccccgcaggauaaucaacuggccuaugucguuaucggcauucucacacuggcugccaucaucgcggccaacgaaaugggccuucuggagaccacgaaacgggaccucggcaugagcaaggaaccugggguggugucucccacauccuaccuggaugucgaccugcaccccgcuagcgccuggacccucuacgcuguggccacaaccguuauuaccccuaugcuucgccauacaaucgaaaauucuacggcuaacgugagccuggccgcgauugccaaccaggcugucgugcugaugggacucgacaaaggcuggccgaucuccaagauggaucugggggucccccuucuggcccucggaugcuauucucaggugaauccucugacccugacagcugccguucuccuucugauuacccacuacgccaucaucggccccgggcugcaggcgaaagcuacaagagaggcccaaaagcggaccgcugccggaauuaugaagaacccuacgguggacggcaucaugacaauugaucucgaccccgucaucuaugauagcaaauucgagaagcagcugggccaggugaugcuucugguucucugugccgugcagcugcugcucaugagaaccuccugggcucuuugcgaggcccugacccuggcgacagggccuauuaccacacucugggaaggaucuccgggcaaauuuuggaauacgaccaucgccgucagcauggcuaacaucuuccgcggguccuaccuggccggagcuggccuugccuuuagcauuaugaagucuguggggacaggaaaacggggcaccggcucccaaggggagacacugggagaaaaguggaagaaaaagcucaaucagcugagcagaaaagaguucgaccuguauaagaaauccggcaucaccgagguggaucgcacggaagcgaaggaggggcucaaacggggagaaauuacccaucacgccguuucuagaggcagcgcuaaacuucagugguuugucgagcggaacauggugauccccgaagggcgcgugauugaccugggauguggcagaggcgggugguccuacuauugcgccggacugaagaaagucacagagguucggggcuacaccaaagggggaccuggccaugaggaacccgugccuaugucuacauacggguggaauaucgugaaacucaugagcggaaaggaugucuucuaucugcccccggagaaaugugacacccuucugugcgauauuggcgaauccagcccuucucccacaguggaggagucccgcaccaucagaguucucaagaugguggaacccuggcugaagaacaaucaguucuguaucaaaguccugaacccuuacaugcccacggugauugagcaccucgaacggcuucaacgcaagcacggcgggaugcugguuagaaauccucugagccggaacucuacacaugagauguauuggaucuccaauggaaccggcaacauuguggcuagcgucaauauggugucucgccuccugcuuaacagauuuaccaugacacaccggagaccgacgaucgaaaaagacguggaucugggggccggaacccgccaugucaacgcugagcccgagacaccuaauauggacguuauuggcgaacggaucaagagaaucaaagaggaacacaacagcaccuggcacuacgacgaugagaaucccuauaagacaugggccuaccauggguccuaugaagugaaggcgaccggaucugccagcuccaugauuaacggcguggucaaacuccugacaaagccuugggacgugguucccauggugacccagauggcuaugacggauaccacaccguucggccagcaacgcgucuuuaaagagaagguggacacccggacaccuagaagcaugcccgggacccgccggguuaugggaaucacggccgaguggcuguggagaacacucggccgcaauaaaaagccucggcugugcaccagagaagaguucacaaagaaagugcgcaccaacgcugccaugggggccgucuuuacggaagagaaucagugggauuccgcgaaggcugccguggaagacgaggauuucuggaaacuuguugaccgggagagagaacugcacaagcucggaaaauguggcucuugcguguacaacaugauggggaagcgcgagaaaaagcugggcgaauuuggaaaggccaaaggcagcagagcuauuugguacauguggcuuggggcccgguaucuggaguucgaggcucucggauuucugaaugaagaucauugguucucccgcgagaacucuuacagcggcgucgaaggggagggacugcacaagcucggcuauauccugagagacauuuccaaaauccccgggggcgccauguacgcggaugacaccgccggaugggacacacggaucaccgaagaugaccuucauaaugaggagaagauuacacagcagauggauccugaacacagacaacuggcuaacgccaucuuuaaacucaccuaucagaauaagguggucaaggugcagcggcccacaccgaccggcacgguuauggacauuaucucucgcaaagaucagagagggagcggacaagugggcacauacgggcugaacaccuucaccaauauggaggcucagcuuauucggcagauggaaggagagggcguccuguccaaggccgaccucgaaaacccucaucugcccgagaaaaagaucacacaguggcuggagaccaaagggguggaacgccucaagagaauggcgaucagcggcgaugacugcgugguuaagcccauugaugaccgguuugccaacgcucugcuugcccugaaugauaugggaaaagugcgcaaggacaucccucaauggcagccgucuaaaggcuggcaugauuggcagcagguccccuucuguucccaccauuuccacgagcucauuaugaaggacgggagaaaacuggugguuccuugccggccccaagacgaacuuaucggacgcgcuagaauuagccagggcgccggguggucucugcgggagacagcuugucucggaaaggccuaugcgcagauguggucccugauguacuuucaccgcagagaucugcggcucgccagcaacgcuaucugcucugccgugccuguccauugggugcccacgucccgcaccacauggagcauucacgcccaucaccaauggaugaccacagaagacaugcugaccgucuggaauagaguguggaucgaggauaacccuuggauggaggacaagacgcccguuaccacaugggaaaaugugccguaccuuggcaaacgggaggaucaguggugugggucccugaucggccucaccagcagagcuacaugggcccagaacauuccuaccgcgauccagcaaguccgcucucugauuggaaaugaagaguuccuugacuauaugcccagcaugaagcgguuuagaaaagaggaagaguccgaaggcgcuaucugguga

SEQ ID NO: 20822 - RNA, 9873 nt, Artificial Sequence
  derived and/or modified CDS sequence (opt5) from DENV-3__EU482613__SS-prME
accagccugugccucaugaugauccugcccgccgcucuugccuuccaccugacaucccgggacggcgagccucggaugauuguggggaagaacgaacgcggaaagucucuccuguuuaagacggcgagcggcaucaauauguguacccuuauugcuauggaucugggggaaaugugcgacgauacagugaccuacaaguguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacguacaacggcaagcgccucgagccgaauugggcuuccgucaaaaaggaccugauuagcuauggcgggggauggagacuuucugcccaguggcaaaaaggcgaagagguccaggugaucgcggucgaaccugggaagaaccccaaaaauuuccagaccaugccuggaacauuccagaccaccacaggcgagauuggggcuaucgcccuggauuuuaagcccggaacguccggcagccccaucauuaaccgggagggcaagaucguggggcuguacggaaauggcguugugaccaaaaacgggggauaugucuccggcauugcccaaacaaaugcugaaccugacgggccgacccccgagcucgaagaggaaauguucaagaaacgcaaccugacaaucauggaucuucacccuggcagcggaaagaccagaaaauaccugcccgccauugugcgggaggcuaucaagcgcagacuccggacgcugauccucgccccuacaagaguuguggcggccgagauggaagaggcucugaagggccuucccauucgcuaucagaccaccgccacaaaaucugaacauaccgggcgggagaucgucgaccugaugugccacgcuacauuuaccaugagacugcucagcccugugcgcguuccgaauuacaaccugauuaucauggaugaagcccauuucacggaccccgccuccauugcugcgcggggauacaucucuacaagagugggcaugggggaggccgcugccaucuuuaugaccgccacaccucccggaaccgcugaugccuucccucagagcaaugcgcccauucaggacgaggaacgcgacaucccggagcgguccuggaacucuggcaaugaauggauuacggauuuugcugggaagaccgucugguucgugccuagcaucaaagccggcaacgacauugccaacugucuuagaaagaauggcaaaaaggugauccaacugucccgcaagacauuugauaccgaguaucagaaaacaaagcucaacgacugggauuucgucguuaccacagacauuucugagaugggagcuaauuuuaaagccgaucgggugaucgaccccagacggugccugaagcccgugauccugaccgaugggccugaacgcgucauucucgcgggacccaugccugugacggccgcuagcgccgcucagagacggggccgcguugggagaaacccgcagaaagagaaugaccaauacaucuucacaggacagccccuuaacaaugaugaagaccacgcccauuggaccgaggcuaagaugcugcuggacaacauuaauaccccugaaggcaucauucccgcccucuucgagccugagcgggaaaaguccgcggccaucgauggggaguauagacugaaaggcgaaagccgcaagacauuuguggagcuuaugcggagaggagaccugcccgucuggcucgcucacaaaguggccucugaaggcaucaaguacaccgaucgcaaauggugcuucgacgggcagcggaacaaucagauucuggaggagaacauggauguugaaaucuggacaaaggagggagagaagaagaagcugagaccgcgcuggcucgacgcucggacguauuccgauccucuugcccugaaagaguuuaaggacuucgccgcuggcagaaaaagcauugcgcuggaucucgugaccgaaaucgggcgcguccccacacaccuggcccauagaacccggaaugcucuugacaaccuggugaugcuccacacaucugagcauggaggcaaggccuaccgccacgccgucgaggaacugccugagaccauggaaacgcugcuccuucugggccugaugauucuccugaccgggggagcuaugcuuuuucugaucuccggcaaagggaucggaaagacaagcauuggccucaucugugugauugccuccucugggaugcuguggauggcggagaucccccugcaauggauugccagcgcuaucguucucgaguucuuuaugauggugcuucugauuccugaacccgagaagcagagaaccccgcaggauaaucaacuggccuauguggucaucggaauccucacacuggcugccauuaucgcggccaacgaaaugggccuucuggagaccacgaaacgggaccucggcauguccaaggaaccugggguugugagccccacaucuuaccuggauguggaccugcaccccgcuuccgccuggacccucuacgcugucgccacaaccgugauuaccccuaugcuucgccauacaaucgagaauagcacggcuaacguuucucuggccgcgauugccaaccaggcugugguccugaugggacucgacaaaggcuggccgaucagcaagauggaucugggggugccccuucuggcccucggaugcuauucccaggucaauccucugacccugacagcugccgugcuccuucugaucacccacuacgccauuaucggccccgggcugcaggcgaaagcuacaagagaggcccaaaagcggaccgcugccggaauuaugaagaacccuacgguugacggcaucaugacaauugaucucgaccccgugaucuaugauucuaaauucgaaaagcagcugggccaggucaugcuucuggugcucugugccguucagcugcugcucaugagaaccagcugggcucuuugcgaggcccugacccuggcgacagggccuaucaccacacucugggaaggauccccgggcaaauuuuggaauacgaccauugccgugucuauggcuaacaucuuccgcgggagcuaccuggccggagcuggccuugccuuuuccauuaugaaaagcgucgggacaggaaaacggggcaccggcucucaaggggagacacugggagaaaaguggaagaaaaagcucaaucagcuguccagaaaagaguucgaccuguauaagaaaagcggcaucaccgagguggaucgcacggaagcgaaggaggggcucaaacggggagaaauuacccaucacgccguguccagaggcucugcuaaacuucagugguuuguugagcggaacauggucauccccgaagggcgcgugauugaccugggauguggcagaggcggguggagcuacuauugcgccggacugaagaaagugacagagguccggggcuacaccaaagggggaccuggccaugaggaacccguuccuauguccacauacggguggaauaucgugaaacucaugucuggaaaggauguguucuaucugcccccggagaaaugugacacccuucugugcgauaucggcgaaagcuccccuagccccacagucgaggagucucgcaccauuagagugcucaagaugguugaacccuggcugaagaacaaucaguucuguaucaaagugcugaacccuuacaugcccacggucauugagcaccucgaacggcuucaacgcaagcacggcgggaugcuggugagaaauccucugucccggaacagcacacaugagauguauuggaucucuaauggaaccggcaacauuguugcuuccgugaauauggucagccgccuccugcuuaacagauuuaccaugacacaccggagaccgacgaucgaaaaagacguggaucugggggccggaacccgccaugugaacgcugagcccgagacaccuaauauggacgucaucggcgaacggauuaagagaaucaaagaggaacacaacucuaccuggcacuacgacgaugagaaucccuauaagacaugggccuaccaugggagcuaugaaguuaaggcgaccggauccgccucuagcaugauuaacggcguggugaaacuccugacaaagccuugggacgucgugcccaugguuacccagauggcuaugacggauaccacaccguucggccagcaacgcguguuuaaagagaaggucgacacccggacaccuagauccaugcccgggacccgccgggugaugggaaucacggccgaguggcuguggagaacacucggccgcaauaaaaagccucggcugugcaccagagaagaguucacaaagaaaguucgcaccaacgcugccaugggggccguguuuacggaagagaaucagugggauagcgcgaaggcugccgucgaagacgaggauuucuggaaacuuguggaccgggagagagaacugcacaagcucggaaaauguggcuccugcguuuacaacaugauggggaagcgcgagaaaaagcugggcgaauuuggaaaggccaaaggcucuagagcuauuugguacauguggcuuggggcccgguaucuggaguucgaggcucucggauuucugaaugaagaucauugguucagccgcgagaacuccuacucuggcguggaaggggagggacugcacaagcucggcuauauccugagagacaucagcaaaauucccgggggcgccauguacgcggaugacaccgccggaugggacacacggaucaccgaagaugaccuucauaaugaggagaagauuacacagcagauggauccugaacacagacaacuggcuaacgccaucuuuaaacucaccuaucagaauaaggucgugaagguccagcggcccacaccgaccggcacggugauggacauuaucucccgcaaagaucagagagggucuggacaaguuggcacauacgggcugaacaccuucaccaauauggaggcucagcuuauccggcagauggaaggagagggcgugcugagcaaggccgaccucgaaaacccucaucugcccgagaaaaagauuacacaguggcuggagaccaaaggggucgaacgccucaagagaauggcgaucuccggcgaugacugcguggugaagcccauugaugaccgguuugccaacgcucugcuugcccugaaugauaugggaaaaguucgcaaggacaucccucaauggcagccgagcaaaggcuggcaugauuggcaacaggugcccuucuguucucaccauuuccacgagcucauuaugaaggacgggagaaaacuggucgugccuugccggccccaagacgaacuuaucggacgcgcuagaauuucccagggcgccggguggagccugcgggagacagcuugucucggaaaggccuaugcgcagauguggucucugauguacuuucaccgcagagaucugcggcucgccuccaacgcuaucugcagcgccguuccugugcauuggguccccacgucucgcaccacaugguccauccacgcccaucaccaauggaugaccacagaagacaugcugaccguguggaauagagucuggauugaggauaacccuuggauggaggacaagacgcccgugaccacaugggaaaauguuccguaccuuggcaaacgggaggaucaguggugugggagccugaucggccucaccuccagagcuacaugggcccagaacauuccuaccgcgauccagcaagugcgcagccugauuggaaaugaagaguuccuugacuauaugcccucuaugaagcgguuuagaaaagaggaagagagcgaaggcgcuaucugguga

SEQ ID NO: 20823 - RNA, 9873 nt, Artificial Sequence
  derived and/or modified CDS sequence (opt5) from DENV-3__EU529690__SS-prME
acaagccugugccucaugaugauccugcccgccgcucuugccuuccaccugacaucccgggacggcgagccucggaugauuguggggaagaaugaacgcggaaaaucucuccuguuuaagacggcgagcggcaucaauauguguacccuuauugcuauggaucugggggaaaugugcgacgauacagugaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacacagggugugucaucaauuggaaaggaaaggagcugaagugcggcagcgggauuuucgugacgaacgagguucauaccuggacagaacaguacaaauuucaagccgauucccccaagcggcuggcgaccgccaucgcuggcgccugggagaauggaguguguggcauuagaagcacaacccgcauggaaaaccuucucuggaaacagaucgcuaaugagcugaacuauauccugugggaaaauaacauuaagcucacggucgugguuggggacaucauuggagugcuggagcagggcaaacggacccuuacaccucagcccauggagcugaaguacucuuggaaaaccugggggaaggccaagaucgucacagccgaaacccaaaacuccagcuucauuaucgauggaccuaauacacccgagugcccgucugcuuccagagcguggaacgugugggaaguggaggacuauggcuuuggcgucuucaccacgaauaucuggcucaaacugcgcgaaguuuacacacagcugugugaccaccggcuuaugagcgccgcugugaaggaugagagagccgugcacgccgacaugggguacuggauugagucccagaaaaacggaucuuggaagcucgaaaaagcuagccugaucgaggucaagaccugcaccuggccuaagucccauacacuguggucuaauggcgugcucgaaagcgauaugauuauccccaaaucccuggccgggccuauuagccagcacaacuaucgccccggauaccauacccaaacggcgggcccuuggcaccuugggaagcuggagcucgacuuuaauuauugcgagggaacaaccguugugaucacagaaaacuguggcacccggggccccucucugagaacaaccacggucuccgggaaacugauccacgaguggugcugucgcagcugcacccuuccgccucuccgguacaugggagaagauggcuguugguaugggauggagauuagacccaucucugaaaaggaggagaauauggugaaaucccugguuagcgcuggaucuggcgaaguggacaacuucacaauggggguccugugccucgccauucuguuugaggaagugaugcggggaaaguucggcaagaaacauaugaucgccggcguuuucuuuaccuucgugcuucugcucagcgggcagauuacauggcgcgauauggcucacacccugaucaugauuggauccaaugccagcgacagaaugggcaugggggucacguaccuggcgcuuaucgcuacauuuaagauccagcccuuccuggcccucggauuuuuccugcggaaacucaccucuagagagaaccugcuucugggcguggggcucgccauggcuacaacccugcaacugccugaagauauugagcagauggccaauggaaucgcucuuggccugauggcccucaagcugauuacccaguuugagacauaucagcucuggacggcgcugaucucccuuaccuguagcaacacaauuuucacccugacaguggccuggcgcaccgcuacgcucauccuggccggcgucucccugcuuccgguuugccaaucuagcuccaugcggaaaacagacuggcugcccaugaccguggcugccaugggggugccuccccucccucuguuuaucuucaaucucaaggauacccugaagagacgcucuuggccccuuaacgaaggagucauggccgugggccugguuagcauucuggcuuccucucuccugagaaacgacgugccuauggcggggccccuugucgccggaggccugcucaucgcuuguuacgugauuacagggaccagcgccgaucugacaguugagaaagccgcugacgugacgugggaagaggaagccgagcagaccggagucucccauaaucucaugaucacaguggacgaugacggcaccaugcggauuaaggaugacgagacagaaaacauccugaccguccuucugaaaacggcgcugcucaucgugagcggcauuuuuccguacucuaucccugcuacccugcuuguuuggcacacauggcagaagcagacccaacgcuccggggugcugugggauguccccagcccucccgagacacagaaagccgaacucgaggagggaguguauagaauuaagcagcagggcaucuucgggaaaacccaaguuggagugggcguccagaaggaagggguguuucauacaauguggcacgugacgcggggagccguucugaccuacaauggcaagcgccucgagccgaacugggcuucugucaaaaaggaccugauuuccuauggcgggggauggagacuuagcgcccaguggcaaaaaggcgaagagguccaggugaucgcggucgaaccugggaagaaucccaaaaacuuccagacaaugccuggaaccuuccagaccacaacgggcgagauuggggcuaucgcccuggauuuuaagcccggaaccucuggcucccccaucauuaaucgggagggcaaggugguugggcuguacggaaacggcguggucaccaagaaugggggauaugugagcggcaucgcccaaaccaacgcugaaccugacgggccgacacccgagcucgaagaggaaauguucaagaaacgcaaucugaccauuauggaucuucacccuggcuccggaaagacgagaaaauaccugcccgccaucguucgggaggcuauuaagcgcagacuccggacacugauccucgccccuaccagaguggucgcggccgagauggaagaggcucugaagggccuucccauccgcuaucagaccacagccaccaaaagcgaacauacagggcgggagauuguggaccugaugugccacgcuaccuuuacgaugagacugcucucuccuguucgcgugccgaacuacaaucugaucauuauggaugaagcccauuucacagaccccgccagcaucgcugcgcggggauacauuuccaccagagucggcaugggggaggccgcugccaucuuuaugacagccaccccucccggaacggcugaugccuucccucagucuaacgcgcccauccaggacgaggaacgcgacauuccggagcggagcuggaacuccggcaacgaauggaucaccgauuuugcugggaagacagugugguucgugccuucuauuaaagccggcaacgacaucgccaauugucuuagaaagaacggcaaaaaggucauucaacugagccgcaagaccuuugauacagaguaucagaaaaccaagcucaaugacugggauuucguugugacaaccgacaucuccgagaugggagcuaacuuuaaagccgaucgggugauugaccccagacggugccugaagcccgucauccugacggaugggccugaacgcgugauccucgcgggacccaugccuguuacagccgcuucugccgcucagagacggggccgcguggggagaaauccgcagaaagagaacgaccaauacauuuucaccggacagccccuuaauaacgaugaagaccacgcccauuggaccgaggcuaagaugcugcuggacaauaucaacacaccugaaggcauuauccccgcccucuucgagccugagcgggaaaagagcgcggccauugauggggaguauagacugaaaggcgaaucccgcaagaccuuugucgagcuuaugcggagaggagaccugcccguguggcucgcucacaaaguugccagcgaaggcaucaaguacacagaucgcaaauggugcuucgacgggcagcggaauaaccagauccuggaggagaauauggauguggaaauuuggacgaaggagggagagaagaagaagcugagaccgcgcuggcucgacgcucggaccuauucugauccucuugcccugaaagaguuuaaggacuucgccgcuggcagaaaauccaucgcgcuggaucucgucacagaaauugggcgcgugcccacccaccuggcccauagaacacggaacgcucuugacaaucuggucaugcuccacaccagcgagcauggaggcaaggccuaccgccacgccguggaggaacugccugagacgauggaaacccugcuccuucugggccugaugauccuccugacagggggagcuaugcuuuuucugauuucuggcaaagggaucggaaagaccuccaucggccucauuuguguuaucgccagcuccgggaugcuguggauggcggagauuccccugcaauggaucgccucugcuauugugcucgaguucuuuaugauggugcuucugaucccugaacccgagaagcagagaacaccgcaggauaaccaacuggccuaugucguuauuggaauccucacccuggcugccaucauugcggccaaugaaaugggccuucuggagacgacaaaacgggaccucggcaugagcaaggaaccugggguggugucccccaccagcuaccuggaugucgaccugcaccccgcuucugccuggacacucuacgcuguggccaccaccguuaucacaccuaugcuucgccauacgauugagaacuccaccgcuaacgugagccuggccgcgaucgccaaucaggcugucgugcugaugggacucgacaaaggcuggccgauuucuaagauggaucugggggucccccuucuggcccucggaugcuauagccaggugaacccucugacacugaccgcugccguucuccuucugaucacacacuacgccaucauuggccccgggcugcaggcgaaagcuaccagagaggcccaaaagcggacggcugccggaaucaugaagaauccuacaguggacggcauuaugaccaucgaucucgaccccgucauuuaugauuccaaauucgaaaagcagcugggccaggugaugcuucugguucucugugccgugcagcugcugcucaugagaaccucuugggcucuuugcgaggcccugacacuggcgaccgggccuaucacaacgcucugggaaggaagcccgggcaaauuuuggaacaccacaaucgccgucuccauggcuaauauuuuccgcgggucuuaccuggccggagcuggccuugccuuuagcaucaugaaguccguggggaccggaaaacggggcacaggcagccaaggggagacccugggagaaaaguggaagaaaaagcucaaccagcugucuagaaaagaguucgaccuguauaagaaauccggcauuacggagguggaucgcaccgaagcgaaggaggggcucaaacggggagaaaucacacaucacgccguuagcagaggcuccgcuaaacuucagugguuugucgagcggaauauggugauucccgaagggcgcgugaucgaccugggauguggcagaggcggguggucuuacuauugcgccggacugaagaaagucaccgagguucggggcuacacaaaagggggaccuggccaugaggaacccgugccuaugagcaccuacggguggaacauugugaaacucauguccggaaaggaugucuucuaucugcccccggagaaaugugacacacuucugugcgauaucggcgaaucuagcccuucccccaccguggaggagagccgcacgaucagaguucucaagaugguggaacccuggcugaagaauaaccaguucuguauuaaaguccugaauccuuacaugcccacagugaucgagcaccucgaacggcuucaacgcaagcacggcgggaugcugguuagaaacccucugucuagaaauuccacccaugagauguauuggauuagcaacggaaccggcaauaucguggcuucugucaacauggugucccgccuccugcuuaacagauuuacaaugacgcaccggagaccgaccauugaaaaagacguggaucugggggccggaacacgccaugucaaugcugagcccgagaccccuaacauggacguuaucggcgaacggaucaagagaauuaaagaggaacacaauagcacauggcacuacgacgaugagaaccccuauaagaccugggccuaccaugggucuuaugaagugaaggcgacaggaagcgccuccucuaugaucaauggcguggucaaacuccugaccaagccuugggacgugguucccauggugacgcagauggcuaugaccgauacaaccccguucggccagcaacgcgucuuuaaagagaagguggacacacggaccccuagaagcaugcccgggacgcgccggguuaugggaauuacagccgaguggcuguggagaacccucggccgcaacaaaaagccucggcugugcacaagagaagaguucaccaagaaagugcgcacgaaugcugccaugggggccgucuuuaccgaagagaaccagugggauuccgcgaaggcugccguggaagacgaggauuucuggaaacuuguugaccgggagagagaacugcacaagcucggaaaauguggcagcugcguguacaauaugauggggaagcgcgagaaaaagcugggcgaauuuggaaaggccaaaggcuccagagcuaucugguacauguggcuuggggcccgguaucuggaguucgaggcucucggauuucugaacgaagaucauugguucucucgcgagaauagcuacuccggcgucgaaggggagggacugcacaagcucggcuauauucugagagacaucucuaaaauccccgggggcgccauguacgcggaugacacagccggaugggacacccggauuacagaagaugaccuucauaacgaggagaagaucacccagcagauggauccugaacacagacaacuggcuaaugccauuuuuaaacucacauaucagaacaagguggucaaggugcagcggcccaccccgacgggcacaguuauggacaucauuagccgcaaagaucagagaggguccggacaagugggcaccuacgggcugaauaccuucacaaacauggaggcucagcuuauccggcagauggaaggagagggcguccugucuaaggccgaccucgaaaacccucaucugcccgagaaaaagaucacccaguggcuggagacaaaagggguggaacgccucaagagaauggcgauuagcggcgaugacugcgugguuaagcccaucgaugaccgguuugccaaugcucugcuugcccugaacgauaugggaaaagugcgcaaggacauuccucaauggcagccguccaaaggcuggcaugauuggcagcagguccccuucuguagccaccauuuccacgagcucaucaugaaggacgggagaaaacuggugguuccuugccggccccaagacgaacuuauuggacgcgcuagaaucucucagggcgccggguggucccugcgggagacggcuugucucggaaaggccuaugcgcagauguggagccugauguacuuucaccgcagagaucugcggcucgccucuaaugcuauuugcuccgccgugccuguccauugggugcccaccagccgcacaaccuggucuauccacgcccaucaccaauggaugacaaccgaagacaugcugacggucuggaacagaguguggaucgaggauaauccuuggauggaggacaagacccccguuacaaccugggaaaacgugccguaccuuggcaaacgggaggaucaguggugugggucccugauuggccucacaagcagagcuaccugggcccagaauaucccuacggcgauucagcaaguccgcucccugaucggaaacgaagaguuccuugacuauaugcccagcaugaagcgguuuagaaaagaggaagagucugaaggcgcuauuugguga

SEQ ID NO: 20824 - RNA, 9873 nt, Artificial Sequence
  derived and/or modified CDS sequence (opt5) from DENV-3__EU529691__SS-prME
accagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacacagacgggacaagcgcucuguggcccuggcuccucauguggggaugggacuggauaccagaacacagaccuggaugagcgccgaaggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacggccaagggaaggcgcauuccggaagacugaucacagcuaaccccguugugaccaaaaaggaggaacccgucaauauugaggccgaaccuccguucggcgagucuaacaucgugauugggaucggcgauaaugcccugaaaaucaacugguauaagaagggaagcuccauuggcaaaauguuugaagcuacggccagaggggcuagacgcauggccauccuuggagacacagcgugggauuucggcagcgucgggggaguucucaauucucugggcaagaugguccaccagauuuuuggguccgccuacaccgcucuguucagcggcgugucuugggugaugaaaaucggaauuggcguccuccugaccuggaucgggcuuaacagcaagaauacauccaugucuuuuagcugcauugccgugggaaucaucacccuguaucucggcgcuguugugcaggccgacauggggugugucauuaacuggaaaggaaaggagcugaagugcggcuccgggaucuucgugacaaaugagguucauacguggaccgaacaguacaaauuucaagcggauagccccaagcggcuggccacagcuauugccggcgcuugggagaacggaguguguggcaucagaucuaccacacgcauggaaaaucuucucuggaaacagauugccaacgagcugaauuauauccugugggaaaacaauaucaagcucaccgucgugguuggggacauuaucggagugcuggagcagggcaaacggacgcuuaccccucagcccauggagcugaaguacuccuggaaaacaugggggaaggccaagauugucaccgcugaaacacaaaacagcucuuucaucauugauggaccuaacacccccgagugcccguccgcgagcagagccuggaaugugugggaaguggaggacuauggcuuuggcgucuucacaaccaacaucuggcucaaacugcgcgaaguuuacacgcagcugugugaccaccggcuuauguccgcugccgugaaggaugagagagccgugcacgcugacaugggguacuggaucgagucucagaaaaauggaagcuggaagcucgaaaaagccucccugauugaggucaagacaugcaccuggccuaagucucauacccuguggagcaacggcgugcucgaauccgauaugaucauucccaaaagccuggcggggccuaucucucagcacaaucaucgccccggauaucacacacaaaccgcuggcccuuggcaccuugggaagcuggagcucgacuuuaacuacugcgagggaacgacaguugugauuaccgaaaauuguggcacacggggccccucccugagaaccacaaccgucagcgggaaacugauccaugaguggugcugucgcucuugcacgcuuccgccucuccgguauaugggagaagauggcuguugguacgggauggagaucagacccauuuccgaaaaggaggagaacauggugaaaagccugguuucugccggaagcggcaagguggacaauuucaccauggggguccugugccucgccauccuguuugaagaggugaugcggggaaaguucggcaaaaagcacaugauugcuggcguuuucuuuacauucgugcuucugcucuccgggcagaucaccuggcgcgauauggcccauacacugauuaugaucggaagcaacgcgucugacagaaugggcaugggggucaccuaucuggcucuuauugccacguuuaaaauccagcccuuccuggcccucggauuuuuccugcggaagcucacauccagagaaaaucugcuucugggcguggggcucgcuauggccaccacacugcaacugccugaggauaucgaacagauggcuaacggaauugcccuuggccugauggcgcucaaacugaucacccaguuugagaccuaccagcucuggacagcccugauuagccuuacguguuccaauaccauguucacacugaccguggcuuggcgcacagccacccucauccuggcuggcgucucucugcuuccgguuugccaaagcuccucuaugcggaagacggacuggcugcccauggccguggccgcuaugggggugccuccccucccucuguuuauuuucagccucaaggauacacugaaaagacgcuccuggccccuuaacgagggagucauggcggugggccugguuucuauccuggccagcucccuccugagaaaugacgugccuauggcugggccccuugucgccggaggccugcucaucgccuguuaugugauuaccgggaccagcgcugaucugacaguugaaaaggccgcggacaucaccugggaggaagaggcugaacagacaggagugucucacaaccucaugauuacggucgacgaugacggcaccaugcggaucaaagaugacgagacagagaacauucugaccgugcuucugaagacagcccugcucaucgucuccggcguguuuccguacagcaucccugccacccugcuuguuuggcauacguggcagaaacagacccaacgcucuggggugcugugggauguccccuccccucccgaaacacagaaggcugagcucgaagagggaguguacagaauuaaacagcagggcaucuucgggaagacccaaguuggagugggcguccagaaggaggggguguuucacacaauguggcacgugacccggggagccguucugacauauaauggcaaacgccucgaaccgaacugggcgagcgucaagaaagaccugauuucuuacggcgggggauggagacuuuccgcucaguggcaaaagggcgaggaaguccaggugaucgccgucgagccugggaaaaaucccaagaacuuccagacgaugccuggaaccuuccagacaaccaccggcgaaauuggggccaucgcucuggauuuuaagcccggaacaagcggcucccccauuaucaaucgggagggcaaagugguugggcuguauggaaacggcguggucacgaagaaugggggauacgugagcggcaucgcccaaaccaacgcugagccugacgggccgacacccgaacucgaggaagagauguucaaaaagcgcaaucugaccauuauggaucuucauccuggcucuggaaaaacaagaaaguaucugcccgccaucguucgggaagcgauuaagcgcagacuccggacccugauccucgccccuacgagaguggucgcugccgagauggaggaagcucugaaaggccuucccauucgcuaccagacaaccgccaccaagagcgagcacacagggcgggaaaucguggaccugaugugccaugccaccuuuacaaugagacugcucuccccuguucgcgugccgaacuauaaucugaucauuauggaugaggcucacuucaccgaccccgcgucuaucgccgcucggggauacauuagcacgagagucggcaugggggaagccgccgcuaucuuuaugacagccaccccucccggaacagcggaugcuuucccucaguccaacgcccccauucaggacgaggagcgcgacaucccggaacggucuuggaauagcggcaacgaguggaucaccgauuuugccgggaaaacggugugguucgugccuuccauuaaggcuggcaaugacaucgccaacugucuucgcaaaaacggaaagaaggucauucaacugucuagaaaaaccuuugauacagaauaccagaagaccaaacucaaugacugggauuucguugugacaaccgacaucagcgagaugggcgcgaacuuuaaggccgaucgggugauugaccccagacggugccugaaacccgucauccugacagaugggccugagcgcgugauucucgcuggacccaugccuguuaccgccgcuuccgccgcucagagacggggccgcguggggagaaauccgcagaaggaaaacgaccaauauaucuucacgggacagccccuuaauaacgaugaggaccaugcccacuggacagaagcgaagaugcugcuggacaauaucaacaccccugagggcauuauccccgcccucuucgaaccugagcgggagaaaagcgcugccauugauggggaauacagacugaagggcgagucucgcaaaaccuuugucgaacuuaugcggagaggagaccugcccguguggcucgcucacaagguugccuccgagggcaucaaauauacagaucgcaaguggugcuucgacgggcagcggaauaaccagauucuggaagagaauauggauguggagaucuggaccaaagaaggagagaagaagaaacugagaccgcgcuggcucgacgcccggacauacagcgauccucuugcucugaaggaauuuaaagacuucgcggccggcagaaagucuaucgcucuggaucucgucacggagauugggcgcgugcccucccaucuggcccacagaacccggaacgcccuugacaaucuggucaugcuccauacaagcgaacacggaggccgcgcuuauagacacgccguggaggagcugccugaaaccauggagacacugcuccuucugggccugaugauccuccugaccgggggagcgaugcuuuuucugauuuccggcaaagggaucggaaagacgucuauuggccucaucuguguuaucgccagcuccgggaugcuguggauggcugaaauuccccugcaauggaucgccagcgcuauugugcucgaguucuuuaugauggugcuucugaucccugagcccgaaaagcagcggaccccgcaggauaaccaacuggccuacgucguuauuggaauccucacacuggcggccauuaucgcugccaaugagaugggccuucuggaaaccacaaaacgcgaccucggcaugucuaaggagccugggguggugucccccaccagcuaucuggaugucgaccugcaucccgcuucugccuggacgcucuacgcuguggccacaaccguuaucacaccuaugcuuagacacaccauugaaaacagcaccgcgaaugugucccuggccgcuaucgccaaccaggcugucgugcugaugggacucgacaaaggcuggccgauuucuaagauggaucugggggucccccuucuggcccucggaugcuacagccaggugaacccucugacacugacggccgcgguucuccuucugaucacccauuaugcuauuaucggccccgggcugcaggccaaagcuacacgggaggcccaaaagagaaccgccgcuggaaucaugaagaauccuacaguggacggcauuaugaccaucgaucucgaccccgucauuuacgauuccaaauucgagaagcagcugggccaggugaugcuucugguucucugugccgugcagcugcugcucaugcgcacgucuugggcgcuuugcgaagcccugacacuggcuaccgggccuaucaccacacucugggagggaagcccgggcaaauuuuggaacaccacaauugccgucuccauggcuaauaucuuccgggggagcuaucuggccggagcgggccuugccuuuucuaucaugaaguccguggggacgggaaaaagaggcaccggcagccaaggggaaacacugggagagaaguggaagaaaaagcucaaccagcugucccgcaaagaguucgaccuguacaagaaaucuggcauuaccgagguggaucggacagaggcuaaggaagggcucaaaagaggagagaccacgcaccaugccguuagccggggcuccgcuaaacuucagugguuugucgaacgcaauauggugauccccgaggggagagugauugaccugggauguggccggggcggguggucuuauuacugcgccggacugaagaaagucaccgaaguucgcggcuauacaaaagggggaccuggccacgaggagcccgugccuaugagcaccuacggguggaacaucgugaaacucauguccggaaaggaugucuucuaccugcccccggaaaaaugugacacacuucugugcgauauuggcgagagcucuccuucccccaccguggaagagagcagaacaauccggguucucaagaugguggagcccuggcugaagaauaaccaguucuguauuaaaguccugaauccuuauaugcccaccgugaucgaacaccucgagcgccuucaaagaaagcauggcgggaugcugguucggaacccucugucucgcaauuccacgcacgaaauguacuggaucagcaacggaacaggcaauauuguggcuucugucaacauggugagcagacuccugcuuaaucgguuuaccaugacccauagacgcccgacaaucgagaaagacguggaucugggggccggaacgcggcacgucaacgcggaacccgagaccccuaacauggacguuauuggcgagagaaucaagcgcauuaaagaagaacacaauuccacauggcauuaugacgaugaaaaccccuacaagaccugggccuaucacgggucuuacgaggugaaggcuacaggaagcgccuccagcaugaucaauggcguggucaaacuccugaccaagccuugggacgugguucccauggugacacagauggcuaugaccgauacgaccccguucggccagcaacgggucuuuaaagaaaagguggacacaagaaccccucgcuccaugcccgggacacggagaguuaugggaaucaccgccgaguggcuguggcgcacgcucggccggaacaaaaagccuagacugugcacacgcgaggaguucaccaagaaagugcggacaaaugccgcgaugggggcugucuuuaccgaggaaaaccagugggauucugccaaggccgcuguggaggacgaagauuucuggaaacuuguugacagagagcgcgagcugcauaagcucggaaaauguggcagcugcguguauaauaugauggggaagagagagaagaagcugggcgaguuuggaaaggccaaaggcucccgggcuauuugguacauguggcuuggggcccgcuaccuggaguucgaggcgcucggauuucugaacgaggaucacugguucucuagagaaaauagcuauuccggcgucgagggggaaggacugcauaagcucggcuacauccugcgggacauuucuaaaauccccgggggcgccauguaugcugaugacacggccggaugggacaccagaauuacagaggaugaccuucacaacgaagagaagaucacccagcagauggauccugagcaccggcaacuggcuaaugccaucuuuaaacucacauaccagaacaagguggucaaggugcagcgccccaccccgacaggcaccguuauggacauuaucagcagaaaagaucagcggggguccggacaagugggcacguaugggcugaauacauucaccaacauggaagcgcagcuuauucgccagauggagggagaaggcguccugagcaaggccgaccucgagaauccucaucugcccgagaagaagaucacccaguggcuggagacaaaagggguggagagacucaagcggauggcuauuucuggcgaugacugcgugguuaagcccaucgaugaccgcuuugccaacgcucugcuugcccugaacgauaugggaaaagugagaaaggacaucccucaauggcagccguccaaaggcuggcacgauuggcagcagguccccuucuguagccaucacuuccacgaacucauuaugaaggacgggcggaaacuggugguuccuugccgcccccaagacgagcuuaucggacgggcucggauuucucagggcgccggguggucccugcgcgaaaccgcgugucucggaaaggccuacgcucagauguggagccugauguauuuucauagacgggaucugcgccucgccucuaaugccaucugcuccgcugugccuguccacugggugcccacaagcagaacgaccugguccauucaugcccaccaucaauggaugacaaccgaggacaugcugacagucuggaaccggguguggaucgaagauaauccuuggauggaggacaagacccccguuacgaccugggagaacgugccguaccuuggcaaaagagaagaucaguggugugggagccugauuggccucacaucucgcgcgaccugggcucagaauaucccuacagccauccagcaaguccggagccugauuggaaacgaggaguuccuugacuacaugcccuccaugaagagauuucgcaaagaggaggaaucugagggcgccaucugguga

SEQ ID NO: 20825 - RNA, 9873 nt, Artificial Sequence
  derived and/or modified CDS sequence (opt5) from DENV-3__EU569689__SS-prME
accagccugugccucaugaugauccugcccgccgcucuugccuuccaccugacgucccgggacggcgagccucggaugauuguggggaagaacgaacgcggaaagucucuccuguuuaagacggcgagcggcaucaauauguguacccuuauugcuauggaucugggggaaaugugcgacgauacagugaccuacaaguguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaagccugggggaaggccaagaucgucacagcugaaacccaaaacuccagcuucauuaucgauggaccuaauacacccgagugcccgucugcguccagagccuggaacgugugggaaguggaggacuauggcuuuggcgucuucaccacaaauaucuggcucaaacugcgcgaaguuuacacccagcugugugaccaccggcuuaugagcgcugccgugaaggaugagagagccgugcacgcugacaugggguacuggauugagucccagaaaaacggaucuuggaagcucgaaaaagccagccugaucgaggucaagacgugcacauggccuaagucccauacccuguggucuaauggcgugcucgaaagcgauaugauuauccccaaaucccuggcggggccuauuagccagcacaacuaucgccccggauaccauacccaaacagcuggcccuuggcaccuugggaagcuggagcucgacuuuaauuauugcgagggaaccacgguugugaucacagaaaacuguggcacccggggccccucucugagaacaaccacagucuccgggaaacugauccacgaguggugcugucgcagcugcacccuuccgccucuccgguacaugggagaagauggcuguugguaugggauggagauuagacccaucucugaaaaggaggagaauauggugaaaucccugguuagcgccggaucuggcgaaguggacaacuucacgauggggguccugugccucgccauucuguuugaggaagugaugcggggaaaguucggcaagaaacauaugaucgcuggcguuuucuuuaccuucgugcuucugcucagcgggcagauuacauggcgcgaucuggcccacacccugaucaugauuggauccaaugcgagcgacagaaugggcaugggggucacauaccuugcucugaucgccaccuuuaagauccagcccuuccucgcccugggauuuuuccuccggaaacugacgucuagagagaaccuucugcucggcguggggcuggcuauggccacaacccugcaacuuccugaagauauugagcagauggcuaauggaaucgcccugggccucauggcgcugaagcucauuacacaguuugagaccuaucagcuguggaccgcccuuaucucccugacauguagcaacacgauuuucacccucacaguggcuuggcgcaccgccacacugauccuggcuggcgucucccuucugccgguuugccaaucuagcuccaugcggaaaaccgacuggcuccccaugacgguggccgccaugggggugccuccccugccucucuuuaucuucucucugaaggauacacuuaagagacgcagcuggccccugaaugaaggagucauggcugugggccugguuuccauucucgcgucuagccugcuuagaaacgacgugccuauggccgggccccuggucgcuggaggccuccugaucgccuguuacgugauuaccgggaccuccgccgaucucacaguugagaaagcugccgacgugaccugggaagaggaagcggagcagacaggagucagccauaaccugaugaucacgguggacgaugacggcaccaugcggauuaaggaugacgagacagaaaauauccuuaccguccugcugaaaacagcucuccugaucgugucuggcauuuuuccguacuccaucccugccacccuucugguuuggcacacguggcagaagcagacccaacgcagcggggugcucugggauguccccucuccucccgagacacagaaagccgaacuggaggagggaguguauagaauuaagcagcagggcaucuucgggaaaacccaaguuggagugggcguccagaaggaagggguguuucauacaauguggcacgugacccggggagcuguucucacauacaacggcaagcgccuggagccgaauugggccuccgucaaaaaggaccuuauuagcuauggcgggggauggagacugucugcgcaguggcaaaaaggcgaagagguccaggugaucgcugucgaaccugggaagaaccccaaaaauuuccagacgaugccuggaaccuuccagacaaccaccggcgagauuggggccaucgcccuggauuuuaagcccggaacauccggcagccccaucauuaaccgggagggcaaggugguugggcucuacggaaauggcguggucacgaaaaacgggggauauguguccggcaucgcucaaaccaaugccgaaccugacgggccgacacccgagcuggaagaggaaauguucaagaaacgcaaccuuaccauuauggaucugcacccuggcagcggaaagacaagaaaauaccuccccgcuaucguucgggaggccauuaagcgcagacugcggacccucauccuggcgccuacgagaguggucgccgcugagauggaagaggcccuuaagggccugcccauccgcuaucagacaaccgcuaccaaaucugaacauacagggcgggagauuguggaccugaugugccacgccaccuuuacaaugagacuccugagcccuguucgcgugccgaauuacaaccuuaucauuauggaugaagcccauuucaccgaccccgcuuccaucgcggcccggggauacauuucuacgagagucggcaugggggaggcugccgccaucuuuaugacagcuaccccucccggaacagccgaugcguucccucagagcaaugcucccauccaggacgaggaacgcgacauuccggagcgguccuggaacucuggcaaugaauggaucaccgauuuugccgggaagacggugugguucgugccuagcauuaaagccggcaacgacaucgcuaacugucugagaaagaauggcaaaaaggucauucaacucucccgcaagaccuuugauacagaguaucagaaaaccaagcugaacgacugggauuucguugugacaaccgacaucucugagaugggagccaauuuuaaagcggaucgggugauugaccccagacggugccugaagcccgucauccucacagaugggccugaacgcgugauccuugccggacccaugccuguuaccgcugccagcgcugcccagagacggggccgcguggggagaaacccgcagaaagagaaugaccaauacauuuucacgggacagccccugaacaaugaugaagaccacgcucauuggacagaggccaagaugcugcucgacaacaucaauaccccugaaggcauuauccccgcgcuguucgagccugagcgggaaaaguccgccgcuauugauggggaguauagacuuaaaggcgaaagccgcaagaccuuugucgagcugaugcggagaggagaccuccccguguggcuggcccacaaaguugcuucugaaggcaucaaguacacagaucgcaaauggugcuucgacgggcagcggaacaaucagauccuggaggagaacauggauguggaaauuuggaccaaggagggagagaagaagaagcucagaccgcgcuggcuugacgcccggacauauuccgauccucuggcccugaaagaguuuaaggacuucgcugcgggcagaaaaagcaucgcccucgaucuggucacggaaauugggcgcgugcccacccaccuugcucauagaacacggaaugcccuggacaaccucgucaugcugcacaccucugagcauggaggcaaggccuaccgccacgcuguggaggaacugccugagacaauggaaacccuccuucugcugggccucaugauccugcuuacagggggagccaugcuguuucucauuuccggcaaagggaucggaaagaccagcaucggccugauuuguguuaucgcguccucugggaugcuguggauggccgagauuccccuccaauggaucgcuagcgccauugugcuugaguucuuuaugauggugcugcugaucccugaacccgagaagcagagaacaccgcaggauaaucaacucgcuuaugucguuauuggaauccugacccuugccgcgaucauugccgcuaacgaaaugggccugcucgagacaaccaaacgggaccugggcauguccaaggaaccugggguggugagccccacgucuuaccuggaugucgaccuccaccccgccuccgcuuggacacuuuacgccguggcuaccacaguuaucaccccuaugcugcgccauaccauugagaauagcacagccaacgugucucuggcggccaucgcuaaccaggccgucgugcucaugggacuggacaaaggcuggccgauuagcaagauggaucuuggggucccccugcucgcucugggaugcuauucccaggugaauccucugacgcucaccgccgccguucuucugcugaucacacacuacgcgaucauuggccccgggcuccaggcuaaagccaccagagaggcucaaaagcggacagccgccggaaucaugaagaacccuaccguggacggcauuaugacgaucgaucuggaccccgucauuuaugauucuaaauucgaaaagcagcuuggccaggugaugcugcucguucugugugcugugcagcugcuccuuaugagaacaagcugggcccugugcgaggcgcugacccucgccaccgggccuaucacaacccugugggaaggauccccgggcaaauuuuggaauacaacgaucgcugucucuauggccaacauuuuccgcgggagcuaccuugcuggagccggccuggcguuuuccaucaugaaaagcguggggaccggaaaacggggcacaggcucucaaggggagacccucggagaaaaguggaagaaaaagcugaaucagcuguccagaaaagaguucgaccucuauaagaaaagcggcauuacagagguggaucgcaccgaagccaaggaggggcuuaaacggggagaaaucacgcaucacgcuguuuccagaggcucugccaagcugcagugguuugucgagcggaacauggugauucccgaagggcgcgugaucgaccugggauguggcagaggcggguggagcuacuauugcgcuggacucaagaaagucaccgagguucggggcuacacaaaagggggaccuggccaugaggaacccgugccuauguccaccuacggguggaauauugugaaacugaugucuggaaaggaugucuucuaucuucccccggagaaaugugacacacugcucugcgauaucggcgaaagcuccccuagccccaccguggaggagucucgcacaaucagaguucugaagaugguggaacccuggcugaagaacaaucaguucuguauuaaaguccucaacccuuacaugcccaccgugaucgagcaccuugaacggcugcaacgcaagcacggcgggaugcugguuagaaauccucucucccggaacagcacgcaugagauguauuggauuucuaauggaacaggcaacaucguggccuccgucaauauggugagccgccugcuucugaacagauuuaccaugacccaccggagaccgacaauugaaaaagacguggaucucggggcuggaacgcgccaugucaacgccgagcccgagaccccuaauauggacguuaucggcgaacggaucaagagaauuaaagaggaacacaacucuacauggcacuacgacgaugagaaucccuauaagaccugggcguaccaugggagcuaugaagugaaggccacaggauccgcuucuagcaugaucaacggcguggucaaacugcugaccaagccuugggacgugguucccauggugacacagauggccaugaccgauacgaccccguucggccagcaacgcgucuuuaaagagaagguggacacacggaccccuagauccaugcccgggacacgccggguuaugggaauuaccgcugaguggcucuggagaacgcugggccgcaauaaaaagccucggcuuugcacaagagaagaguucaccaagaaagugcgcacaaacgccgccaugggggcggucuuuaccgaagagaaucagugggauagcgcuaaggccgccguggaagacgaggauuucuggaaacugguugaccgggagagagaacuccacaagcugggaaaauguggcuccugcguguacaacaugauggggaagcgcgagaagaaacuuggcgaauuuggaaaagcuaaaggcucuagagccaucugguacauguggcugggggcucgguaucucgaguucgaggcccugggauuucugaaugaagaucauugguucagccgcgagaacuccuacucuggcgucgaaggggagggacuccacaagcugggcuauauucuuagagacaucagcaaaauccccgggggcgcgauguacgccgaugacacggcuggaugggacacccggauuacagaagaugaccugcauaaugaggagaagaucacccagcagauggauccugaacacagacaacucgccaacgcuauuuuuaaacugacauaucagaauaagguggucaaggugcagcggcccaccccgacaggcaccguuauggacaucauuucccgcaaagaucagagagggucuggacaagugggcacguacgggcuuaacacauucaccaauauggaggcccagcugauccggcagauggaaggagagggcguccucagcaaggcggaccuggaaaacccucaucugcccgagaaaaagaucacccaguggcucgagacaaaagggguggaacgccugaagagaauggccauuuccggcgaugacugcgugguuaagcccaucgaugaccgguuugcuaacgcccuucuggcucucaaugauaugggaaaagugcgcaaggacauuccucaauggcagccgagcaaaggcuggcaugauuggcagcagguccccuucuguucucaccauuuccacgagcugaucaugaaggacgggagaaaacuugugguuccuugccggccccaagacgaacugauuggacgcgccagaaucucccagggcgcuggguggagccuccgggagaccgccugucugggaaaggcguaugcccagauguggucucugauguacuuucaccgcagagaucuccggcuggcuuccaacgccauuugcagcgccgugccuguccauugggugcccacaucucgcacgaccugguccauccacgcucaucaccaauggaugacaaccgaagacaugcuuacagucuggaauagaguguggaucgaggauaacccuuggauggaggacaagacccccguuacgaccugggaaaaugugccguaccugggcaaacgggaggaucaguggugugggagccucauuggccugacauccagagccaccugggcgcagaacaucccuacagcuauucagcaaguccgcagccuuaucggaaaugaagaguuccuggacuauaugcccucuaugaagcgguuuagaaaagaggaagagagcgaaggcgccauuugguga

SEQ ID NO: 20826 - RNA, 9873 nt, Artificial Sequence
  derived and/or modified CDS sequence (opt5) from DENV-3__EU482614__SS-prME
accagccugugccucaugaugauccugcccgccgcucuugccuuccaccugacgucccgggacggcgaaccucggaugauuguggggaagaacgaacgcggaaagucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagauguucccuguaaaauuccuuucagcaccgaggacggccaagggaaggcccauaacggaagacugaucacagcgaaucccguggucaccaaaaaggaggaacccgugaacauugaggcugaaccuccguucggcgaguccaauaucgugauugggaucggcgauaacgcccugaaaaucaauugguauaagaagggaucuagcauuggcaaaauguuugaagccacggcuagaggggccagacgcauggcuauccuuggagacacagccugggauuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugacauggggugugucaucaauuggaaaggaaaggagcugaagugcggcagcgggauuuucgugacaaacgagguucauacguggaccgaacaguacaaauuucaagccgauucccccaagcggcuggcgacagccaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacaucauuggagugcuggagcagggcaaacggacgcuuaccccucagcccauggagcugaaguacucuuggaaaacaugggggaaggccaagaucgucaccgccgaaacacaaaacuccagcuucauuaucgauggaccuaauacccccgagugcccgucugcuuccagagcguggaacgugugggaaguggaggacuauggcuuuggcgucuucacaaccaauaucuggcucaaacugcgcgaaguuuacacgcagcugugugaccaccggcuuaugagcgccgcugugaaggaugagagagccgugcacgccgacaugggguacuggauugagucccagaaaaacggaucuuggaagcucgaaaaagcuagccugaucgaggucaagacaugcaccuggccuaagucccauacccuguggucuaauggcgugcucgaaagcgauaugauuauccccaaaucccuggccgggccuauuagccagcacaacuaucgccccggauaccauacacaaaccgcgggcccuuggcaccuugggaagcuggagcucgacuuuaauuauugcgagggaacgacaguugugaucaccgaaaacuguggcacacggggccccucucugagaaccacaaccgucuccgggaaacugauccacgaguggugcugucgcagcugcacgcuuccgccucuccgguacaugggagaagauggcuguugguaugggauggagauuagacccaucucugaaaaggaggagaauauggugaaaucccugguuagcgcuggaucuggcgaaguggacaacuucaccauggggguccugugccucgccauucuguuugaggaagugaugcggggaaaguucggcaagaaacauaugaucgccggcguuuucuuuacauucgugcuucugcucagcgggcagauuaccuggcgcgauauggcucacacacugaucaugauuggauccaaugccagcgacagaaugggcaugggggucaccuaccuggcgcuuaucgcuacguuuaagauccagcccuuccuggcccucggauuuuuccugcggaaacucacaucuagagagaaccugcuucugggcguggggcucgccauggcuaccacacugcaacugccugaagauauugagcagauggccaauggaaucgcucuuggccugauggcccucaagcugauuacccaguuugagaccuaucagcucuggacagcgcugaucucccuuacguguagcaacaccauuuucacacugaccguggccuggcgcacagcuacccucauccuggccggcgucucccugcuuccgguuugccaaucuagcuccaugcggaaaacggacuggcugcccaugacaguggcugccaugggggugccuccccucccucuguuuaucuucucucucaaggauacccugaagagacgcagcuggccccuuaaugaaggagucauggccgugggccugguuuccauucuggcuucuagccuccugagaaacgacgugccuauggcggggccccuugucgccggaggccugcucaucgcuuguuacgugauuaccgggacauccgccgaucugaccguugagaaagccgcugacgugacaugggaagaggaagccgagcagacgggagucagccauaaccucaugaucaccguggacgaugacggcacaaugcggauuaaggaugacgagaccgaaaauauccugacaguccuucugaaaaccgcgcugcucaucgugucuggcauuuuuccguacuccaucccugcuacgcugcuuguuuggcacaccuggcagaagcagacacaacgcagcggggugcugugggauguccccucuccucccgagacccagaaagccgaacucgaggagggaguguauagaauuaagcagcagggcaucuucgggaaaacacaaguuggagugggcguccagaaggaagggguguuucauaccauguggcacgugacacggggagccguucugacgcacaacggcaagcgccucgagccgaauugggcuuccgucaaaaaggaccugauuagcuacggcgggggauggagacuuucugcccaguggcaaaaaggcgaagagguccaggugaucgcggucgaaccugggaagaaccccaaaaauuuccagaccaugccuggaacauuccagaccaccacaggcgagauuggggcuaucgcccuggauuuuaagcccggaacguccggcagccccaucauuaaccgggagggcaaggugguugggcuguauggaaauggcguggucaccaaaaacgggggauacguguccggcaucgcccaaacaaaugcugaaccugacgggccgacccccgagcucgaagaggaaauguucaagaaacgcaaccugacaauuauggaucuucauccuggcagcggaaagaccagaaaauaucugcccgccaucguucgggaggcuauuaagcgcagacuccggacgcugauccucgccccuacaagaguggucgcggccgagauggaagaggcucugaagggccuucccauccgcuaccagaccaccgccacaaaaucugaacacaccgggcgggagauuguggaccugaugugccaugcuacauuuaccaugagacugcucagcccuguucgcgugccgaauuauaaccugaucauuauggaugaagcccacuucacggaccccgccuccaucgcugcgcggggauacauuucuacaagagucggcaugggggaggccgcugccaucuuuaugaccgccacaccucccggaaccgcugaugccuucccucagagcaaugcgcccauccaggacgaggaacgcgacauuccggagcgguccuggaacucuggcaaugaauggaucacggauuuugcugggaagaccgugugguucgugccuagcauuaaagccggcaacgacaucgccaacugucuuagaaagaauggcaaaaaggucauucaacugucccgcaagacauuugauaccgaguaccagaaaacaaagcucaacgacugggauuucguugugaccacagacaucucugagaugggagcuaauuuuaaagccgaucgggugauugaccccagacggugccugaagcccgucauccugaccgaugggccugaacgcgugauccucgcgggacccaugccuguuacggccgcuagcgccgcucagagacggggccgcguggggagaaacccgcagaaagagaaugaccaauauauuuucacaggacagccccuuaacaaugaugaagaccaugcccacuggaccgaggcuaagaugcugcuggacaacaucaauaccccugaaggcauuauccccgcccucuucgagccugagcgggaaaaguccgcggccauugauggggaguacagacugaaaggcgaaagccgcaagacauuugucgagcuuaugcggagaggagaccugcccguguggcucgcucacaaaguugccucugaaggcaucaaguauaccgaucgcaaauggugcuucgacgggcagcggaacaaucagauccuggaggagaacauggauguggaaauuuggacaaaggagggagagaagaagaagcugagaccgcgcuggcucgacgcucggacguacuccgauccucuugcccugaaagaguuuaaggacuucgccgcuggcagaaaaagcaucgcgcuggaucucgucaccgaaauugggcgcgugcccucucaucuggcccacagaacacggaaugcucuugacaaccuggucaugcuccauaccuccgagcacggaggcaaggccuaucgccacgccguggaggaacugccugagacaauggaaacccugcuccuucugggccugaugauccuccugacagggggagcuaugcuuuuucugauuagcggcaaagggaucggaaagaccuccaucggccucauuuguguuaucgccucuagcgggaugcuguggauggcggagauuccccugcaauggaucgccuccgcuauugugcucgaguucuuuaugauggugcuucugaucccugaacccgagaagcagagaacaccgcaggauaaucaacuggccuacgucguuauuggaauccucacccuggcugccaucauugcggccaacgaaaugggccuucuggagacaaccaaacgggaccucggcaugagcaaggaaccugggguggugucucccacguccuaucuggaugucgaccugcaucccgcuagcgccuggacacucuacgcuguggccaccacaguuaucaccccuaugcuucgccacaccauugaaaauucuacagcuaacgugagccuggccgcgaucgccaaccaggcugucgugcugaugggacucgacaaaggcuggccgauuuccaagauggaucugggggucccccuucuggcccucggaugcuacucucaggugaauccucugacgcugaccgcugccguucuccuucugaucacacauuaugccaucauuggccccgggcugcaggcgaaagcuaccagagaggcccaaaagcggacagcugccggaaucaugaagaacccuaccguggacggcauuaugacgaucgaucucgaccccgucauuuacgauagcaaauucgagaagcagcugggccaggugaugcuucugguucucugugccgugcagcugcugcucaugagaacauccugggcucuuugcgaggcccugacccuggcgaccgggccuaucacaacccucugggaaggaucuccgggcaaauuuuggaauacaacgaucgccgucagcauggcuaacauuuuccgcggguccuaucuggccggagcuggccuugccuuuagcaucaugaagucuguggggaccggaaaacggggcacaggcucccaaggggagacccugggagaaaaguggaagaaaaagcucaaucagcugagcagaaaagaguucgaccuguacaagaaauccggcauuacagagguggaucgcaccgaagcgaaggaggggcucaaacggggagaaaucacgcaccaugccguuucuagaggcagcgcuaaacuucagugguuugucgagcggaacauggugauucccgaagggcgcgugaucgaccugggauguggcagaggcgggugguccuauuacugcgccggacugaagaaagucaccgagguucggggcuauacaaaagggggaccuggccacgaggaacccgugccuaugucuaccuacggguggaauauugugaaacucaugagcggaaaggaugucuucuaccugcccccggagaaaugugacacacuucugugcgauaucggcgaauccagcccuucucccaccguggaggagucccgcacaaucagaguucucaagaugguggaacccuggcugaagaacaaucaguucuguauuaaaguccugaacccuuauaugcccaccgugaucgagcaccucgaacggcuucaacgcaagcauggcgggaugcugguuagaaauccucugagccggaacucuacgcacgagauguacuggauuuccaauggaacaggcaacaucguggcuagcgucaauauggugucucgccuccugcuuaacagauuuaccaugacccaucggagaccgacaauugaaaaagacguggaucugggggccggaacgcgccacgucaacgcugagcccgagaccccuaauauggacguuaucggcgaacggaucaagagaauuaaagaggaacacaacagcacauggcauuaugacgaugagaaucccuacaagaccugggccuaucacggguccuacgaagugaaggcgacaggaucugccagcuccaugaucaacggcguggucaaacuccugaccaagccuugggacgugguucccauggugacacagauggcuaugaccgauacgaccccguucggccagcaacgcgucuuuaaagagaagguggacacacggaccccuagaagcaugcccgggacacgccggguuaugggaauuaccgccgaguggcuguggagaacgcucggccgcaauaaaaagccucggcugugcacaagagaagaguucaccaagaaagugcgcacaaacgcugccaugggggccgucuuuaccgaagagaaucagugggauuccgcgaaggcugccguggaagacgaggauuucuggaaacuuguugaccgggagagagaacugcauaagcucggaaaauguggcucuugcguguauaacaugauggggaagcgcgagaaaaagcugggcgaauuuggaaaggccaaaggcagcagagcuaucugguacauguggcuuggggcccgguaccuggaguucgaggcucucggauuucugaaugaagaucacugguucucccgcgagaacucuuauagcggcgucgaaggggagggacugcauaagcucggcuacauucugagagacaucuccaaaauccccgggggcgccauguaugcggaugacacggccggaugggacacccggauuacagaagaugaccuucacaaugaggagaagaucacccagcagauggauccugaacacagacaacuggcuaacgccauuuuuaaacucacauaccagaauaagguggucaaggugcagcggcccaccccgacaggcaccguuauggacaucauuucucgcaaagaucagagagggagcggacaagugggcacguaugggcugaacacauucaccaauauggaggcucagcuuauccggcagauggaaggagagggcguccuguccaaggccgaccucgaaaacccucaucugcccgagaaaaagaucacccaguggcuggagacaaaagggguggaacgccucaagagaauggcgauuagcggcgaugacugcgugguuaagcccaucgaugaccgguuugccaacgcucugcuugcccugaaugauaugggaaaagugcgcaaggacauuccucaauggcagccgucuaaaggcuggcacgauuggcagcagguccccuucuguucccaucacuuccacgagcucaucaugaaggacgggagaaaacuggugguuccuugccggccccaagacgaacuuauuggacgcgcuagaaucagccagggcgccggguggucucugcgggagaccgcuugucucggaaaggccuacgcgcagauguggucccugauguauuuucaucgcagagaucugcggcucgccagcaacgcuauuugcucugccgugccuguccacugggugcccacaucccgcacgaccuggagcauccaugcccaccaucaauggaugacaaccgaagacaugcugacagucuggaauagaguguggaucgaggauaacccuuggauggaggacaagacccccguuacgaccugggaaaaugugccguaccuuggcaaacgggaggaucaguggugugggucccugauuggccucacaagcagagcuaccugggcccagaacaucccuacagcgauucagcaaguccgcucucugaucggaaaugaagaguuccuugacuacaugcccagcaugaagcgguuuagaaaagaggaagaguccgaaggcgcuauuugguga

SEQ ID NO: 20827 - RNA, 9873 nt, Artificial Sequence
  derived and/or modified CDS sequence (opt5) from DENV-3__EU569690__SS-prME
accagccugugccucaugaugauccugcccgccgcucuugccuuccaccugacaucccgggacggcgagccucggaugauuguggggaagaacgaacgcggaaaaucucuccuguuuaagacggcgagcggcaucaauauguguacccuuauugcuauggaucugggggagaugugcgacgauacagugaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauacccggacacaaaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugcgguguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggucucggaaagagcuucuggugacauuuaagaaugcucacgcgaaaaagcaagaagucgugguucucgggucccaggagggagccaugcacaccgcucugacaggcgccaccgaaauccagaacagcgggggcaccucuauuuucgccggacaucugaagugucgccucaaaauggacaagcuggagcuuaaaggcauguccuacgcuaugugcacaaauacguuugugcugaagaaagaggucagcgaaacccagcacgggacaauccucaucaagguggaguacaagggagaagauguucccuguaaaauuccuuucuccaccgaggacgagcaaggcaaggcccauaacgggagacugaucacagcgaaccccguggucaccaaaaaggaagaacccgugaauauugaagcugagccuccguucggagaaucuaacaucgugauuggcaucggggauaaugcccugaaaaucaacugguauaagaagggcagcuccauuggaaaaauguuugaggccacggcucggggcgccagacgcauggcuauccuuggggacacagccugggauuucggaagcguuggcgggguccucaauucucugggaaagauggugcaccagauuuuuggcuccgcguacaccgcccuguucagcggggugucuugggucaugaaaaucggcauuggagugcuccugaccuggaucggccuuaacagcaagaauacauccaugucuuuuagcugcauugcuaucgggaucauuacccuguaucucggagccguugugcaggcugacaugggcugugucaucaacuggaaagggaaggagcugaagugcggauccggcauuuucgugacaaaugaaguucauacguggaccgagcaguacaaauuucaagccgauagccccaagcggcuggcgacagccaucgcuggggccugggaaaacggcguguguggaauuagaucuaccacacgcauggagaaucuucucuggaaacagaucgcuaacgaacugaauuauauccugugggagaacaauauuaagcucaccgucgugguuggcgacaucauuggggugcuggagcagggaaaacggacgcuuaucccucagcccauggaacugaaguacuccuggaaaaccuggggcaaggccaagauugucacagccgagacccaaaacagcucuuucaucaucgaugggccuaacacacccgaaugcccguccgcuagcagagcguggaaugugugggagguggaagacuauggauuuggcgucuucaccacaaacauuuggcucaaacugcgcgagguuuacacccagcugugugaccaccggcuuauguccgccgcugugaaggaugagagagccgugcacgccgacaugggcuacuggaucgaaucucagaaaaaugggagcuggaagcucgagaaggcuucccugauugaagucaagacgugcacauggccuaagucucauacccuguggagcaacggagugcucgaguccgauaugaucauucccaaaagccuggccggcccuaucucucagcacaauuaucgccccggguaccauacccaaacagcgggaccuuggcaccuuggcaagcuggagcucgacuuuaacuauugcgaagggaccacgguugugaucacagagaauuguggaacccggggccccucccugagaacaaccacagucagcggcaaacugauucacgaauggugcugucgcucuugcacccuuccgccucuccgguacaugggggaggauggauguugguauggcauggaaaucagacccauuuccgagaaggaggaaaacauggugaaaagccugguuucugcugggagcggagagguggacaauuucacgaugggcguccugugccucgccauccuguuugaagaggugaugcgggggaaguucggaaagaaacauaugauugccggcguuuucuuuaccuucgugcuucugcucuccggccagaucacauggcgcgauauggcucacacccugauuaugaucgggagcaacgccucugacagaaugggaaugggcgucacauaccuggcgcuuaucgcuaccuuuaagauucagcccuuccuggcccucggguuuuuccugcggaaacucacguccagagaaaaucugcuucugggagugggccucgccauggcuacaacccugcaacugccugaggauaucgagcagauggccaacgggauugcucuuggacugauggcccucaagcugaucacacaguuugaaaccuaucagcucuggaccgcgcugauuagccuuacauguuccaauacgaucuucacccugacaguggccuggcgcaccgcuacacucauccuggccggcgucucucugcuuccgguuugccaaagcuccucuaugcggaaaaccgacuggcugcccaugacgguggcugccaugggcgugccuccccucccucuguuuauuuucagccucaaggauacacugaagagacgcuccuggccccuuaacgagggggucauggccgugggacugguuucuauccuggcuagcucccuccugagaaaugacgugccuauggcgggcccccuugucgccgggggacugcucauugcuuguuacgugaucaccggcaccagcgccgaucugacaguugaaaaagccgcugacgugaccugggaggaagaggccgagcagacaggggucucucauaaccucaugauuacgguggacgaugacggaaccaugcggaucaaggaugacgaaacagagaacauccugaccguccuucugaaaacagcgcugcucauuguguccggcaucuuuccguacagcauuccugcuacccugcuuguuuggcacacguggcagaagcagacccaacgcucuggcgugcugugggauguccccuccccucccgaaacacagaaagccgagcucgaggaagggguguauagaaucaagcagcagggaauuuucggcaaaacccaaguuggggugggaguccagaaggagggcguguuucauacaauguggcacgugaccagaggggccguucugacauacaauggaaagcgccucgaaccgaacugggcuagcgucaaaaaggaccugaucucuuauggcggcggguggagacuuuccgcccaguggcaaaaaggagaggaaguccaggugauugcggucgagccuggcaagaaucccaaaaacuuccagacgaugccugggaccuuccagacaaccaccggagagaucggcgcuaucgcccuggauuuuaagcccgggacaagcggaucccccauuaucaaucgggaaggcaaggugguuggccuguacgggaacggaguggucacgaaaaauggcggguaugugagcggaauugcccaaaccaacgcugagccugacggcccgacacccgaacucgaggaagagauguucaagaaacgcaaucugaccaucauggaucuucacccugggucuggcaagacaagaaaauaccugcccgccauuguucgggaggcuaucaagcgcagacuccggacccugauccucgccccuacgagaguggucgcggccgaaauggaggaagcucugaagggacuucccauucgcuaucagacaaccgccaccaaaagcgagcauacaggccgggaaaucguggaccugaugugccacgcuaccuuuacaaugagacugcucuccccuguucgcgugccgaacuacaaucugauuaucauggaugaggcccauuucaccgaccccgccucuauugcugcgcggggguacaucagcacgagagucggaaugggcgaggccgcugccaucuuuaugacagccaccccucccgggacagcugaugccuucccucaguccaacgcgcccauucaggacgaagaacgcgacaucccggaacggucuuggaauagcggaaacgaguggauuaccgauuuugcuggcaagacggugugguucgugccuuccaucaaagccgggaaugacauugccaacugucuuagaaagaacggcaaaaaggucauccaacugucucgcaagaccuuugauacagaguaucagaaaaccaagcucaaugacugggauuucguugugacaaccgacauuagcgaaaugggagcuaacuuuaaagccgaucgggugaucgaccccagacggugccugaagcccgucauccugacagauggcccugagcgcgugauucucgcggggcccaugccuguuaccgccgcuuccgccgcucagagacggggacgcgugggcagaaauccgcagaaagaaaacgaccaauacaucuucacggggcagccccuuaauaacgaugaggaccacgcccauuggacagaagcuaagaugcugcuggacaauauuaacaccccugagggaaucauucccgcccucuucgagccugaacgggagaaaagcgcggccaucgauggcgaauauagacugaaaggggaaucucgcaagaccuuugucgaacuuaugcggagaggcgaccugcccguguggcucgcucacaaaguugccuccgagggaaucaaguacacagaucgcaaauggugcuucgacggccagcggaauaaccagauucuggaggaaaauauggauguggagaucuggaccaaggaaggggagaaaaagaagcugagaccgcgcuggcucgacgcucggacauauagcgauccucuugcccugaaagaauuuaaggacuucgccgcuggaagaaaaucuauugcgcuggaucucgucacggagaucggccgcgugcccacccaccuggcccauagaacacggaacgcucuugacaaucuggucaugcuccacaccuccgagcaugggggaaaggccuaccgccacgccguggaggaacugccugaaacaauggagacccugcuccuucugggccugaugauucuccugacgggcggggcuaugcuuuuucugaucagcggaaaaggcaucgggaagaccuccauuggacucaucuguguuauugccucuagcggcaugcuguggauggcggagaucccccugcaauggauugccuccgcuaucgugcucgaguucuuuaugauggugcuucugauuccugagcccgaaaagcagagaacaccgcaggauaaccaacuggccuaugucguuaucgggauccucacccuggcugccauuaucgcggccaaugagaugggacuucuggaaacaaccaaacgggaccucggcaugagcaaggagccuggcguggugucucccacguccuaccuggaugucgaccugcaccccgcuagcgccuggacacucuacgcuguggccaccacaguuauuaccccuaugcuucgccauaccaucgagaacucuacagcuaaugugagccuggccgcgauugccaaccaggcugucgugcugauggggcucgacaaaggauggccgaucuccaagauggaucugggcgucccccuucuggcccucgggugcuauucucaggugaacccucugacgcugaccgcugccguucuccuucugaucacacacuacgccauuaucggacccggccugcaggcgaaagcuaccagagaagcccaaaagcggacagcugccgggauuaugaagaauccuaccguggacggaaucaugacgauugaucucgaccccgucaucuaugauagcaaauucgagaagcagcugggccaggugaugcuucugguucucugugccgugcagcugcugcucaugagaacauccugggcucuuugcgaagcccugacccuggcgaccggcccuaucacaacccucugggaggggucuccgggaaaauuuuggaacacaacgauugccgucagcauggcuaauaucuuccgcggcuccuaccuggccggggcuggacuugccuuuagcauuaugaagucugugggcaccgggaaacggggaacaggcucccaaggcgaaacccugggggagaaguggaagaaaaagcucaaccagcugagcagaaaagaguucgaccuguauaagaaauccggaaucacagaaguggaucgcaccgaggcgaaggaaggccucaaaagaggggaaauuacgcaucacgccguuucuagaggaagcgcuaaacuucagugguuugucgaacggaauauggugauccccgagggccgcgugauugaccugggguguggaagaggcggcugguccuacuauugcgccgggcugaagaaagucaccgagguucggggauacacaaagggcgggccuggacaugaggaacccgugccuaugucuaccuacggcuggaacaucgugaaacucaugagcgggaaggaugucuucuaucugcccccggaaaaaugugacacacuucugugcgauaucggagaguccagcccuucucccaccguggaggaaucccgcacaauuagaguucucaagaugguggagcccuggcugaagaauaaccaguucuguaucaaaguccugaauccuuacaugcccaccgugauugaacaccucgagcggcuucaacgcaagcacggcggcaugcugguuagaaacccucugagcagaaauucuacgcaugaaauguauuggaucuccaacgggacaggaaauauuguggcuagcgucaacauggugucucgccuccugcuuaauagauuuaccaugacccaccggagaccgacaaucgagaaagacguggaucugggcgccgggacgcgccaugucaacgcugagcccgaaaccccuaacauggacguuaucggagagcggauuaagagaaucaaagaggagcacaauagcacauggcacuacgacgaugaaaaccccuauaagaccugggccuaccauggcuccuaugaggugaaggcgacagggucugccagcuccaugauuaauggaguggucaaacuccugaccaagccuugggacgugguucccauggugacacagauggcuaugaccgauacgaccccguucggccagcaacgcgucuuuaaagagaagguggacacacggaccccuagaagcaugcccggcacacgccggguuauggggaucaccgccgaauggcuguggagaacgcucggacgcaacaaaaagccucggcugugcacaagagaggaguucaccaagaaagugcgcacaaaugcugccaugggcgccgucuuuaccgaggaaaaccagugggauuccgcgaaggcugccguggaggacgaggauuucuggaaacuuguugaccgggaaagagagcugcacaagcucgggaaauguggaucuugcguguacaauaugaugggcaagcgcgagaagaagcugggggaguuuggcaaggccaaaggaagcagagcuauuugguacauguggcuuggcgcccgguaucuggaguucgaagcucucggguuucugaacgaggaucauugguucucccgcgaaaauucuuacagcggagucgagggcgaagggcugcacaagcucggauauauccugagagacaucuccaaaauucccggcggggccauguacgcggaugacacggccggcugggacacccggaucacagaggaugaccuucauaacgaggaaaagauuacccagcagauggauccugagcacagacaacuggcuaaugccaucuuuaaacucacauaucagaacaagguggucaaggugcagcggcccaccccgacaggaaccguuauggacauuaucucucgcaaagaucagagaggcagcgggcaagugggaacguacggccugaauacauucaccaacauggaagcucagcuuauccggcagauggagggggaaggaguccuguccaaggccgaccucgagaauccucaucugcccgagaaaaagauuacccaguggcuggaaacaaaaggcguggagcgccucaagagaauggcgaucagcggggaugacugcgugguuaagcccauugaugaccgguuugccaacgcucugcuugcccugaacgauaugggcaaagugcgcaaggacaucccucaauggcagccgucuaaaggauggcaugauuggcagcagguccccuucuguucccaccauuuccacgaacucauuaugaaggacggcagaaaacuggugguuccuugccggccccaagacgagcuuaucgggcgcgcuagaauuagccagggagccggcuggucucugcgggaaaccgcuugucucgggaaggccuaugcgcagauguggucccugauguacuuucaccgcagagaucugcggcucgccagcaaugcuaucugcucugccgugccuguccauugggugcccacaucccgcacgaccuggagcauccacgcccaucaccaauggaugacaaccgaggacaugcugacagucuggaacagaguguggauugaggauaauccuuggauggaagacaagacccccguuacgaccugggagaacgugccguaccuuggaaaacgggaagaucagugguguggcucccugaucgggcucacaagcagagcuaccugggcccagaauauuccuacagcgauccagcaaguccgcucucugauuggcaacgaggaguuccuugacuauaugcccagcaugaagcgguuuagaaaagaagaggaauccgagggagcuaucugguga

SEQ ID NO: 20828 - RNA, 9873 nt, Artificial Sequence
  derived and/or modified CDS sequence (opt5) from DENV-3__EU569691__SS-prME
accagccugugccucaugaugauccugcccgccgcucuugccuuccaccugacaucccgggacggagaaccucggaugauuguggggaagaacgaacgcggaaagucucuccuguuuaagacggcgagcggcaccaauauguguacacuuaucgcuauggaucugggggagaugugcgacgauaccgugacauacaaguguccgcauauuaccgaaguugagcccgaagacaucgauugcugguguaaccucacauccaccugggugacguauggaaccugcaaucaggccggcgagcacagacgggacaagcgcucuguggcccuggcuccucaugucgggaugggacuggauacaagaacccagacauggaugagcgccgagggcgcuuggagacagguggaaaaaguugagaccugggcccuccgccaccccggcuucacgauucuggcgcuuuuucuggcccauuacaucgggacaucccucacccagaagguggucaucuucauucugcuuaugcuggugacaccuucuaugaccaugagauguguuggagugggcaaccgggacuuugucgaagggcucagcggagcuaccuggguggaugugguccuggagcacggcgggugcguuacaacgauggccaagaauaaacccacccuggacaucgagcuccagaagacagaagcuacccaacuggccacacuucgcaaacuguguauugagggaaagaucaccaacauuacgacagauuccagaugcccuacccagggcgaagcggugcucccggaggaacaggaccagaauuauguguguaaacacaccuacgucgaucggggcugggggaacggaugcggccuguucgggaagggaagccuugugacaugcgccaaguuucaaugucuggagcccaucgagggcaaaguugugcaguaugaaaaucucaaguacaccgucauuaucacagugcauacgggggaccagcaccagguuggaaacgagacccaaggcgugacagcugaaaucaccccucaggccucuacaaccgaggcuauucugcccgaauauggcacgcuggggcucgagugcuccccucgcaccggacuggacuucaaugagaugauccuucugacaaugaaaaacaaggccuggaugguccauagacagugguuuuucgaucucccccugccguggaccagcggcgccacaaccgaaacgccuacauggaaucggaaagagcuucuggugaccuuuaagaacgcucacgcgaaaaagcaagaagucgugguucucgggucucaggagggagccaugcacacagcucugaccggcgccaccgaaauucaaaauuccgggggcacaagcaucuucgccggacaucugaagugucgccucaaaauggacaagcuggagcuuaaaggcaugucuuacgcuaugugcacgaacaccuuugugcugaagaaagaggucuccgaaacacagcacgggaccauucucaucaagguggaguacaagggagaagauguucccuguaaaaucccuuucagcacagaggacggccaagggaaggcccauaacggaagacugauuaccgcgaaucccguggucacgaaaaaggaggaacccgugaacaucgaggcugaaccuccguucggcgaguccaauauugugaucgggauuggcgauaacgcccugaaaaucaauugguauaagaagggaucuagcaucggcaaaauguuugaagccacagcuagaggggccagacgcauggcuauucuuggagacaccgccugggauuucggcuccguugggggaguccucaacagccugggcaagauggugcaccagaucuuugggucugcguacaccgcccuguucuccggcgugagcugggucaugaaaauuggaaucggcgugcuccugacauggauugggcuuaauucuaagaacaccagcauguccuuuucuugcaucgcuauuggaaucaucacacuguaucucggcgccguugugcaggcugacauggggugugucauuaauuggaaaggaaaggagcugaagugcggcagcgggaucuucgugacgaacgagguucauaccuggacagaacaguacaaauuucaagccgauucccccaagcggcuggcgaccgccauugcuggcgccugggagaauggaguguguggcaucagaagcacaacccgcauggaaaaccuucucuggaaacagauugcuaaugagcugaacuauauccugugggaaaauaacaucaagcucacggucgugguuggggacauuaucggagugcuggagcagggcaaacggacccuuacaccucagcccauggagcugaaguacucuuggaaaaccugggggaaggccaagauugucacagccgaaacccaaaacuccagcuucaucauugauggaccuaauacacccgagugcccgucugcuuccagagcguggaacgugugggaaguggaggacuauggcuuuggcgucuucaccacgaauaucuggcucaaacugcgcgaaguuuacacacagcugugugaccaccggcuuaugagcgccgcugugaaggaugagagagccgugcacgccgacaugggguacuggaucgagucccagaaaaacggaucuuggaagcucgaaaaagcuagccugauugaggucaagaccugcaccuggccuaagucccauacacuguggucuaauggcgugcucgaaagcgauaugaucauucccaaaucccuggccgggccuaucagccagcacaacuaucgccccggauaccauacccaaacggcgggcccuuggcaccuugggaagcuggagcucgacuuuaauuauugcgagggaacaaccguugugauuacagaaaacuguggcacccggggccccucucugagaacaaccacggucuccgggaaacugauccacgaguggugcugucgcagcugcacccuuccgccucuccgguacaugggagaagauggcuguugguaugggauggagaucagacccauuucugaaaaggaggagaauauggugaaaucccugguuagcgcuggaucuggcgaaguggacaacuucacaauggggguccugugccucgccauccuguuugaggaagugaugcggggaaaguucggcaagaaacauaugauugccggcguuuucuuuaccuucgugcuucugcucagcgggcagaucacauggcgcgauauggcucacacccugauuaugaucggauccaaugccagcgacagaaugggcaugggggucacguaccuggcgcuuauugcuacauuuaagauccagcccuuccuggcccucggauuuuuccugcggaaacucaccucuagagagaaccugcuucugggcguggggcucgccauggcuacaacccugcaacugccugaagauaucgagcagauggccaauggaauugcucuuggccugauggcccucaagcugaucacccaguuugagacauaucagcucuggacggcgcugauuucccuuaccuguagcaacacaaucuucacccugacaguggccuggcgcaccgcuacgcucauucuggccggcgucucccugcuuccgguuugccaaucuagcuccaugcggaaaacagacuggcugcccaugaccguggcugccaugggggugccuccccucccucuguuuaucuucacccucaaggauacacugaagagacgcucuuggccccuuaaugaaggagucauggccgugggccugguuagcauccuggcuuccucucuccugagaaacgacgugccuauggcggggccccuugucgccggaggccugcucauugcuuguuacgugaucaccgggacaagcgccgaucugacgguugagaaagccgcugacgugaccugggaagaggaagccgagcagacaggagucucccauaaccucaugauuaccguggacgaugacggcacaaugcggaucaaggaugacgagaccgaaaauauucugacgguccuucugaaaaccgcgcugcucaucgugagcggcaucuuuccguacucuauuccugcuacacugcuuguuuggcacaccuggcagaagcagacacaacgcuccggggugcugugggauguccccagcccucccgagacccagaaagccgaacucgaggagggaguguauagaaucaagcagcagggcauuuucgggaaaacacaaguuggagugggcguccagaaggaagggguguuucauacgauguggcacgugacccggggagccguucugacacacaacggcaagcgccucgagccgaauugggcuucugucaaaaaggaccugaucuccuacggcgggggauggagacuuagcgcccaguggcaaaaaggcgaagagguccaggugauugcggucgaaccugggaagaaccccaaaaauuuccagaccaugccuggaaccuuccagacaacgaccggcgagaucggggcuauugcccuggauuuuaagcccggaacaucuggcucccccaucaucaaccgggagggcaaggugguugggcuguauggaaauggcguggucaccaaaaacgggggauacgugagcggcauugcccaaacaaaugcugaaccugacgggccgacccccgagcucgaagaggaaauguucaagaaacgcaaccugacgaucauggaucuucauccuggcuccggaaagacaagaaaauaucugcccgccauuguucgggaggcuaucaagcgcagacuccggacccugauucucgccccuaccagaguggucgcggccgagauggaagaggcucugaagggccuucccauccgcuaccagacaaccgccacaaaaagcgaacacaccgggcgggagaucguggaccugaugugccaugcuacguuuacaaugagacugcucucuccuguucgcgugccgaauuauaaccugauuaucauggaugaagcccacuucaccgaccccgccagcauugcugcgcggggauacaucuccacaagagucggcaugggggaggccgcugccauuuuuaugaccgccacgccucccggaaccgcugaugccuucccucagucuaaugcgcccauccaggacgaggaacgcgacaucccggagcggagcuggaacuccggcaaugaauggauuacagauuuugcugggaagaccgugugguucgugccuucuaucaaagccggcaacgacauugccaacugucuuagaaagaauggcaaaaaggucauccaacugagccgcaagacauuugauaccgaguaccagaaaacaaagcucaacgacugggauuucguugugaccacggacauuuccgagaugggagcuaauuuuaaagccgaucgggugaucgaccccagacggugccugaagcccgucauucugacagaugggccugaacgcgugauccucgcgggacccaugccuguuaccgccgcuucugccgcucagagacggggccgcguggggagaaacccgcagaaagagaaugaccaauauaucuucaccggacagccccuuaacaaugaugaagaccaugcccacuggacagaggcuaagaugcugcuggacaacauuaauaccccugaaggcaucauucccgcccucuucgagccugagcgggaaaagagcgcggccaucgauggggaguacagacugaaaggcgaaucccgcaagacauuugucgagcuuaugcggagaggagaccugcccguguggcucgcucacaaaguugccagcgaaggcauuaaguauacggaucgcaaauggugcuucgacgggcagcggaacaaucagauccuggaggagaacauggauguggaaaucuggaccaaggagggagagaagaagaagcugagaccgcgcuggcucgacgcucggacauacucugauccucuugcccugaaagaguuuaaggacuucgccgcuggcagaaaauccauugcgcuggaucucgucaccgaaaucgggcgcgugcccacacaucuggcccacagaacccggaaugcucuugacaaccuggucaugcuccauacgagcgagcacggaggcaaggccuaucgccacgccguggaggaacugccugagaccauggaaacacugcuccuucugggccugaugauucuccugaccgggggagcuaugcuuuuucugaucucuggcaaagggauuggaaagacauccaucggccucaucuguguuauugccagcuccgggaugcuguggauggcggagaucccccugcaauggauugccucugcuaucgugcucgaguucuuuaugauggugcuucugauuccugaacccgagaagcagagaaccccgcaggauaaucaacuggccuacgucguuaucggcauucucacgcuggcugccaucaucgcggccaacgaaaugggccuucuggagacaaccaaacgggaccucggcaugagcaaggaaccugggguggugucccccacaagcuaucuggaugucgaccugcaucccgcuucugccuggacccucuacgcuguggccaccacaguuauuacgccuaugcuucgccacaccaucgaaaauuccacagcuaacgugagccuggccgcgauugccaaccaggcugucgugcugaugggacucgacaaaggcuggccgaucucuaagauggaucugggggucccccuucuggcccucggaugcuacagccaggugaauccucugacccugacagcugccguucuccuucugauuacccauuaugccaucaucggccccgggcugcaggcgaaagcuacgagagaggcccaaaagcggacagcugccggaauuaugaagaacccuaccguggacggcaucaugaccauugaucucgaccccgucaucuacgauuccaaauucgagaagcagcugggccaggugaugcuucugguucucugugccgugcagcugcugcucaugagaacaucuugggcucuuugcgaggcccugacccuggcgacagggccuauuacgacccucugggaaggaagcccgggcaaauuuuggaauacaaccaucgccgucuccauggcuaacaucuuccgcgggucuuaucuggccggagcuggccuugccuuuagcauuaugaaguccguggggacaggaaaacggggcaccggcagccaaggggagacgcugggagaaaaguggaagaaaaagcucaaucagcugucuagaaaagaguucgaccuguacaagaaauccggcaucaccgagguggaucgcacagaagcgaaggaggggcucaaacggggagaaauuacccaccaugccguuagcagaggcuccgcuaaacuucagugguuugucgagcggaacauggugauccccgaagggcgcgugauugaccugggauguggcagaggcggguggucuuauuacugcgccggacugaagaaagucacagagguucggggcuauaccaaagggggaccuggccacgaggaacccgugccuaugagcacauacggguggaauaucgugaaacucauguccggaaaggaugucuucuaccugcccccggagaaaugugacacccuucugugcgauauuggcgaaucuagcccuucccccacgguggaggagagccgcacaaucagaguucucaagaugguggaacccuggcugaagaacaaucaguucuguaucaaaguccugaacccuuauaugcccaccgugauugagcaccucgaacggcuucaacgcaagcauggcgggaugcugguuagaaauccucugucucggaacuccacccacgagauguacuggaucagcaauggaacaggcaacauuguggcuucugucaauauggugucccgccuccugcuuaacagauuuacgaugacccaucggagaccgacaaucgaaaaagacguggaucugggggccggaacccgccacgucaacgcugagcccgagacaccuaauauggacguuauuggcgaacggaucaagagaaucaaagaggaacacaacagcaccuggcauuaugacgaugagaaucccuaccgcacaugggccuaucacgggucuuacgaagugaaggcgaccggaagcgccuccucuaugauuaacggcguggucaagcuccugacgaaaccuugggacgugguucccauggugacccagauggcuaugacagauaccacaccguucggccagcaacgggucuuuaaggagaaaguggacaccagaacgccucgcagcaugcccgggacacggagaguuaugggaaucaccgccgaguggcuguggcgcacacucggccggaauaagaaaccuagacugugcacccgcgaagaguucacgaagaaggugcggaccaacgcugccaugggggccgucuuuacagaagagaaucagugggauuccgcgaaagcugccguggaagacgaggauuucuggaaacuuguugacagagagcgcgaacugcauaaacucggaaaguguggcagcugcguguauaacaugauggggaaaagagagaagaaacugggcgaauuuggaaaggccaagggcucccgggcuauuugguacauguggcuuggggcccgcuaccuggaguucgaggcucucggauuucugaaugaagaucacugguucucuagagagaacagcuauuccggcgucgaaggggagggacugcauaaacucggcuacauccugcgggacauuucuaagauccccgggggcgccauguaugcggaugacaccgccggaugggacacaagaaucaccgaagaugaccuucacaaugaggagaaaauuacacagcagauggauccugaacaccggcaacuggcuaacgccaucuuuaagcucaccuaccagaauaaaguggucaaggugcagcgccccacgccgacaggcaccguuauggacauuaucagcagaaaggaucagcggggguccggacaagugggcaccuaugggcugaacacauucaccaauauggaggcucagcuuauucgccagauggaaggagagggcguccugucuaaagccgaccucgaaaacccucaucugcccgagaagaaaaucacacaguggcuggagacgaaggggguggaaagacucaaacggauggcgaucagcggcgaugacugcgugguuaagcccauugaugaccgcuuugccaacgcucugcuugcccugaaugauaugggaaaggugagaaaagacaucccucaauggcagccguccaagggcuggcacgauuggcagcagguccccuucuguagccaucacuuccacgagcucauuaugaaagacgggcggaagcuggugguuccuugccgcccccaagacgaacuuaucggacgggcucggauuucucagggcgccggguggucccugcgcgagaccgcuugucucggaaaagccuacgcgcagauguggagccugauguauuuucauagacgggaucugcgccucgccucuaacgcuaucugcuccgccgugccuguccacugggugcccacaagcagaaccacauggucuauucaugcccaccaucaauggaugaccacggaagacaugcugaccgucuggaaucggguguggaucgaggauaacccuuggauggaggacaagacacccguuaccacaugggaaaaugugccguaccuuggcaagagagaggaucaguggugugggucccugaucggccucaccagccgcgcuacgugggcccagaacauuccuacagcgauccagcaaguccggucccugauuggaaaugaagaguuccuugacuacaugcccagcaugaaaagauuucgcaaggaggaagagucugaaggcgcuaucugguga

SEQ ID NO: 20829 - RNA, 9873 nt, Artificial Sequence
  derived and/or modified CDS sequence (opt5) from DENV-3__EU482452__SS-prME
accagccucugccucaugaugaugcugcccgccacacuugcuuuccaccugacgucccgggacggcgaaccucggaugaucguggggaagaacgaacgcggaaagucucuccuguuuaagaccgccuccggcauuaauauguguacacuuaucgcgauggaucugggggagaugugcgacgauaccgucacauacaaguguccgcucauugcugaaguugagcccgaagacaucgauugcugguguaaccugaccuccacaugggugaccuauggaacgugcaaucaggccggcgagcaucggcgggacaagcgcucuguggcccuggcuccucacgucgggaugggacucgauaccagaacacagaccuggaugagcgccgagggcgcuuggagacagguggaaaagguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaagcccacgcucgacaucgagcugcagaagaccgaagcuacacagcuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggucacaugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccucgcaccggacuugauuucaaugagaugauccugcucacgaugaaaaacaaggcuuggaugguccacagacagugguuuuucgaccugccccuuccguggaccagcggcgccacaaccgagacaccuaccuggaaucggaaagaacugcucgugacguuuaagaacgcccaugcuaaaaagcaagagguugugguccuggggucucaggaaggagcgaugcacacagcccugaccggcgcuacagagauucaaaauuccgggggcaccagcaucuucgccggacaccucaagugucgccugaaaauggauaaacuugaacugaaaggcaugucuuacgccaugugccucgacaccuuugugcugaagaaagagguuuccgagacacagcaugggacgauucugaucaagguggaauacaagggagaggaugcucccuguaaaaucccuuucagcaccgaagacggccaagggaaggcccacaacggaagacuuauuacagcgaaccccgucgugaccaaaaaggaggagcccgugaauaucgaagcugagccuccguucggcgaauccaacauuguuaucgggauuggcgauaaagcccucaagaucaauugguauaagaaaggaucuagcaucggcaagauguuugaggccacagcuagaggggccagacgcauggcuauucugggagacaccgccugggauuucggcuccgucgggggagugcugaacagccucggcaaaauggugcaucagaucuuugggucugcguacacggcccuguucuccggcgucagcuggauuaugaagaucggaauuggcgugcuucugacauggaucgggcucaauucuaaaaacaccagcauguccuuuucuugcauuguuaucggaaucauuacccuguaucugggcgcugugguccaggccgacauggggugugugaucaauuggaagggaaaggaacuuaaaugcggcagcgggauuuucguuacaaacgaggugcacaccuggacagagcaguacaaguuucaagcugauucccccaaacggcucgccacggcgaucgccggcgcuugggaaaauggagucuguggcauuagaagcaccacacgcauggagaaccugcuguggaagcagaucgccaaugaacucaacuauauccugugggagaauaacauuaaacuuaccgugguugugggggacgucaucggagugcuggaacagggcaagcggacacucaccccucagcccauggagcugaaauacucuuggaagacgugggggaaggcuaaaauugugaccgccgagacacaaaauuccagcuucaucauugacggacugaacaccccugaaugccccucugccuccagagcuuggaacgucugggagguugaagauuauggcuuuggcguguucacaaccaauaucuggcuuaagcuccgcgagguguacacacagagcugugaccaucggcugauguccgcggccaucaaagaugaaagagcuguccacgccgacaugggguacuggauugagucucagaagaacggaagcuggaaacuggagaaggccuccuuuaucgaagugaagaccugcacguggccgaaaucucacacacucuggagcaauggcguucuggaguccgauaugauuaucccuaagagccuugcugggcccauuucucagcauaaccaccgcccuggauaucauacccaaaccgccggccccuggcaccuggggaaacucgaacuggacuucaauuacugcgagggaacaaccguggucaucacggagaacuguggcacacggggcccuucccugagaaccacaaccgugagcgggaaacuuauccacgaauggugcugucgcucuugcacacugcccccgcugcgguauaugggagaggauggcuguugguacgggauggaaauuagaccuaucaaugagaaagaagagaacaugguuaagucccuggugagcgcgggaucuggcaaggucgacaauuuuaccaugggggugcucugccuggcuauucuuuucgaggaaguuaugcggggaaaauucggcaagaaacauaugaucgccggcgugcuguuuacguucguccuccugcugagcgggcagauuaccuggcgcgauauggcccacacacuuaucaugauuggauccaacgcuagcgacagaaugggcaugggggugaccuaucuggcccucaucgcgacauuuaagauccagcccuuccuggcucucggauuuuuccugcggaaacuuaccucuagagagaaucugcuccugggcguggggcuggccauggccacgacacuucaacugcccgaagauauugagcagauggcuaacggaaucgcccucggccugaugacccucaagcugauuacacaguuugaaaccuaccagcuuuggaccgcucuggucucccucacauguagcaauacgaucuucacccugacaguugccuggcgcaccgcgacacugauucuugccggcgugucccugcucccucugugccaaucuagcuccaugcggaagaccgacuggcucccgaugacgguggcugccaugggggucucuccccugccucuuuuuaucuucagccugaaagauacacccaagagacgcuccuggccucugaacgagggagugauggcuguuggccucgugucuauccuggccagcucccuucugagaaaugacguccccauggccgggccucucguggcuggaggccugcucauugcguguuauguuaucaccgggaccagcgccgaccugacaguggagaaagcugccgaugucaccugggaagaggaagccgagcagacaggagugucucauaaccuuaugauuacggucgacgaugacggcaccaugcggaucaaggaugacgaaacagagaacauucugaccgugcugcucaaaacagcucugcuuaucguuuccggcaucuuucccuacagcauuccggccacccugcucguguggcacacguggcagaagcagacccaacgcucugggguccugugggaugugccuucucccccugagacacagaaagcggaacucgaggaaggaguuuacagaaucaagcagcagggcauuuucgggaagacccaagugggagucggcgugcagaaagaggggguguuucauacaauguggcacguuacccggggagcuguccugacacacaauggcaagcgccuugagcccaacugggccagcgugaaaaaggaccugaucagcuauggcgggggauggagacuguccgcccaguggcaaaaaggcgaagaggugcaggucauugcuguggaaccggggaagaauccuaagaacuuccagacgaugcccggaaucuuccagaccacaaccggcgagauuggggccaucgcgcucgauuuuaaaccuggaaccagcggcucccccaucauuaaucgggaaggcaagguuguggggcuguacggaaacggcgucgugaccaagaaugggggauauguuagcggcaucgcucaaacgaacgccgagcccgacgggccuaccccggagcuugaagaggaaauguucaagaaacgcaaucugacaauuauggaucuccaucccggcucuggaaagaccagaaaguaccugccugccaucgugcgggaggcuauuaaacgcagacuccggacacugauccuugcccccaccagagucguggcugccgaaauggaggaggcgcugaagggccugccuauccgcuaucagacgacagccaccaaaagcgaacacaccgggcgggagauuguugaccucaugugccaugcuacauuuaccaugagacugcuuucccccgugcgcgucccuaacuacaaucugaucauuauggaugaagcccacuucacagacccggcuucuaucgccgcccggggauauauuagcaccagagugggcaugggggaggcugcggccaucuuuaugacggcuacacccccuggaaccgccgaagccuucccccaguccaacgcuccuauccaggacgaggagcgcgauauucccgaacggucuuggaauagcggcaacgaguggaucacagacuuuguggggaagaccgucugguucguuccguccauuaaagccggcaaugauaucgcgaacugucucagaaagaacggaaagaaagugauucaacugucucgcaagacguuugacaccgaauaccagaaaacacggcugaaugauugggacuucguggucaccacagauaucagcgagaugggcgcuaacuuuaaggccgacagagugauugauccucggcgcugccucaaacccguuauccuuaccgacgggcccgagagagugauccuggccggaccuaugcccgucacagcugccuccgcggcccagcggcgcggcagaguggggcggaauccucagaaggaaaacgaucaauacauuuucaccggacagccgcugaauaacgacgaggaccaugcucacuggacggaagccaagaugcuccuggauaauaucaacacacccgagggcauuaucccugcucuuuucgaacccgagagagagaaaagcgccgcuauugacggggaauaucgccugaagggcgagucucggaaaaccuuuguugaacucaugagacgcggagaucugccuguguggcuggcccacaaggucgcguccgagggcaucaaauacaccgaccggaaguggugcuucgauggggaaagaaauaaccagauccucgaggagaauauggacguggaaauuuggacaaaagagggagaacgcaagaaacuucggcccagauggcuggaugcccgcaccuauagcgacccgcuggcucucaaagaguuuaaggauuucgccgcuggcagaaaaucuaucgcccuggaccuugucacagaaauugggcgggugccuucccaucuggccuaccgcacgagaaacgcucucgauaaucugguuaugcugcacaccagcgagcauggaggccgggcguaucgccacgccguggaggaacuccccgagacaauggaaacccuucugcugcucggccugaugauccuucugacagggggagcuaugcucuuucugauuuccggcaaggggaucggaaaaaccucuaucggccugauuugugugaucgucagcuccgggaugcucuggauggccgacauuccucuucaguggaucgccagcgcuauuguucuggaguucuuuaugauggugcugcucauccccgagccugaaaagcaaagaacgccccaggauaaccagcuggccuacguggucauuggaauccuuacccuggcggccaucguggcugccaaugagaugggccuccuggaaacaaccaagcgggaccugggcaugucuaaagagccggggguuguguccccuacaagcuaucucgacgucgaucuucaccccgcuucugccuggacccuguacgcgguggccacgacagucauuacccccaugcugagacauacaaucgaaaacagcaccgcuaaugugucccucgccgcuauugccaaccaagcuguugugcugaugggacuugacaagggcuggccuaucucuaaaauggaucugggggucccgcuccuggcccugggaugcuacagccaggugaacccccucacccuuacagcggccguucugcugcucgugacgcacuaugcuauuaucggcccugggcugcaggccaaggcuacccgcgaggcccagaaacggacagccgcgggaaucaugaagaaucccaccgucgacggcauuaugacaaucgaucuugacccugugauuuacgauuccaaguucgagaaacaacugggccaggugaugcuccugguucugugugcuguccagcuccuucugaugagaaccucuugggcccugugcgaagcucucacgcuggccacagggcccaucaccacccuuugggagggaagcccuggcaaguuuuggaacacaaccauugccguguccauggcuaauaucuuccgcgggagcuaucuggccggagcgggccucgccuuuucuaucaugaaauccguggggacaggacggagaggcacgggcagccagggggaaacccugggagagaaguggaaaaagaagcugaaccaacucucccggaaagaguucgaccuuuacaagaaaucuggcauuacagaggucgaucgcaccgaggcuaaggaagggcugaaaagaggagagacaacccaucacgccguuagccggggcuccgcuaagcugcagugguuuguggaacgcaauauggugaucccggaggggagagucauugaccucggauguggccggggcggguggucuuauuacugcgccggacugaaaaaggugacggaaguucgcggcuauaccaaaggcgggcccgggcaugaggagccugugcccaugagcacauacggguggaacaucgucaaacuuauguccggaaaggauguguucuaccugccucccgaaaaaugugacacccuccugugcgauauuggcgagagcucuccguccccuacaguugaagagagcagaaccauccgggugcugaagauggucgagcccuggcucaaaaauaaccaguucuguauuaaggugcuuaaucccuauaugccuacagugaucgaacaccuggagcgccugcagagaaaguacggcgggaugcucguccggaacccccugucuagaaauuccacccacgaaauguauuggaucagcaacggaacgggcaauauuguuucuagcgugaacauggugucccgccuucugcucaaucgguuuacaaugacccauagacgcccuaccaucgagaaagacgucgaccugggggcgggaacacggcacgugaacgccgaaccggagacgcccaacauggauguuauuggcgagagaaucaagcgcauuaaagaagaacauucuagcaccuggcacuacgacgaugaaaauccuuauaagacaugggcuuaccacggguccuaugaggugaaagccaccggaagcgcuuccucuaugaucaacggcgucgugaagcugcucacaaagcccugggacguugugccuauggucacccaaauggccaugacagauaccacgcccuucggccagcagcggguguuuaaagaaaagguugacaccagaacaccgcgcccuaugcccgggacccggaaagugauggagaucacagcugaguggcuguggagaacccuuggacgcaauaagaaaccucggcugugcacgagagaagaguucacaaagaagguccgcaccaacgccgcgaugggcgccguguuuacagaagagaaucaaugggauagcgcuagagccgcugucgaagacgaggaguucuggaaacucguggaucgggaacgcgagcugcauaaacuugggaaauguggauccugcguuuacaacaugaugggcaagagagagaagaagcugggggaguuuggcaaagccaagggaucucgggccauuugguacauguggcucggcgcgagauaucuggaguucgaagcucugggguuucucaaugaggaccacugguucagccgggaaaacuccuacucuggaguggagggcgaagggcugcauaaacuuggauauauccugcgcgauauuagcaaaauccccggcggggccauguacgccgacgacaccgcuggcugggauacgagaauuaccgaggacgaucuccacaaugaggaaaagaucacacagcagauggacccugagcaucggcagcuggccaacgcuaucuuuaaacuuaccuaucaaaauaaggucgugaaagugcagcgccccacaccgaagggaaccguuauggauauuaucuccagaaaggaccagcggggcagcggacaggugggaacauacggccugaacaccuucacgaauauggaagcccaacucguccgccagauggagggggaaggagugcugucuaaagcggaucuggagaacccucaccuccuggagaagaaaauuacacaguggcuugaaaccaagggcguugagagacugaaacggauggccaucuccggggacgauugcguggucaagcccauugacgaucgcuuugcuaaugcccuccuggcucuuaacgacaugggcaaggugagaaaagauaucccccaguggcaaccuagcaagggauggcacgacuggcagcaggucccguucuguucucaucacuuccaugaacugaucaugaaagacggccggaagcucgugguucccugccgcccucaggaugagcugauugggagagcccggaucucccaaggagcgggcuggagccugaaagaaaccgccugucucgggaaggcuuaugcccagauguggucucugauguacuuucaccgcagagaccuucggcuggcuuccaacgccauuugcagcgcugugcccguccacuggaucccuacauccagaaccacauggagcauucaugcccaccaucaguggaugacgaccgaggauaugcucacaguguggaaucgcguuuggaucgaggacaaccccuggauggaagauaagaccccugugacaaccugggaggacguccccuaccugggaaaacgggaagaucaaugguguggcucucuuauugggcugacgagcagagcgaccugggcccagaauauccucacagcuauccaacaggugcgcucccugauuggcgacgaggaguuccuggauuauaugccgucuaugaagcgguuuagaaaagaagaggaaagcgagggagccaucugguga

SEQ ID NO: 20830 - RNA, 9873 nt, Artificial Sequence
  derived and/or modified CDS sequence (opt5) from DENV-3__EU482453__SS-prME
accagccugugccucaucaugaugcugcccgccacccuugcuuuccaccugacgucccgggacggcgaaccucggaugauuguggggaagaacgaacgcggaaagucucuccuguuuaagaccgccagcggcaucaauauguguacccuuauugcgauggaucugggggagaugugcgacgauaccgucacauacaaguguccgcucaucgcugaaguugagcccgaagacauugauugcugguguaaccugaccuccacaugggugaccuauggaacgugcaaucaggccggcgagcauagacgggacaagcgcucuguggcccuggcuccucacgucgggaugggacucgauaccagaacacagaccuggaugagcgccgagggcgcuuggcggcaggucgaaaagguugagacaugggcccugcgccaucccggcuucaccauccuugcgcuguuucucgcccacuacaucgggacgucccugacacagaagguggucauuuucauccuucugaugcucgugaccccuucuaugacaaugagauguguuggagugggcaaccgggacuuugucgaagggcugagcggagcuaccuggguggaugugguccuggagcauggcgggugcguuaccacaauggccaagaauaaacccacgcucgacauugagcugcagaagaccgaagcuacacagcuugccacccugcgcaaacucuguaucgagggaaagauuacaaacaucaccacggauuccagaugcccuacacagggcgaagcgauucugccggaggaacaggaccagaauuauguguguaaacacaccuacguggaucggggcugggggaacggaugcggccuuuucgggaagggaagccuggugaccugcgccaaguuucaaugucucgagcccaucgagggcaaagugguucaguaugaaaaucugaaguacacagugaucauuaccguccacacaggggaccagcaucaggugggaaacgacacgcaaggcguuaccguggagaucacaccucaggcuucuaccgucgaagccgugcugcccgaguauggcacacucgggcuggaaugcuccccucgcaccggacuugauuucaaugagaugauucugcucacgaugaaaaacaaggcuuggaugguccacagacagugguuuuucgaccugccccuuccguggaccagcggcgccacaaccgagacaccuaccuggaaucggaaagaacugcucgugacguuuaagaacgcccaugcuaaaaagcaagagguugugguccuggggucucaggaaggagcgaugcacacagcccugaccggcgcuacagagauccaaaauuccgggggcaccagcauuuucgccggacaccucaagugucgccugaaaauggauaaacuugaacugaaaggcaugucuuacgccaugugccucaacaccuuugugcugaagaaagagguuuccgagacacagcaugggacgauccugaucaagguggaauacaagggagaggacgcucccuguaaaauuccuuucagcaccgaagauggccaagggaaggcccacaacggaagacuuaucacagcgaaucccgucgugaccaaaaaggaggagcccgugaacauugaagcugagccuccguucggcgaauccaauaucguuauugggaucggcgacaaagcccucaagaucaacugguauaagaaaggaucuagcauuggcaagauguuugaggccacagcuagaggggccagacgcauggcuauccugggagauaccgccugggacuucggcuccgucgggggagugcugaauagccucggcaaaauggugcaucagauuuuugggucugcguacacggcccuguucuccggcgucagcuggaucaugaagauuggaaucggcgugcuucugacauggauugggcucaacucuaaaaauaccagcauguccuuuucuugcaucgcuaucggaauuaucacccuguaucugggcgccguugugcaggcugauauggggugugccauuaacuggaagggaaaggaacuuaaaugcggcagcgggaucuucgucacaaaugaggugcacaccuggacagagcaguacaaguuucaagcggacucccccaaacggcucgccacggcuauugccggcgcuugggaaaacggaguuuguggcaucagaagcaccacacgcauggagaaucugcuguggaagcagaucgccaacgaacucaauuauauucugugggagaacaauaucaaacuuaccguggucgugggggauauuaucggaguucuggaacagggcaagcggacacucaccccucagcccauggagcugaaauacucuuggaagacgugggggaaggccaaaauugugaccgcugagacacaaaacuccagcuucaucaucgacggaccuaacacccccgaaugcccgucugcguccagagccuggaaugucugggagguggaagacuauggcuuuggcguguucacaaccaacauuuggcugaaacuucgcgaggucuacacacagagcugugaucaucggcucauguccgcugccaucaaagacgaaagagccguucacgcugauaugggguacuggauugagucucagaagaauggaagcuggaaacuggagaaggccuccuuuaucgaagugaagaccugcacguggccuaaaucucacacacuguggagcaacggcgugcucgaguccgacaugauuauccccaagagccuggcggggccuaucucucagcauaaucaccgccccggauaucauacccaaaccgcuggcccuuggcaccuugggaaacuggaacucgauuucaacuacugcgagggaacaaccgucgugauuacggagaauuguggcacacggggccccucccugagaaccacaaccguuagcgggaagcugauccacgaauggugcugucgcucuugcacacuuccgccucuccgguauaugggagaggacggcuguugguacgggauggaaauuagacccaccaacgagaaagaagagaauauggugaagucccuggucagcgccggaucuggcaagguggauaacuuuacgauggggguucugugccucgccauccuguucgaggaagugaugcggggaaaauucggcaagaaacauaugauugcuggcguccuuuuuaccuucgugcugcuccugagcgggcagaucacauggcgcgacauggcccacacccugauuaugaucggauccaaugcgagcgauagaaugggcauggggguuacauaucuugcucugaucgccaccuuuaagauucagcccuuccucgcccugggauuuuuccuccggaaacugacgucuagagagaaccuucugcucggcguggggcuggcuauggccacaacccugcaacuuccugaagacaucgagcagauggcuaauggaauugcccugggccucaugacacugaagcucaucacccaguuugaaaccuaccagcuguggacagcgcuugucucccugacguguagcaacaccauuuucacacucaccguggccuggcgcacagcuacccugauccuggccggcgugucccuucugccgcucugccaaucuagcuccaugcggaagacggauuggcugcccaugacagucgcugccauggggguuccuccccucccucuguuuaucuucucucuuaaagacacccccaagagacgcagcuggccucugaaugagggagugauggccgugggccuggucuccauucucgcuucuagccugcuuagaaacgaugugcccauggcggggccgcugguugccggaggccuccugaucgcuuguuaugugauuaccgggacauccgccgaccucaccgucgagaaagccgcugacgugacaugggaagaggaagccgagcagacgggaguuagccauaaccugaugaucaccguggaugacgauggcacaaugcggauuaaggacgaugaaaccgagaauauccuuacaguccugcugaaaaccgcgcuccugaucgugucuggcauuuuuccuuacuccauccccgcuacgcuucuggucuggcacaccuggcagaagcagacacaacgcagcggggugcucugggacguuccuucucccccggagacccagaaagccgaacuggaggaaggaguguacagaauuaagcagcagggcaucuucgggaagacacaagucggagugggcguucagaaagaggggguguuucauaccauguggcacgucacacggggagccgugcucacgcacaacggcaagcgccuggagccuaauugggcuuccgugaaaaaggaucuuauuagcuauggcgggggauggagacugucugcccaguggcaaaaaggcgaagagguucaggucaucgcgguggaacccgggaagaacccuaagaauuuccagaccaugcccggaauuuuccagacaaccaccggcgagaucggggcuaucgcccuggacuuuaaacccggaacauccggcagcccuauuaucaaccgggaaggcaagguggucgggcucuacggaaauggcgugguuacgaaaaacgggggauauguguccggcauugcccaaaccaaugcugagccggaugggcccacaccugagcuggaagaggaaauguucaagaaacgcaaccuuaccaucauggaccugcaucccggcagcggaaagacaagaaaguaccucccugccauuguccgggaggcuaucaaacgcagacugcggacccucauccuggcccccacgagagugguugcggccgaaauggaggaggcucuuaagggccugccuauucgcuaucagacaaccgccaccaaaucugaacacacagggcgggagaucguggaucugaugugccaugcuaccuuuacaaugagacuccugagcccgguccgcgugcccaauuacaaccuuauuaucauggacgaagcccacuucaccgauccugccuccauugcugcgcggggauauaucucuacgagaguuggcaugggggaggccgcugccaucuuuaugacagccacacccccuggaacagcugaagccuucccccagagcaaugcgccgauucaggacgaggagcgcgacaucccugaacgguccuggaacucuggcaaugaguggauuaccgauuuuguggggaagacggucugguucgugcccagcaucaaagcuggcaacgacauugccaacugucugagaaagaauggaaagaaagugauccaacucucccgcaagaccuuugauacagaauaccagaaaacccggcugaacgacugggauuucgucguuacaaccgacauuucugagaugggcgccaauuuuaaggcugauagagugaucgacccccggcgcugccugaaaccugugauccucacagaugggcccgagagagucauucuugccggaccuaugccggugaccgcggccagcgcugcccagcggcgcggcagaguugggcggaacccccagaaggaaaaugaccaauacaucuucacgggacagccucugaacaaugaugaggaccaugcucacuggacagaagccaagaugcugcucgacaacauuaauacccccgagggcaucauuccugcucuguucgaacccgagagagagaaauccgccgcgaucgauggggaauaucgccuuaagggcgagagccggaaaaccuuuguggaacugaugagacgcggagaccucccggucuggcuggcccacaagguggcuucugagggcaucaaauacacagaucggaaguggugcuucgacggggaaagaaacaaucagauucuggaggagaacauggauguugaaaucuggaccaaagagggagaacgcaagaagcuccggccuagauggcuugacgcccgcacauauuccgauccccuggcucugaaagaguuuaaggacuucgccgccggcagaaaaagcauugcucucgaucuggugacggaaaucgggcgggucccuucucaucuugcguaccgcaccagaaaugcccuggacaaccucgugaugcugcacacauccgagcauggaggccgggcuuaucgccacgccgucgaggaacugcccgagaccauggaaacacuccuucugcugggccucaugauucugcuuaccgggggagccaugcuguuucucaucagcggcaaggggaucggaaaaacguccauuggccugaucugugugauuguuucuagcgggaugcuguggauggcugaugugccucuccaguggaucgccuccgcgauugugcuugaguucuuuaugaugguccugcugauccccgagccggaaaagcaaagaaccccucaggacaaucagcucgccuacguugugauuggaauccugacacuugcugccaucguggcugccaacgagaugggccugcucgaaaccacaaagcgggaucugggcaugagcaaagagcccggggucgugucucccaccuccuaucuggacguugaccuccacccugcgagcgccuggacgcuuuacgcuguggccacaaccgucauuacaccgaugcugagacauaccaucgaaaauucuaccgcuaacgugagccuggccgcuauugccaaccaagcggucgugcucaugggacuggauaagggcuggcccaucuccaaaauggaccuugggguuccucugcucgcccugggaugcuacucucaggugaauccccugacacucacggcugccguccuucugcuggugacccacuaugcuauuaucggcccugggcuccaggccaaggccacacgcgaggcgcagaaacggaccgcugccggaaucaugaagaaccccacaguugauggcauuaugaccaucgaccuggauccugugauuuacgacagcaaguucgagaaacaacuuggccaggucaugcugcucgugcugugugcugugcagcugcuccuuaugagaacguccugggcccugugcgaagcccugacacucgcuaccgggccgaucaccacacugugggagggaucucccggcaaguuuuggaauaccacaauugccguuagcauggcgaacaucuuccgcggguccuaucuugccggagcuggccuggccuuuagcaucaugaaaucugucgggacgggacggagaggcaccggcucccagggggaaacacucggagagaaguggaaaaagaagcugaaucaacugagccggaaagaguucgaucucuacaagaaauccggcauuaccgagguggaccgcacagaggcuaaggaagggcuuaaaagaggagagaccacgcaucacgccgugucucggggcagcgcgaagcugcagugguuugucgaacgcaacaugguuaucccugaggggagagugauugaucugggauguggccggggcgggugguccuauuacugcgccggacucaaaaaggugaccgaaguccgcggcuauacaaaaggcgggcccgggcaugaggagccugugcccaugucuaccuacggguggaauaucguuaaacugaugagcggaaaggacguguucuaccuuccgccugaaaaaugugauacacugcucugcgacauuggcgaguccagccccucucccaccgucgaagaguccagaacaauccgggugcugaagaugguugagccuuggcugaaaaacaaucaguucuguauuaaggugcucaaccccuauaugccuaccgucaucgaacaccuugagcgccugcagagaaaguacggcgggaugcuggugcggaauccgcucagcagaaacucuacgcacgaaauguauuggaucuccaauggaacaggcaacauugugagcucugucaauaugguuagccgccugcuucugaaccgguuuaccaugacccauagacgccccacaaucgagaaagauguggaccucggggcuggaacgcggcacgugaacgccgaaccugagacccccaauauggacgucauuggcgagagaaucaagcgcauuaaagaagaacacuccucuacauggcacuacgaugacgaaaacccuuauaagaccugggcuuaccacgggagcuaugaggugaaagccacaggauccgcuagcuccaugaucaauggcguugugaagcugcugaccaagcccugggaugucgugccgaugguuacacaaauggccaugaccgacacgaccccuuucggccagcagcggguguuuaaagaaaaggucgauacaagaacaccccgcccuaugcccgggacacggaaagugauggagaucaccgcggaguggcucuggagaacgcugggacgcaacaagaaaccucggcuuugcacaagagaagaguucaccaagaagguucgcacaaaugccgcuaugggcgccguguuuaccgaagagaaccaaugggacucugcuagagccgccgucgaagaugaggaguucuggaaacugguggaccgggaacgcgagcuccauaagcuggggaaauguggaagcugcgucuacaauaugaugggcaagagagagaagaaacuuggggaguuuggcaaagcgaagggaucccgggcuauuugguacauguggcugggcgccagauaucucgaguucgaagcccugggguuucugaacgaggaucacugguucucucgggaaaauagcuacuccggaguggagggcgaagggcuccauaagcugggauauauccuucgcgacauuucuaaaauccccggcggggcuauguacgccgaugacacggcuggcugggacaccagaauuacagaggaugaccugcacaacgaggaaaagaucacccagcagauggauccggagcaucggcagcucgccaaugcgaucuuuaaacugacauaucaaaacaagguugugaaaguccagcgcccuacccccaagggaacagugauggacauuaucagcagaaaggaucagcggggcuccggacaggugggaaccuacggccuuaauacguucacaaacauggaagcccaacugguucgccagauggagggggaaggagugcucagcaaagcugaccuggagaauccccaucugcucgagaagaaaauuacccaguggcuggaaaccaagggcgucgagagacuuaaacggauggccaucucuggggaugacugcgugguuaagccuauugaugaccgcuuugcuaacgcccugcucgcgcugaacgauaugggcaaggugagaaaagacaucccgcaguggcaacccuccaagggauggcacgauuggcagcaggucccuuucuguagccaucacuuccaugaacuuaucaugaaagacggccggaagcuggugguccccugccgcccucaggacgagcucauugggagagcccggaucucucaaggagcuggcuggucccugaaagaaacagccugucuggggaaggcuuaugcccagauguggagccucauguacuuucaccgcagagaucugcggcuugcuucuaaugccauuugcuccgcggugcccguucacuggaucccuaccagcagaacaacgugguccauucaugcccaccaucaguggaugaccacagaggacaugcugaccguguggaaccgcgucuggaucgaggauaaucccuggauggaagacaagacaccggugaccacgugggaggauguuccuuaccucggaaaacgggaagaccaaugguguggcagccugauugggcuuaccucuagagcuacaugggcccagaacauccugaccgccauccaacaggugcgcagccucauuggcgaugaggaguuccuggacuauaugcccuccaugaagcgguuuagaaaagaagaggaacuggagggagcuaucugguga

SEQ ID NO: 20831 - RNA, 9873 nt, Artificial Sequence
  derived and/or modified CDS sequence (opt5) from DENV-3__EU482454__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacaaaccuggaugagcgccgagggcgcuuggcggcagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaaacccacgcucgacaucgagcugcagaagaccgaagcuacacaacuugccacccugcgcaaacucuguauugagggaaagaucacaaacauuaccacggauuccagaugcccuacacagggcgaagcgacccugccggaggaacaggaccagaauuauguguguaaacacaccuacguggaucggggcugggggaacggaugcggccuuuucgggaagggaagccuggucacaugcgccaaguuucaaugucucgagcccaucgagggcaaagugguucaguaugaaaaucugaaguacaccgugauuaucacaguccacacgggggaccagcaucaggugggaaacgacacccaaggcguuacaguggagaucaccccucaggcuucuacagucgaagccgugcugcccgaguauggcacccucgggcuggaaugcuccccucgcacgggacuugauuucaaugagaugauucugcucaccaugaaaaacaaggcuuggaugguccacagacagugguuuuucgaccugccccuuccguggacaagcggcgccaccacagagaccccuacguggaaucggaaagaacugcucgugacauuuaagaacgcccaugcuaaaaagcaagagguugugguccuggggucucaggaaggagcgaugcacaccgcccugacaggcgcuaccgagauccagaauuccgggggcaccagcauuuucgccggacaccucaagugucgccugaaaauggauaagcuugaacugaaaggcaugucuuacgccaugugccucaacacauuugugcugaagaaagagguuuccgagacgcagcaugggaccauccugauuaagguggaauacaagggagaggacgcucccuguaaaaucccuuucagcacagaagauggccaagggaaggcccacaacggaagacuuaucaccgcgaaucccgucgugacaaaaaaggaggagcccgugaacauugaagcugagccuccguucggcgaauccaauaucguuauugggaucggcgacaaagcccucaagauuaacugguauaagaaaggaucuagcaucggcaagauguuugaggccaccgcuaaaggggcccggagaauggcuauccugggagauacggccugggacuucggcuccgucgggggagugcugaauagccucggcaagauggugcaucagauuuuugggucugcguacacagcccuguucuccggcgucagcuggaucaugaaaauuggaaucggcgugcuucugaccuggauugggcucaacucuaagaauaccagcauguccuuuucuugcaucguuauuggaaucaucacacuguaucugggcgcugugguccaggccgauauggggugugugauuaacuggaagggaaaagaacuuaagugcggcagcgggaucuucguuaccaaugaggugcacacauggacggagcaguacaaauuucaagcugacucccccaagcgccucgccaccgcgauugccggcgcuugggaaaacggagucuguggcauccggagcacaaccagaauggagaaucugcuguggaaacagauugccaacgaacucaauuauauccugugggagaacaauaucaagcuuacagugguugugggggauauuaucggaguccuggaacagggcaaacgcacccucacgccucagcccauggagcugaaguacucuuggaagaccugggggaaagcuaagauugugacagccgagacccaaaacuccagcuucaucauugacggaccuaacacacccgaaugcccgucugccucccgggcuuggaaugugugggaggucgaagacuauggcuuuggcguuuucaccacaaacaucuggcugaaacuuagagagguguacacccagagcugugaucaucgccucauguccgcggccaucaaggacgaacgggcugugcacgccgauaugggguacuggauugagucucagaaaaauggaagcuggaagcuggagaaggccuccuuuaucgaagucaaaacgugcacauggccuaagucucacacccuguggagcaacggcgugcucgaguccgacaugauuauccccaaaagccuggcugggccuauuucucagcauaaucacagacccggauaucauacccaaacagccggcccuuggcaccuugggaagcuggaacucgauuucaacuacugcgagggaaccacgguugugaucacagagaauuguggcacccgcggccccucccugcggacaaccacagucagcgggaaacugauccacgaauggugcuguagaucuugcacccuuccgccucuccgcuauaugggagaggacggcuguugguacgggauggaaauucggcccaucaacgagaaggaagagaauauggugaagucccugguuagcgcgggaucuggcaaaguggauaacuuuacgauggggguccugugccucgcuauucuguucgaggaagugaugagaggaaaguucggcaaaaagcauaugaucgccggcguucuuuuuaccuucgugcugcuccugagcgggcagauuacauggcgggacauggcccacacccugaucaugauuggauccaaugcuagcgaucgcaugggcaugggggucacauaucuugcccugaucgcgaccuuuaaaauccagcccuuccucgcucugggauuuuuccucagaaagcugacgucucgggagaaccuucugcucggcguggggcuggccauggccacaacccugcaacuuccugaagacauugagcagauggcuaauggaaucgcccugggccucaugacacugaagcucauuacccaguuugaaaccuaccagcuguggacagcucuugugucccugacguguagcaacaccaucuucacacucaccgucgccuggagaacagcgacccugauucuggccggcguuucccuucugccgcucugccaaucuagcuccaugcgcaaaacggauuggcugcccaugacaguggcugccaugggggugccuccccucccucuguuuaucuucucucuuaaggacacccccaaacggagaagcuggccucugaaugagggagucauggcugugggccugguuuccauccucgccucuagccugcuucgcaacgaugugcccauggccgggccgcuggucgcuggaggccuccugauugcguguuaugugaucaccgggacauccgccgaccucaccguugagaaggcugccgacgugacaugggucgaagaggccgaacagacgggagugagccauaaccugaugauuaccgucgaugacgauggcacaaugagaaucaaagacgaugagaccgaaaauauucuuacagugcugcugaagaccgcucuccugaucguuucuggcaucuuuccuuacuccauucccgccacgcuucugguguggcacaccuggcagaaacagacacaacggagcgggguccucugggacgugccuucucccccggagacccagaaggcggagcuggaagagggaguuuaccgcaucaagcagcagggcauuuucgggaaaacacaagugggagucggcgugcagagagaagggguguuucauaccauguggcacguuacacggggagcuguccucacgcacaacggcaagcgccuggagccuaauugggccuccgugaaaaaggaucuuaucagcuauggcgggggauggagacugucugcccaguggcaaaaaggcgaggaagugcaggucauugcuguggagcccgggaagaacccuaagaauuuccagaccaugcccggaacauuccagaccaccacaggcgaaaucggggccauugcgcuggacuuuaaacccggaacguccggcagcccuaucaucaaccgggagggcaagguuguggggcucuacggaaauggcgucgugaccaaaaacgggggauauguuuccggcauugcucaaacaaaugccgaaccggaugggcccaccccugagcuggaggaagagauguucaagaaacgcaaccuuacaaucauggaccugcaucccggcagcggaaagaccagaaaguaccucccugccauugugcgggaagcuaucaaacgcagacugcggacgcucauucuggcccccacaagagucguggcugccgagauggaagaggcgcuuaagggccugccuauccgcuaucagaccaccgccacaaaaucugagcacaccgggcgggaaaucguugaucugaugugccaugcuacauuuaccaugagacuccugagcccggugcgcguccccaauuacaaccuuauuaucauggacgaggcccacuucacggauccugcuuccauugccgcccggggauauaucucuacaagagugggcaugggggaagcugcggccauuuuuaugaccgcuacacccccuggaaccgccgaggccuucccccagagcaaugcuccgauccaggacgaagagcgcgacaucccugagcgguccuggaacucuggcaaugaauggauuacggauuuuguggggaagaccgucugguucguucccagcaucaaagccggcaacgacauugcgaacugucugagaaagaauggaaagaaagugauccaacucucccgcaagacauuugauaccgaguaccagaaaacacggcugaacgacugggauuucguggucaccacagacauuucugaaaugggcgcuaauuuuaaggccgauagagugaucgacccccggcgcugccugaaaccuguuauucucaccgaugggcccgagagagugauccuugccggaccuaugccggucacggcugccagcgcggcccagcggcgcggcagaguggggcggaacccccagaaggagaaugaccaauacaucuucacaggacagccucugaacaaugaugaagaccaugcucacuggaccgaggccaagaugcugcucgacaacauuaauacccccgaaggcaucauuccugcucuguucgagcccgaaagagagaaauccgccgcuaucgauggggaguaucgccuuaagggcgaaagccggaaaacauuuguugagcugaugagacgcggagaccucccgguguggcuggcccacaaggucgcgucugaaggcauuaaauacaccgaucggaaguggugcuucgacggggagagaaacaaucagauccuggaagagaacauggauguggagaucuggacaaaagaaggagagcgcaagaagcuccggccuagauggcuugacgcccgcacguauuccgauccccuggcucugaaagaauuuaaggacuucgccgcuggcagaaaaagcauugcccucgaucuggucaccgagaucgggcgggugccuucucaucuugcccaccgcacaagaaaugcucuggacaaccucguuaugcugcauaaguccgaacacggaggccgggcguaccgccacgccguggaggagcugcccgaaaccauggagacacuccuucugcugggccucaugauucugcuuaccgggggagcuaugcuguuucucaucagcggcaaagggauuggaaagacguccaugggccugaucugugugaucgucucuagcgggaugcuguggauggccgauguuccucuccaguggauugccuccgcuaucgugcuugaauucuuuaugauggugcugcugauucccgagccggagaagcaaagaaccccucaggacaaucagcucgccuaugucgugaucggaauucugacacuugcggccaucguugcugccaacgaaaugggccugcucgagaccacaaaacgggaucugggcaugagcaaggaacccgggguggucucucccaccuccuaccuggacguggaccuccauccugcuagcgccuggacgcuuuaugcggucgccacaaccgugauuacaccgaugcugagacacaccaucgagaauucuaccgcuaacguuagccuggccgcuaucgccaaccaagcugugguccucaugggacuggauaaaggcuggcccauuuccaagauggaccuuggggugccucugcucgcccugggaugcuacucucagguuaauccccugacacucacggcggccgugcuucugcuggucacccauuacgcuaucauuggcccugggcuccaggccaaagcuacacgcgaagcccagaagcggaccgccgcgggaaucaugaagaaccccacaguggauggcauuaugaccaucgaccuggauccugugaucuaugacagcaaauucgagaagcaacuuggccagguuaugcugcucguccugugugcugugcagcugcuccuuaugagaacguccugggcccugugcgaggcucugacacucgccaccgggccgauuaccacacugugggaaggaucucccggcaaauuuuggaauaccacaaucgccgugagcauggcuaacauuuuccgcggguccuaccuugccggagcgggccuggccuuuagcaucaugaagucugucgggacgggacggagaggcaccggcucccagggggagacacucggagaaaaauggaagaagaaacugaaucaacugagccggaaggaguucgaucucuauaaaaaguccggcauuaccgaaguugaccgcacagaggcuaaagaggggcuuaagagaggagaaaccacgcaccaugccgugucucggggcagcgcuaaacugcagugguuuguggagcgcaacauggucaucccugaagggagagugaucgaucugggauguggccggggcgggugguccuacuauugcgccggacucaagaagguuaccgaggugcgcggcuacacaaaagggggacccggccacgaagagccuguccccaugucuaccuauggguggaauauugugaagcugaugagcggaaaagacguuuucuaccuuccgccugagaagugugauacacugcucugcgacaucggcgaauccagccccucucccaccguggaggaauccagaacaauucggguccugaaaaugguggagccuuggcugaagaacaaucaguucuguaucaaggugcucaaccccuacaugccuaccgucauugagcaccuugaacgccugcagagaaaauauggcgggaugcugguucggaauccgcucagcagaaacucuacgcaugagauguacuggaucuccaauggaacaggcaacauugugagcucugugaauauggucagccgccugcuucugaaccgguuuaccaugacccacagacgccccacaaucgaaaaggauguggaccucggggcgggaacgcggcauguuaacgccgagccugaaacccccaauauggacgugaucggcgagagaauuaaacgcaucaaggaggaacacuccucuacauggcacuaugaugacgagaacccuuacaaaaccugggcuuaucaugggagcuacgaagucaaggccacaggauccgcuagcuccaugauuaauggcgugguuaagcugcugaccaaacccugggauguggucccgauggugacacaaauggccaugaccgacacgaccccuuucggccagcagcggguuuuuaaggagaaaguggauacaagaaccccccgcccuaugcccgggacacggaaggucauggaaaucaccgcugaguggcucuggagaacgcugggacgcaacaaaaagccucggcuuugcacaagagaggaauucaccaagaaagugcgcacaaaugccgcgaugggcgccgucuuuaccgaggaaaaccaaugggacucugcuagagccgcuguggaggaugaagaguucuggaagcugguugaccgggagcgcgaacuccacaaacuggggaaguguggaagcugcguguauaauaugaugggcaaaagagagaagaaacuuggggaauuuggcaaggccaagggaucccgggccauuugguacauguggcugggcgcgagauaccucgaguucgaggcucugggguuucugaacgaagaucauugguucucucgggagaauagcuauuccggagucgaaggcgaggggcuccacaaacugggauacauccuucgcgacaucucuaagauucccggcggggccauguaugccgaugacacggcuggcugggacaccagaaucacagaagaugaccugcauaacgaggagaaaauuacccagcagauggauccggaacaccggcagcucgccaaugcuaucuuuaagcugacauaccaaaacaaaguggugaagguucagcgcccuacccccaagggaacagugauggacauuaucagcagaaaagaucagcggggcuccgggcaggucggaaccuauggccuuaauacguucacaaacauggaggcccaacuggugcgccagauggaaggggagggaguucucagcaaggcggaccuggaaaauccccaccugcucgagaaaagaaucacccaguggcuggagaccaagggcguggaacggcuuaaacgcauggccauuucuggggaugacugcgucgugaagccuaucgaugacagauuugcuaacgcccugcucgcucugaacgauaugggcaagguccggaaagacauuccgcaguggcaacccuccaagggauggcaugauuggcagcaggugccuuucuguagccaccauuuccacgagcuuaucaugaaagacggccgcaagcugguugugcccugcagaccucaggacgaacucauugggcgggcccgcaucucucaaggagcgggcuggucccugaaagagacagccugucuggggaaggcuuacgcccagauguggagccucauguauuuucacagacgggaucugagacuugcuucuaaugccaucugcuccgcuguccccgcccauuggauuccuaccagccgcacaacgugguccauccacgcgcaucaccaguggaugaccacagaagacaugcugaccguguggaaccggguuuggauugaggauaaucccuggauggaggacaagacaccggugaccacgugggaagaugucccuuaccucggaaaaagagaggaccaaugguguggcagccugaucgggcuuaccucucgcgccacaugggcucagaacauucugaccgccauccagcaggugcggagccucauuggcgaugaagaguuccuggacuacaugcccuccaugaagagauuucgcaaagaggaagagucugaaggagccaucugguga

SEQ ID NO: 20832 - RNA, 9873 nt, Artificial Sequence
  derived and/or modified CDS sequence (opt5) from DENV-3__EU482455__SS-prME
accagccugugccucaugaugaugcugcccgcuacacuugcuuuccaccugacguccagagacggagaaccucggaugaucguggggaagaacgaacgcggaaaaucucuccuguuuaagaccgccagcggaauuaauauguguacacuuaucgcgauggaucugggggagaugugcgacgauaccgugacauacaaauguccgcucguugcugaaguggagcccgaagacauugauugcugguguaaccugaccuccacaugggugaccuauggaacgugcaaucaggccggcgagcauagacgggacaagcgcucuguggcccuggcuccucacguggggaugggacucgauaccagaacacagaccuggaugagcgccgagggcgcuuggcggcagguugaaaaaguggagacaugggcccugcgccaucccggcuucaccauccuugcgcuguuucucgcccacuacauugggacgucccugacacagaaggucgugaucuucauccuucugaugcucguuaccccuucuaugacaaugagaugugugggagucggcaaccgggacuuuguggaagggcugagcggagcuaccuggguggaugucguucuggagcauggcgggugcgugaccacaauggccaagaauaaacccacgcucgacauugagcugcagaagaccgaagcuacacagcuugccacccugcgcaaacucuguaucgagggaaagauuacaaacaucaccacggauuccagaugcccuacacagggcgaagcgauucugccggaggaacaggaccagaauuauguguguaaacacaccuacgucgaucggggcugggggaacggaugcggccuuuucgggaagggaagccuggugaccugcgccaaguuucaaugucucgagcccaucgagggcaaaguugugcaguaugaaaaucugaaguacacagucauuaucaccgugcacacaggggaccagcaucagguuggaaacgacacgcaaggcgugaccgucgagaucacaccucaggcuucuaccguggaagccguccugcccgaguauggcacacucgggcuggaaugcuccccucgcaccggacuugauuucaaugagaugauucugcucacgaugaaaaacaaggcuuggauggugcacagacagugguuuuucgaccugccccuuccguggaccagcggcgccacaaccgagacaccuaccuggaauaaaaaggaacugcucguuacguuuaaaaacgcccaugcuaagaagcaagagguggucgugcuggggucucaggaaggagcgaugcacacagcccugaccggcgcuacagagauccaaaauuccgggggcaccagcauuuucgccggacaccucaaaugucggcugaagauggauaaacuugaacugaagggcaugucuuacgccaugugccucaacaccuuuguucugaaaaaggagguguccgagacacagcaugggacgauccugauuaaggucgaauacaaaggagaggacgcucccuguaagaucccuuucagcaccgaagauggccaagggaaagcccacaacggacgccuuaucacagcgaaucccguggugaccaagaaagaggagcccguuaacauugaagcugagccuccguucggcgaauccaauaucgucauugggaucggcgacaaggcccucaagauuaacugguauaaaaagggaucuagcaucggcaaaauguuugaggccacagcuagaggggcccggagaauggcuauccugggagauaccgccugggacuucggcuccgucggcggggugcugaauagccucgggaagaugguccaucagauuuuugggucugcguacacggcccuguucuccggcgugagcuggaucaugaaaauuggaaucggcguucuucugacauggauugggcucaacucuaagaauaccagcauguccuuuucuugcaucgugauuggaaucaucacccuguaucugggcgcugucgugcaggccgauauggggugugcuauuaacuggaagggaaaagaacuuaagugcggcagcgggaucuucguuacaaaugaggugcacaccuggacagagcaguacaaauuucaagccgacucccccaagcgccucgcgacggccauugcuggcgccugggaaaacggagucuguggcauccggagcaccacaagaauggagaaucugcuguggaaacagauugcuaacgaacucaauuauauccugugggagaacaauaucaaacuuaccgugguugugggggauauuaucggaguccuggaacagggcaaacgcacacucaccccucagcccauggagcugaaguacucuuggaagacgugggggaaagccaagauugugaccgccgagacacaaaacuccagcuucaucauugacggaccuaacacccccgaaugcccgucugcuucccgggcguggaaugugugggaggucgaagacuauggcuuuggcguuuucacaaccaacaucuggcugaaacuuagagagguguacacacagagcugugaucaucgccucauguccgccgcuaucaaggacgaacgggccgugcacgccgauaugggguacuggauugagucucagaaaaauggaagcuggaagcuggagaaggcuuccuuuaucgaagucaaaaccugcacguggccuaagucucacacacuguggagcaacggcgugcucgaguccgacaugauuauccccaaaagccuggccgggccuauuucucagcauaaucacagacccggauaucauacccaaaccgcgggcccuuggcaccuugggaagcuggaacucgauuucaacuacugcgagggaacaaccguugugaucacggagaauuguggcacacgcggccccucccugcggaccacaaccgucagcgggaaacugauccacgaauggugcuguagaucuugcacacuuccgccucuccgcuauaugggagaggacggcuguugguacgggauggaaauucggcccaucaacgagaaggaagagaauauggugaagucccugguuagcgcuggaucuggcaaaguggauaacuuuaccauggggguccugugccucgccauucuguucgaggaagugaugagaggaaaguucggcaaaaagcauaugaucgccggcguucuuuuuacguucgugcugcuccugagcgggcagauuaccuggcgggacauggcucacacacugaucaugauuggauccaaugccagcgaucgcaugggcaugggggucaccuaucuugcgcugaucgcuacauuuaaaauccagcccuuccucgcccugggauuuuuccucagaaagcugaccucucgggagaaccuucugcucggcguggggcuggccauggcuacgacacugcaacuuccugaagacauugagcagauggccaauggaaucgcucugggccucaugacccugaagcucauuacacaguuugaaaccuaccagcuguggaccgcccuugugucccugacauguagcaacacgaucuucacccucacagucgcguggagaaccgccacacugauucuggcuggcguuucccuucugccgcucugccaaucuagcuccaugcgcaaaaccgauuggcugcccaugacgguggccgcuaugggggugccuccccucccucuguuuaucuucucucuuaaggacacacccaaacggagaagcuggccucugaaugagggagucauggccgugggccugguuuccauccucgccucuagccugcuucgcaacgaugugcccauggcugggccgcuggucgcgggaggccuccugauugccuguuaugugaucaccgggaccuccgcugaccucacaguugagaaggccgccgacgugaccugggaagaggaagcugagcagacaggagucagccauaaccugaugauuacgguggaugacgauggcaccaugagaaucaaagacgaugaaacagagaauauucuuaccguccugcugaagacagcccuccugaucgugucuggcaucuuuccuuacuccauucccgcgacccuucugguuuggcacacguggcagaaacagacccaacggagcggggugcucugggacgucccuucucccccggagacacagaaggcugaacuggaggaaggaguguaccgcaucaagcagcagggcauuuucgggaaaacccaaguuggagugggcguccagaaggaggggguguuucauacaauguggcacgugaccagaggagccguucucacacacaacggcaaacggcuggagccuaauugggccuccgucaagaaagaucuuaucagcuauggcgggggauggcgccugucugcucaguggcaaaagggcgaagagguccaggugauugccgucgaacccgggaagaacccuaaaaauuuccagacgaugcccggaaucuuccagaccacaaccggcgagauuggggcgaucgcucuggacuuuaagcccggaaccuccggcagcccuaucauuaacagagaaggcaaagugguugggcucuacggaaauggcguggucacaaagaacgggggauauguguccggcaucgcccaaacgaaugccgagccggaugggcccaccccugagcuggaagaggaaauguucaaaaagcggaaccuuacaauuauggaccugcaucccggcagcggaaagacccgcaaauaccucccugcuaucguuagagaggccauuaagcggcgccugagaacacucauccuggcucccacccggguggucgccgcggaaauggaggaggcccuuaaaggccugccuaucagauaucagacgacagcuaccaagucugaacacaccgggcgcgagauuguggaucugaugugccaugccacauuuaccaugcggcuccugagcccgguuagagugcccaauuacaaccuuaucauuauggacgaagcucacuucacagauccugccuccaucgccgcucgcggauauauuucuacccgggucggcaugggggaggcggccgcuaucuuuaugacggccacacccccuggaaccgccgaggcuuucccccagagcaaugccccgauccaggacgaggagagagacauuccugaacgcuccuggaacucuggcaaugaguggaucacagauuuuguggggaaaaccgugugguucguccccagcauuaaggcgggcaacgacaucgcuaacugucugcggaagaauggcaagaagguuauucaacucuccagaaaaacguuugauaccgaauaccagaagacacgccugaacgacugggauuucguggugaccacagacaucucugagaugggcgccaauuuuaaagccgaucgggucauugaccccagacggugccugaagccugugauccucaccgaugggcccgagcgcguuauccuugcuggaccuaugccggugacagccgcgagcgccgcucagagacggggccgcgucgggagaaacccccagaaggaaaaugaccaauacauuuucaccggacagccucugaacaaugaugaggaccaugcccacuggacggaagcuaaaaugcugcucgacaacaucaauacacccgagggcauuaucccugcccuguucgaacccgagcgggagaaguccgcugccauugauggggaauauagacuuaaaggcgagagccgcaagaccuuuguggaacugaugcggagaggagaccucccgguuuggcuggcgcacaaaguggccucugagggcaucaaguacaccgaucgcaaauggugcuucgacggggaacggaacaaucagauccuggaggagaacauggaugucgaaauuuggacaaaggagggagaaagaaagaaacuccgcccucgguggcuugacgcuagaaccuauuccgauccccuggcccugaaggaguuuaaagacuucgcugccggccgcaagagcaucgccuuugaucucgugacagaaauugggagagucccuucucaucuggcuuaccggacgcgcaaugcgcuugacaaccuggugaugcuccacaccuccgagcauggaggcagagccuaucggcacgcuguugaggaacugcccgagacaauggaaacccugcuccuucugggccugaugauccuccugacagggggagccaugcuuuuccugauuagcggcaaagggaucggaaagaccuccaucggccucauuugugugaucgugucuagcgggaugcuguggauggccgaugucccucugcaguggauugcuuccgccaucguucucgaguuuuucaugauggugcuucugauucccgagccggaaaagcaacgcacgccucaggacaaucagcuggcguacguggucaucggcauucucacccuggccgcuaucguggccgcuaacgagaugggccuucuggaaacaaccaaaagagaucucggcaugagcaaggagcccgggguugugucucccacauccuaucuggacgucgaccugcacccugccagcgcguggacccucuacgccguggcuacgacagucaucaccccgaugcuucggcauacaauugaaaauucuaccgccaacgugagccuggcugccaucgcuaaccaagccguugugcugaugggacucgauaaaggcuggcccauuuccaagauggaccugggggucccucuucuggcgcucggaugcuacucucaggugaauccccugacccugacagccgcuguucuccuucuggugacgcacuaugccaucauuggcccugggcugcaggcuaaagccaccagagaggcccagaagcgcacagcggcuggaaucaugaagaaccccaccgucgauggcaucaugacaauugaccucgauccugugaucuacgacagcaaauuugagaagcaacugggccaggugaugcuucugguucucugugccguccagcugcugcucaugcggaccuccugggcucuuugcgaagcccugacgcuggccacagggccgauuaccacccucugggagggaucucccggcaaauucuggaauacaaccaucgcugugagcauggccaacauuuuuagaggguccuaucuggcgggagccggccuugcuuucagcaucaugaagucuguggggaucggacgccggggcacaggcucccagggggaaacgcugggagagaaauggaagaagaaacucaaucaacugagcagaaaggaauuugaucuguacaaaaaguccggcauuaccgaggucgaccggacagaggccaaagaagggcucaagcgcggagagaccacacaucacgcuguuucuagaggcagcgccaaacuucagugguucguggaacggaacauggugaucccugaggggcgcgucauugaucugggauguggcagaggcgggugguccuauuacugcgcgggacugaagaaggugaccgaaguucggggcuauacgaaagggggacccggccaugaggagccugugcccaugucuaccuacggguggaauaucgucaagcucaugagcggaaaagacguguucuaccugccgccugaaaagugugauacacuucugugcgacauuggcgaguccagccccucucccaccguugaagagucccgcacaaucagagugcucaaaauggucgagccuuggcugaagaacaaucaguuuuguauuaaggugcugaaccccuauaugccuaccgugaucgaacaccucgagcggcuucagcgcaaauacggcgggaugcuggucagaaauccgcugagccggaacucuacacacgaaauguauuggaucuccaauggaaccggcaacauuguuagcucugugaauauggugagcagacuccugcuuaaccgcuucacgaugacacaucggagacccaccaucgagaaggaugucgaccugggggccggaacccgccacgugaacgcugaaccugagacacccaauauggacguuauuggcgagcggaucaaaagaauuaaggaagaacacuccucuacguggcacuacgaugacgaaaacccuuauaaaaccugggccuaccacgggagcuaugaggugaaggcuacaggauccgccagcuccaugaucaauggcgucgugaagcuccugaccaaacccugggauguugugccgauggucacacaaauggcuaugaccgacacaaccccuuuuggccagcagcgcguguucaaggaaaaaguugauacgcggacccccagaccuaugcccgggacacgcaaggugauggagaucaccgccgaguggcuguggcggacacucggaagaaacaaaaagccucgccugugcacccgggaagaguuuacgaagaaagucagaacaaaugcggccaugggcgcuguguucaccgaagagaaccaaugggacucugcccgcgcugccgucgaagaugaggaguuuuggaaacuuguggacagagaacgggagcugcauaaacucgggaaguguggaagcugcguuuacaauaugaugggcaaacgcgaaaagaaacugggggaguucggcaaggccaagggauccagagcgauuugguacauguggcuuggcgcucgguaucuggaguuugaagcccucggguuccugaacgaggaucacugguuuucuagagaaaauagcuacuccggaguggagggcgaagggcugcauaaacucggauauauccugcgggacauuucuaagauccccggcggggccauguacgcugaugacacagccggcugggacacccgcauuacggaggaugaccuucacaacgaggagaagaucacccagcagauggauccggagcauagacagcuggcuaaugccaucuucaagcucacauaucaaaacaaagucgugaaggugcagcggccuacccccaagggaacaguuauggacauuaucagccgcaaagaucagagaggcuccggacaggugggaaccuacggccugaauacauuuaccaacauggaagcgcaacuuguccggcagauggagggggaaggagugcugagcaaggccgaccucgagaauccccaucugcuggagaaaaagauuacgcaguggcucgaaacaaaaggcguugagcgccugaagagaauggcuaucucuggggaugacugcguggucaagccuauugaugaccgguucgccaacgcccuucuggcccucaacgauaugggcaaagugcgcaaggacaucccgcaguggcaacccuccaaaggauggcacgauuggcagcaggucccuuucuguagccaucacuuucaugaacugaucaugaaggacggcagaaaacuugugguucccugccggccucaggacgagcugauugggcgcgcgagaaucucucaaggagccggcuggucccucaaggaaaccgcuugucuggggaaggccuaugcucagauguggagccugauguacuuccaccggcgcgaucucagacuggccucuaaugcuauuugcuccgccgugcccguccacuggaucccuaccagccggacaaccugguccauucaugcgcaccaucaguggaugacaacggaggacaugcuuaccguguggaacagaguuuggaucgaggauaaucccuggauggaagacaaaacaccggugaccacaugggaggaugucccuuaccugggaaagcgcgaagaccaaugguguggcagccucauugggcugaccucucgggccacgugggcucagaacauccuuaccgccauccaacaggugagaagccugauuggcgaugaggaguuucucgacuauaugcccuccaugaaacgcuuccggaaggaagaggaaucugagggagccaucugguga

SEQ ID NO: 20833 - RNA, 9873 nt, Artificial Sequence
  derived and/or modified CDS sequence (opt5) from DENV-3__EU482456__SS-prME
accagccugugccucaugaugaugcugcccgccacgcuugcuuuccaccugacgucccgggacggagaaccucggaugaucguggggaagaaugaacgcggaaagucucuccuguuuaagaccgccagcggcauuaauauguguacacuuaucgcgauggaucugggggagaugugcgacgauaccgucacauacaaguguccgcucauugcugaaguugagcccgaagacaucgauugcugguguaaccugaccuccacaugggugaccuauggaacgugcaaucaggccggcgagcaucggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaaacccacgcucgacaucgagcugcagaagaccgaagcuacacaacuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggugacaugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccucgcaccggacuugauuucacggagaugauccugcucaccaugaaaaauaaggcuuggaugguccacagacagugguuuuucgaccugccccuuccguggacaagcggcgccaccacagagaccccuacguggaaccggaaagaacugcucgugacauuuaagaaugcccaugcuaaaaagcaagagguugugguccuggggucucaggaaggagcgaugcacaccgcccugacaggcgcuaccgagauucagaacuccgggggcaccagcaucuucgccggacaccucaagugucgccugaaaauggauaaacuugaacugaaaggcaugucuuacgccaugugccucaauacauuugugcugaagaaagagguuuccgagacgcagcaugggaccauucugaucaagguggaauacaagggagaggacgcucccuguaaaaucccuuucagcacagaagauggccaagggaaggcccacaacggaagacuuauuaccgcgaaccccgucgugaccaagaaggaggagcccgugaauaucgaagcugagccuccguucggcgaauccaacauuguuaucgggauuggcgacaaagcccucaagaucaauugguauaagaaaggaucuagcaucggcaagauguuugaggccaccgcuagaggggccagacgcauggcuauucugggagauacggccugggacuucggcuccgucgggggagugcugaacagccucggcaaaauggugcaucagaucuuugggucugcguacacagcccuguucuccggcgucagcuggauuaugaagaucggaauuggcgugcuucugaccuggaucgggcucaauucuaaaaacaccagcauguccuuuucuugcauuguuaucggaaucauuacacuguaucugggcgcugugguccaggccgauauggggugugugaucaauuggaagggaaaggaacuuaaaugcggcagcgggauuuucguuaccaacgaggugcacacauggacggagcaguacaaguuucaagcugacucccccaaacggcucgccaccgcgaucgccggcgcuugggaaaauggagucuguggcauuagaagcacaacccgcauggagaaccugcuguggaagcagaucgccaaugaacucaacuauauccugugggagaauaacauuaaacuuacagugguugugggggauaccaucggaguccuggaacagggcaagcggacgcucaccccucagcccauggagcugaaauacucuuggaagacaugggggaaggcuaaaauugugaccgccgagacacaaaauuccagcuucaucauugacggaccuaacacccccgaaugcccgucugccuccagagcuuggaacgugugggaggucgaagacuauggcuuuggcguuuucacaaccaauaucuggcugaaacuucgcgagguguacacgcagagcugugaucaucggcucauguccgcggccaucaaagacgaaagagcugugcacgccgauaugggguacuggauugagucucagaagaacggaagcuggaaacuggagaaggccuccuuuaucgaagucaagacaugcaccuggccuaaaucucacacccuguggagcaauggcgugcucgaguccgacaugauuauccccaagagccuggcugggccuauuucucagcauaaccaccgccccggauaucauacacaaaccgccggcccuuggcaccuugggaaacuggaacucgauuucaauuacugcgagggaacgacaguugugaucaccgagaacuguggcacacggggccccucccugagaaccacaaccgucagcgggaagcugauccacgaauggugcugucgcucuugcacgcuuccgccucuccgguauaugggagaggacggcuguugguacgggauggaaauuagacccaucaaugagaaagaagagaacauggugaagucccugguuagcgcgggaucuggcaagguggauaauuuuaccauggggguccugugccucgcuauucuguucgaggaagugaugcggggaaaauucggcaagaaacauaugaucgccggcguucuuuuuacauucgugcugcuccugagcgggcagauuaccuggcgcgacauggcccacacacugaucaugauuggauccaacgcuagcgauagaaugggcaugggggucaccuaucuugcccugaucgcgacguuuaagauccagcccuuccucgcucugggauuuuuccuccggaaacugacaucuagagagaaucuucugcucggcguggggcuggccauggccaccacacugcaacuuccugaagacauugagcagauggcuaacggaaucgcccugggccucaugacccugaagcucauuacccaguuugaaacauaccagcuguggacggcucuugugucccugaccuguagcaauacaaucuucacccucacagucgccuggcgcaccgcgacgcugauucuggccggcguuucccuucugccgcucugccaaucuagcuccaugcggaagacagauuggcugcccaugaccguggcugccaugggggugccuccccucccucuguuuaucuucucucuuaaagacacccccaagagacgcagcuggccucugaacgagggagucauggcugugggccugguuuccauccucgccucuagccugcuuagaaaugaugugcccauggccgggccgcuggucgcuggaggccuccugauugcguguuaugugaucacagggaccuccgccgaccucacaguugagaaagcugccgacgugacgugggaagaggaagccgagcagaccggagucagccauaaccugaugauuacaguggaugacgauggcaccaugcggaucaaggacgaugaaacagagaacauucuuaccguccugcugaaaacggcucuccugaucgugucuggcaucuuuccuuacuccauucccgccacccuucugguuuggcacacauggcagaagcagacccaacgcagcggggugcucugggacgucccuucucccccggagacacagaaagcggaacuggaggaaggaguguacagaaucaagcagcagggcauuuucgggaagacccaaguuggagugggcguccagaaagaggggguguuucauacaauguggcacgugacgcggggagcuguucucacccacaauggcaagcgccuggagccuaacugggccuccgucaaaaaggaucuuaucagcuauggcgggggauggagacugucugcccaguggcaaaaaggcgaagagguccaggugauugcugucgaacccgggaagaauccuaagaacuuccagacaaugcccggaaucuuccagaccaccacaggcgagauuggggccaucgcgcuggacuuuaaacccggaacguccggcagcccuaucauuaaucgggaaggcaaggugguugggcucuacggaaacggcguggucaccaaaaaugggggauauguguccggcaucgcucaaacaaacgccgagccggaugggcccaccccugagcuggaagaggaaauguucaagaaacgcaaucuuacaauuauggaccugcaucccggcagcggaaagaccagaaaguaccucccugccaucguucgggaggcuauuaaacgcagacugcggacgcucauccuggcccccacaagaguggucgcugccgaaauggaggaggcgcuuaagggccugccuauccgcuaucagaccaccgccacaaaaucugaacacaccgggcgggagauuguggaucugaugugccaugcuacauuuaccaugagacuccugagcccgguucgcgugcccaacuacaaucuuaucauuauggacgaagcccacuucacggauccugcuuccaucgccgcccggggauauauuucuacaagagucggcaugggggaggcugcggccaucuuuaugaccgcuacacccccuggaaccgccgaagccuucccccagagcaacgcuccgauccaggacgaggagcgcgacauuccugaacgguccuggaacucuggcaacgaguggaucacggauuuuguggggaagaccgugugguucguccccagcauuaaagccggcaaugacaucgcgaacugucugagaaagaacggaaagaaaguuauucaacucucccgcaagacauuugauaccgaauaccagaaaacacggcugaaugacugggauuucguggugaccacagacaucucugagaugggcgcuaacuuuaaggccgauagagucauugacccccggcgcugccugaaaccugugauccucaccgaugggcccgagagaguuauccuugccggaccuaugccggugacggcugccagcgcggcccagcggcgcggcagagucgggcggaauccccagaaggaaaacgaccaauacauuuucacaggacagccucugaauaacgaugaggaccaugcucacuggaccgaagccaagaugcugcucgacaauaucaacacccccgagggcauuaucccugcucuguucgaacccgagagagagaaauccgccgcuauugauggggaauaucgccuuaagggcgagagccggaaaacauuuguggaacugaugagacgcggagaccucccgguuuggcuggcccacaagguggcgucugagggcaucaaauacaccgaucggaaguggugcuucgacggggaaagaaauaaccagauccuggaggagaauauggaugucgaaauuuggacaaaagagggagaacgcaagaagcuccggccuagauggcuugacgcccgcacguauuccgauccccuggcucugaaagaguuuaaggacuucgccgcuggcagaaaaagcaucgcccucgaucuggugaccgaaauugggcgggucccuucucaucuugccuaccgcacaagaaacgcucuggacaaucucgugaugcugcacaccuccgagcauggaggccgggcguaucgccacgccguugaggaacugcccgagacaauggaaacccuccuucugcugggccucaugauccugcuuacaggcggggcuaugcuguuucucauuagcgggaaggggaucggaaaaaccuccaucggccugauuugugugaucgugucuagcgggaugcuguggauggccgaugucccucuccaguggauugccuccgcuaucguucuugaguucuuuaugauggugcugcugauucccgagccggaaaagcaaagaacaccucaggacaaccagcucgccuacguggucaucggcauucugacccuugcggccaucguggcugccaaugagaugggccugcucgaaacaaccaagcgggaucugggcaugagcaaagagcccgggguugugucucccacguccuaucuggacgucgaccuccacccugcuagcgccuggacacuuuacgcgguggccaccacagucaucaccccgaugcugagacauaccauugaaaacucuacagcuaaugugagccuggccgcuaucgccaaccaagcuguugugcucaugggacuggauaagggcuggcccauuuccaaaauggaccuuggggucccucugcucgcccugggaugcuacucucaggugaacccccugacgcucaccgcggccguucuucugcuggugacacacuaugcuaucauuggcccugggcuccaggccaaggcuacccgcgaggcccagaaacggacagccgcgggaaucaugaagaaucccaccgucgauggcaucaugacgauugaccuggauccugugaucuacgacagcaaguucgagaaacaacuuggccaggugaugcugcucguucugugugcuguccagcugcuccuuaugagaacauccugggcccugugcgaagcucugacccucgccaccgggccgauuacaacccugugggagggaucucccggcaaguuuuggaacacaacgaucgccgugagcauggcuaauauuuuccgcggguccuaucuugccggagcgggccuggccuuuagcaucaugaaaucuguggggaccggacggagaggcacaggcucccagggggaaacccucggagagaaguggaaaaagaagcugaaccaacugagccggaaagaguucgaucucuacaagaaauccggcaucacagaggucgaccgcaccgaggcuaaggaagggcuuaaaagaggagagacgacccaucacgccguuucucggggcagcgcuaagcugcagugguuuguggaacgcaauauggugauuccugaggggagagucaucgaucugggauguggccggggcgggugguccuauuacugcgccggacucaaaaaggugacagaaguucgcggcuauaccaaagggggacccggccaugaggagccugugcccaugucuacauacggguggaacauugucaaacugaugagcggaaaggacguguucuaccuuccgccugaaaaaugugauacccugcucugcgacaucggcgaguccagccccucucccacaguugaagaguccagaaccauucgggugcugaagauggucgagccuuggcugaaaaauaaccaguucuguaucaaggugcucaaucccuauaugccuacggugauugaacaccuugagcgccugcagagaaaguacggcgggaugcugguccggaacccgcucagcagaaauucuacacacgaaauguauuggaucuccaacggaaccggcaauaucguuagcucugugaacauggugagccgccugcuucugaaucgguuuaccaugacacauagacgccccacgauugagaaagaugucgaccucggggcgggaacccggcacgugaacgccgaaccugagacacccaacauggacguuaucggcgagagaauuaagcgcaucaaagaagaacacuccucuaccuggcacuacgaugacgaaaauccuuauaagacaugggcuuaccacgggagcuaugaggugaaagccaccggauccgcuagcuccaugauuaacggcgucgugaagcugcugacaaagcccugggauguugugccgauggucacccaaauggccaugacggacaccacaccuuucggccagcagcggguguuuaaagaaaagguugauaccagaacaccccgcccuaugcccgggacccggaaagugauggagaucacggcugaguggcucuggagaacacugggacgcaauaagaaaccucggcuuugcaccagagaagaguucacaaagaagguccgcaccaacgccgcgaugggcgccguguuuacggaagagaaucaaugggacucugcuagagccgcugucgaagaugaggaguucuggaaacugguggaccgggaacgcgagcuccauaagcuggggaaauguggaagcugcguuuacaacaugaugggcaagagagagaagaaacuuggggaguuuggcaaagccaagggaucccgggccaucugguacauguggcugggcgcgagauaucucgaguucgaagcucugggguuucugaaugaggaucacugguucucucgggaaaacagcuacuccggaguggagggcgaagggcuccauaagcugggauauauucuucgcgacaucucuaaaauucccggcggggccauguacgccgaugacaccgcuggcugggacacaagaaucaccgaggaugaccugcacaaugaggaaaagauuacacagcagauggauccggagcaucggcagcucgccaacgcuaucuuuaaacugaccuaucaaaauaaggucgugaaagugcagcgcccuacacccaagggaaccguuauggacaucauuagcagaaaggaucagcggggcuccggacaggugggaacguacggccuuaacacauucaccaauauggaagcccaacugguccgccagauggagggggaaggagugcucagcaaagcggaccuggagaacccccaucugcucgagaagaaaaucacccaguggcuggaaacaaagggcguugagagacuuaaacggauggccauuucuggggaugacugcguggucaagccuaucgaugaccgcuuugcuaaugcccugcucgcucugaacgauaugggcaaggugagaaaagacauuccgcaguggcaacccuccaagggauggcacgauuggcagcaggucccuuucuguagccaucacuuccaugaacuuaucaugaaagacggccggaagcuggugguucccugccgcccucaggacgagcucaucgggagagcccggauuucucaaggagcgggcuggucccugaaagaaaccgccugucuggggaaggcuuaugcccagauguggagccucauguacuuucaccgcagagaucugcggcuugcuucuaacgccaucugcuccgcugugcccguccacuggauuccuacaagcagaacgaccugguccauccaugcccaccaucaguggaugacaaccgaggacaugcugacaguguggaaucgcguuuggauugaggauaaccccuggauggaagacaagaccccggugacgaccugggaggaugucccuuaccucggaaaacgggaagaccaaugguguggcagccugaucgggcuuacaucuagagcgaccugggcccagaauauucugacagcuauccaacaggugcgcagccucaucggcgaugaggaguuccuggacuauaugcccuccaugaagcgguuuagaaaagaagaggaaucugagggagccauuugguga

SEQ ID NO: 20834 - RNA, 9873 nt, Artificial Sequence
  derived and/or modified CDS sequence (opt5) from DENV-3__EU482457__SS-prME
accagcuucugccugaugaugaugcuccccgccacacuggcuuuucaccuuacguccagagacggcgagccucggaugaucguggggaagaacgaacgcggaaaaucucugcucuucaagaccgccagcggcauuaauauguguacacugaucgcgauggaucuuggggagaugugcgacgauaccgucacauacaaauguccgcugauugcugaaguugagcccgaagacaucgauugcugguguaaccucaccuccacaugggugaccuauggaacgugcaaucaggccggcgagcauagacgggacaagcgcucuguggcccuggcuccucacgucgggaugggacuggauaccagaacacaaaccuggaugagcgccgagggcgcuuggcggcagguggaaaaaguugagacaugggcccuccgccaucccggcuuuaccauucuggcgcuuuuccuggcccacuacaucgggacgucccucacacagaagguggucaucuuuauucugcuuaugcuggugaccccuucuaugacaaugagauguguuggagugggcaaccgggacuucgucgaagggcucagcggagcuaccuggguggaugugguccuggagcauggcgggugcguuaccacaauggccaagaauaaacccacgcuggacaucgagcuccagaagaccgaagcuacacaacuggccacccuucgcaaacuguguauugagggaaagaucacaaacauuaccacggauuccagaugcccuacacagggcgaagcgacccucccggaggaacaggaccagaauuauguguguaaacacaccuacguggaucggggcugggggaacggaugcggccuguuugggaagggaagccuugucacaugcgccaaguuccaaugucuggagcccaucgagggcaaagugguucaguaugaaaaucucaaguacaccgugauuaucacaguccacacgggggaccagcaucaggugggaaacgacacccaaggcguuacaguggagaucaccccucaggcuucuacagucgaagccgugcugcccgaguauggcauucuggggcucgaaugcuccccucgcaccggacuggauuuuaaugagaugauccuucugacgaugaaaaacaaggcuuggaugguccacagacagugguucuuugaccucccccugccguggaccagcggcgccacaaccgagacaccuaccuggaaucggaaagaacuucuggugacguucaagaacgcccaugcuaaaaagcaagagguugugguccucgggucucaggaaggagcgaugcacacagcccugaccggcgcuacagagauucagaauuccgggggcaccagcaucuuugccggacaccugaagugucgccucaaaauggauagacuggaacuuaagggcaugucuuacgccaugugccugaacaccuucgugcucaaaaaggagguuuccgagacacagcaugggacgauucugaucaaaguggaauacaagggagaggacgcucccuguaagaucccuuucagcaccgaagauggccaagggaaagcccacaacggacggcugauuacagcgaaucccgucgugaccaagaaagaggagcccgugaacaucgaagcugagccuccguuuggcgaauccaauauuguuaucgggauuggcgacaaggcccuuaaaaucaacugguauaagaagggaucuagcaucggcaaaauguucgaggccacagcuagaggggcccgccggauggcuauucucggagauaccgccugggacuuuggcuccgucgggggagugcugaauagccugggcaagauggugcaucagaucuucgggucugcguacacggcccucuuuuccggcgucagcuggauuaugaaaaucggaauuggcgugcugcuuacauggaucgggcugaacucuaagaauaccagcauguccuucucuugcauuguuaucggaaucauuacccucuaucugggcgcugugguccaggccgauauggggugugugaucaacuggaaaggaaaggaacugaagugcggcagcgggauuuuuguuacaaaugaggugcacaccuggacagagcaguacaaauuccaagcugacucccccaagagacuugccacggcgaucgccggcgcuugggaaaacggagucuguggcauucgcagcaccacacggauggagaaucuccuguggaaacagaucgccaacgaacugaauuauauccucugggagaacaauauuaagcugaccgugguugugggggauacaaucggaguccuugaacagggcaaaagaacccugacgccucagcccauggagcucaaguacucuuggaaaaccugggggaaggcuaagauugugacagccgagacccaaaacuccagcuuuaucauugacggaccuaacacacccgaaugcccgucugccucccgcgcuuggaaugugugggaggucgaagacuauggcuucggcguuuuuaccacaaacaucuggcugaaacugcgggagguguacacccagagcugugaucauagacuuauguccgcggccaucaaggacgaacgcgcugugcacgccgauaugggguacuggauugagucucagaaaaauggaagcuggaagcucgagaaagccuccuucaucgaagucaagacgugcacauggccuaagucucacacccuguggagcaacggcgugcuggaguccgacaugauuauccccaaaagccucgcugggccuauuucucagcauaaucaccggcccggauaucauacccaaacagccggcccuuggcaccuggggaagcuugaacuggauuuuaacuacugcgagggaaccacgguugugaucacagagaauuguggcaccagaggccccucccuccgcacaaccacagucagcgggaaacugauccacgaauggugcugucggucuugcacccugccgccucuuagauauaugggagaggacggcuguugguacgggauggaaauucggcccaucaacgagaaggaagagaauauggugaaaucccucguuagcgcgggaucuggcaagguggauaacuucacgauggggguccugugccuggcuauucucuucgaggaagugaugcgcggaaaguuuggcaaaaagcauaugaucgccggcguucuguucaccuuugugcuucugcucagcgggcagauuacauggagagacauggcccacacccugaucaugauuggauccaaugcuagcgaucggaugggcaugggggucacauaucuggcccuuaucgcgaccuucaaaauccagcccuuucuggcucucggauucuuucugagaaagcucacgucucgcgagaaccugcuucugggcguggggcucgccauggccacaacccugcaacugccugaagacauugagcagauggcuaauggaaucgcccuuggccugaugacacucaaacugauuacccaguucgaaaccuaccagcucuggacagcucuggugucccuuacguguagcaacaccaucuuuacacugaccgucgccuggcggacagcgacccucauucuggccggcguuucccugcuuccgcugugccaaucuagcuccaugagaaagacggauuggcuccccaugacaguggcugccaugggggugccuccccugccucucuucaucuuuucucugaaggacacccccaaacgcagaagcuggccucuuaaugagggagucauggcugugggccugguuuccauccuggccucuagccuccugcggaacgaugugcccauggccgggccgcuugucgcuggaggccugcucauugcguguuaugugaucaccgggacauccgccgaccugaccguugagaaggcugccgacgugacaugggaagaggaagccgagcagacgggagucagccauaaccucauggugaccgucgaugacgauggcacaaugcgcauuaaagacgaugaaaccgagaauauccugacagugcuucugaagaccgcucugcucauuguuucuggcaucuucccuuacuccauccccgccacgcugcuuguguggcacaccuggcagaaacagacacaaagaagcgggguccugugggacgugccuucucccccggagacccagaaggcggaacucgaggaaggaguuuaccggauuaaacagcagggcaucuuugggaagacacaagugggagucggcgugcagaaggaggggguguuccauaccauguggcacguuacacgcggagcuguccugacgcacaacggcaaaagacucgagccuaauugggccuccgugaagaaagaucugauuagcuauggcgggggauggcggcuuucugcccaguggcaaaagggcgaagaggugcaggucaucgcuguggaacccgggaaaaacccuaagaauuuccagaccaugcccggaauuuuucagacaaccaccggcgagaucggggccauugcgcuggacuucaagcccggaacauccggcagcccuaucaucaaccgcgaaggcaaaguuguggggcuguacggaaauggcgucgugacgaagaacgggggauauguuuccggcauugcucaaaccaaugccgagccggaugggcccacaccugagcucgaagaggaaauguuuaaaaagagaaaccugaccaucauggaccuucaucccggcagcggaaaaacacggaaguaccugccugccauugugcgcgaggcuaucaagagacggcucagaacccugauucucgcccccacgcgcgucguggcugccgaaauggaggaggcgcugaaaggccuuccuauccgguaucagacaaccgccaccaagucugaacacacagggagagagaucguugaucugaugugccaugcuaccuucacaaugcgccugcucagcccggugcggguccccaauuacaaccugauuaucauggacgaagcccacuuuaccgauccugcuuccauugccgccagaggauauaucucuacgcgcgugggcaugggggaggcugcggccauuuucaugacagcuacccccccuggaacagccgaagccuuuccccagagcaaugcuccgauccaggacgaggagcgggacaucccugaaagauccuggaacucuggcaaugaguggauuaccgauuucguggggaaaacggucugguuuguucccagcaucaaggccggcaacgacauugcgaacugucuucgcaaaaauggaaagaaggugauccaacugucccggaaaaccuucgauacagaauaccagaagaccagacucaacgacugggauuuuguggucacaaccgacauuucugagaugggcgcuaauuucaaagccgaucgggugaucgacccccgcagaugccugaagccuguuauucugacagaugggcccgagcgggugauccucgccggaccuaugccggucaccgcugccagcgcggcccagcgcagaggccggguggggagaaacccccagaaagaaaaugaccaauacaucuucacgggacagccucuuaacaaugaugaggaccaugcucacuggacagaagccaagaugcugcuggacaacauuaauacccccgagggcaucauuccugcucucuuugggcccgaacgcgagaaguccgccgcuaucgauggcgaguaucggcugaaaggagaaagcagaaagaccuucguugagcuuaugcgccggggcgaccugccgguguggcucgccuacaaagucgcgucugaagggauuaaguauacagauagaaaauggugcuuugacggagagcgcaacaaucagauccuggaagagaacauggauguggagaucuggaccaaggaaggcgagcggaaaaagcugagaccucgcuggcucgacgccagaacauacuccgauccccuugcucugaaggaauucaaagacuuugccgcugggcggaagagcauugcccuggaucucgucacggagaucggacgcgugccuucucaccuggcccauagaacccggaaugcucuugacaaccugguuaugcuccacacauccgaacauggcggccgcgcguauagacacgccguggaggagcugcccgaaaccauggagacacugcuccuucuggggcugaugauucuccugaccggaggcgcuaugcuuuuccugaucagcgggaaaggaauuggcaagacguccaucgggcucaucugugugauugucucuagcggaaugcuguggauggccgauguuccucugcaguggaucgccuccgcuauugugcucgaauuuuucaugauggugcuucugauccccgagccggagaaacaacggaccccucaggacaaucagcuggccuacgucgugauuggcauccucacacuggcggccauuguugcugccaacgaaaugggccuucuggagaccacaaagagagaucucgggaugagcaaggaacccggaguggucucucccaccuccuaucuggacguggaccugcacccugcuagcgccuggacgcucuacgcggucgccacaaccgugaucacaccgaugcuucgccauaccaucgagaauucuaccgcuaacguuagccuggccgcuauugccaaccaagcugugguccugaugggccucgauaaaggguggcccaucuccaagauggaccugggagugccucuucuggcccucggcugcuacucucagguuaauccccugacacugacggcggccgugcuccuucuggucacccacuaugcuauuaucgggccuggacugcaggccaaagcuacacgggaagcccagaagagaaccgccgcgggcauuaugaaaaaccccacaguggauggcaucaugaccaucgaccucgauccugugauuuacgacagcaaguuugagaagcaacuggggcagguuaugcuucugguccucugugcugugcagcugcugcucaugcgcacguccugggcccuuugcgaggcucugacacuggccaccggaccgaucaccacacucugggaaggcucucccgggaaauucuggaauaccacaauugccgugagcauggcuaacaucuuucggggauccuaucuggccggcgcggggcuugccuucagcauuaugaagucugucggaacgggcagacggggcaccgggucccagggagagacacugggcgaaaaauggaagaaaaagcucaaucaacugagccgcaaggaguuugaucuguacaaaaaguccgggaucaccgaaguugacagaacagaggcuaaagagggacucaagcggggcgaaaccacgcaucacgccgugucucgcgggagcgcuaaacuucagugguucguggagagaaacauggucaucccugaaggacgggugauugaucugggcuguggccgcgggggaugguccuauuacugcgccggccugaagaaaguuaccgaggugagaggguauacaaagggaggccccgggcaugaagagccuguccccaugucuaccuacggauggaauaucgugaagcucaugagcggcaaagacguuuucuaccugccgccugagaagugugauacacuucugugcgacauuggcgaauccagccccucucccaccguggaggaaucccggacaauccgcguccucaaaaugguggagccuuggcugaagaacaaucaguuuuguauuaaagugcugaaccccuauaugccuaccgucaucgagcaccucgaaagacuucagcggaaguacgggggaaugcugguuagaaauccgcugagccgcaacucuacgcacgagauguauuggauuuccaauggcacagggaacaucgugagcucugugaauauggucagccggcuccugcuuaacagauucaccaugacccaucgccggcccacaaucgaaaaggauguggaccugggagcgggcacgagacacguuaacgccgagccugaaacccccaauauggacgugauuggggagcgcaucaaacggauuaaggaggaacauuccucuacauggcacuacgaugacgagaacccuuauaaaaccugggcuuaccacggaagcuaugaagucaaggccacaggcuccgcuagcuccaugaucaauggcgugguuaaacuccugaccaagcccugggauguggucccgauggugacacaaauggccaugaccgacacgaccccuuuugggcagcagagaguuuucaaggagaaaguggauacacgcaccccccggccuaugcccggaacaagaaaggucauggaaauuaccgcugaguggcuguggcgcacgcucggccggaacaaaaagccuagacugugcacacgcgaggaauuuaccaaaaaggugagaacaaaugccgcgaugggggccgucuucaccgaggaaaaccaaugggacaaugcucgggccgcuguggaggaugaagaguuuuggaagcuuguugaccgcgagagagaacugcauaaacucggaaaguguggcucuugcguguacaacaugauggggaaacgggagaagaaacugggcgaauucggaaaggccaaaggcagcagagccaucugguacauguggcuuggggcgcgguaucuggaguuugaggcucucggauuccugaaugaagaucacugguuuucccgcgagaacucuuacagcggcgucgaaggggagggacugcauaagcucggcuauauccugagagacauuuccaagauccccgggggcgccauguacgccgaugacacggcuggaugggacacccggauuacagaagaugaccuucacaaugaggagaaaaucacccagcagauggauccggaacaucgccagcuggccaacgcuauuuucaagcucacauaucaaaauaaaguggugaagguucagagaccuacccccaaaggcacagugauggacaucaucucucggaaggaucagcgcgggagcggacaggucggcaccuacgggcugaacacguuuacaaauauggaggcccaacuugugagacagauggaaggagagggcguucuguccaaggcggaccucgaaaacccccaccugcuggagaaaaagauuacccaguggcucgagaccaaagggguggaacggcugaagcgcauggccaucagcggcgaugacugcgucgugaaaccuauugaugacagauucgcuaacgcccuucuggcucucaaugauaugggaaagguccggaaggacaucccgcaguggcaacccucuaaaggcuggcacgauuggcagcaggugccuuucuguucccaucacuuucaugagcugauuaugaaggacgggcgcaaacuuguugugcccugcagaccucaggacgaacugaucggacgggcccgcaucagccaaggcgcgggguggucucucaaggagacagccugucugggaaaagcuuaugcccagauguggucccugauguacuuccacagacgggaucucagacuggcuagcaacgccauuugcucugcuguccccgugcacuggaucccuaccucccgcacaacguggagcauucaugcccaccaucaguggaugaccacagaagacaugcuuaccguuuggaaucggguguggaucgaggauaaccccuggauggaggacaagacaccggucaccacgugggaagaugugccuuaccugggcaagagagaggaccaauggugugggucccucauuggccugaccagccgcgcgacaugggcccagaauauccuuaccgcuauucagcaggugcggucucugaucggagaugaagaguuucucgacuauaugcccagcaugaaaagauuccgcaaggaggaagaguccgaaggcgccaucugguga

SEQ ID NO: 20835 - RNA, 9873 nt, Artificial Sequence
  derived and/or modified CDS sequence (opt5) from DENV-3__EU482458__SS-prME
acaagccugugccucaugaugaugcugcccgccacacuugcuuuccaccugacgucccgggacggcgaaccucggaugaucguggggaagaacgaacgcggaaagucucuccuguuuaagaccgccagcggcauuaauauguguacacuuaucgcgauggaucugggggaaaugugcgacgauaccgucacauacaaauguccgcucauugcugaaguugagcccgaagacaucgauugcugguguaaccugaccuccacaugggugaccuauggaacgugcaaucaggccggcgagcaucggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaaacccacgcucgacaucgagcugcagaagaccgaagcuacacaacuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggucacaugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccucgcaccggacuugauuucaaugagaugauccugcucacgaugaaaaacaaggcuuggaugguccacagacagugguuuuucgaccugccccuuccguggaccagcggcgccacaaccgagacaccuaccuggaaucggaaagaacugcucacgacauuuaagaacgcccaugcuaaaaagcaagaggugguugugcuggggucucaggaaggagcgaugcacaccgcccugacaggcgcuaccgagauucaaaauuccgggggcaccagcaucuucgccggacaccucaagugucgccugaaaauggauaaacuugaacugaaaggcaugucuuacgccaugugccucaacacauuuguccugaagaaagagguguccgagacgcagcaugggaccauucugaucaagguugaauacaagggagaggacgcucccuguaaaaucccuuucagcacagaagauggccaagggaaggcccacaacggaagacuuauuaccgcgaaucccguggucaccaagaaggaggagcccgugaacaucgaagcugagccuccguucggcgaauccaauauugugaucgggauuggcgacaaagcccucaagaucaacugguauaagaaaggaucuagcaucggcaagauguuugaggccaccgcuagaggggccagacgcauggcuauucugggagauacggccugggacuucggcuccguugggggaguccugaauagccucggcaaaauggugcaucagaucuuugggucugcguacacagcccuguucuccggcgugagcuggauuaugaagaucggaauuggcguccuucugaccuggaucgggcucaacucuaaaaauaccagcauguccuuuucuugcauugugaucggaaucauuacacuguaucugggcgcuguugugcaggccgauauggggugugcuaucaacuggaagggaaaggaacuuaaaugcggcagcgggauuuucgucaccaaugaggugcacacauggacggagcaguacaaguuucaagccgacucccccaaacggcucgcgaccgccaucgcuggcgccugggaaaacggaguuuguggcauuagaagcacaacccgcauggagaaucugcuguggaagcagaucgcuaacgaacucaauuauauccugugggagaacaauauuaaacuuacaguggucgugggggauaucauuggaguucuggaacagggcaagcggacccucacgccucagcccauggagcugaaauacucuuggaagaccugggggaaggccaaaaucgugacagccgagacccaaaacuccagcuucauuaucgacggaccuaacacacccgaaugcccgucugcuuccagagcguggaaugucugggagguggaagacuauggcuuuggcguguucaccacaaacaucuggcugaaacuucgcgaggucuacacccagagcugugaucaucggcucauguccgccgcuauuaaagacgaaagagccguucacgccgauaugggguacuggaucgagucucagaagaauggaagcuggaaacuggagaaggcuuccuuuauugaagugaagacgugcacauggccuaaaucucacacccuguggagcaacggcgugcucgaguccgacaugaucauucccaagagccuggccgggccuaucucucagcauaaucaccgccccggauaucauacccaaacagcgggcccuuggcaccuugggaaacuggaacucgauuucaacuacugcgagggaaccacggucgugaucacagagaauuguggcaugcggggccccucccugagaaccacaaccguuagcgggaagcugauucacgaauggugcugucgcucuugcacacuuccgccucuccgguauaugggagaggacggcuguugguacgggauggaaaucagacccauuaacgagaaagaagagaauauggugaagucccuggucagcgcuggaucuggcaagguggauaacuuuaccauggggguucugugccucgccauccuguucgaggaagugaugcggggaaaauucggcaagaaacauaugauugccggcguccuuuuuacguucgugcugcuccugagcgggcagaucaccuggcgcgacauggcucacacacugauuaugaucggauccaaugccagcgauagaaugggcauggggguuaccuaucuugcgcugaucgcuacauuuaagauucagcccuuccucgcccugggauuuuuccuccggaaacugaccucuagagagaaccuucugcucggcguggggcuggccauggcuacgacacugcaacuuccugaagacaucgagcagauggccaauggaauugcucugggccucaugacccugaagcucaucacacaguuugaaaccuaccagcuguggaccgcccuugucucccugacauguagcaacacgauuuucacccucacaguggcguggcgcaccgccacacugauccuggcuggcgugucccuucugccgcucugccaaucuagcuccaugcggaagaccgauuggcugcccaugacggucgccgcuauggggguuccuccccucccucuguuuaucuucucucuuaaagacacacccaagagacgcagcuggccucugaaugagggagugauggccgugggccuggucuccauucucgccucuagccugcuuagaaacgaugugcccauggcugggccgcugguugcgggaggccuccugaucgccuguuaugugauuaccgggaccuccgcugaccucacagucgagaaagccgccgacgugaccugggaagaggaagcugagcagacaggaguuagccauaaccugaugaucacgguggaugacgauggcaccaugcggauuaaggacgaugaaacagagaauauccuuaccguccugcugaaaacagcccuccugaucgugucuggcauuuuuccuuacuccauccccgcgacccuucuggucuggcacacguggcagaagcagacccaacgcagcggggugcucugggacguuccuucucccccggagacacagaaagcugaacuggaggaaggaguguacagaauuaagcagcagggcaucuucgggaagacccaagucggagugggcguucagaaagaggggguguuucauacaauguggcacgucacccggggagccgugcucacacacaacggcaagcgccuggagccuaauugggccuccgugaaaaaggaucuuauuagcuauggcgggggauggagacugucugcucaguggcaaaaaggcgaagagguucaggucaucgccguggaacccgggaagaacccuaagaauuuccagacgaugcccggaauuuuccagaccacaaccggcgagaucggggcgaucgcucuggacuuuaaacccggaaccuccggcagcccuauuaucaaccgggaaggcaagguggucgggcucuacggaaauggcgugguuaccaagaacgggggauauguguccggcauugcccaaacgaaugccgagccggaugggcccaccccugagcuggaagaggaaauguucaagaaacgcaaccuuacaaucauggaccugcaucccggcagcggaaagaccagaaaguaccucccugcuauuguccgggaggccaucaaacgcagacugcggacacucauccuggcucccaccagagugguugccgcggaaauggaggaggcccuuaagggccugccuauucgcuaucagacgacagcuaccaaaucugaacacaccgggcgggagaucguggaucugaugugccaugccacauuuaccaugagacuccugagcccgguccgcgugcccaauuacaaccuuauuaucauggacgaagcucacuucacagauccugccuccauugccgcucggggauauaucucuaccagaguuggcaugggggaggcggccgcuaucuuuaugacggccacacccccuggaaccgccgaggcuuucccccagagcaaugccccgauucaggacgaggagcgcgacaucccugaacgguccuggaacucuggcaaugaguggauuacagauuuuguggggaagaccgucugguucgugcccagcaucaaagcgggcaacgacauugcuaacugucugagaaagaauggaaagaaagugauccaacucucccgcaagacguuugauaccgaauaccagaaaacacggcugaacgacugggauuucgucguuaccacagacauuucugagaugggcgccaauuuuaaggccgauagagugaucgacccccggcgcugccugaaaccugugauccucaccgaugggcccgagagagucauucuugcuggaccuaugccggugacagccgcgagcgccgcucagcggcgcggcagaguugggcggaacccccagaaggaaaaugaccaauacaucuucaccggacagccucugaacaaugaugaggaccaugcccacuggacggaagcuaagaugcugcucgacaacauuaauacacccgagggcaucauuccugcccuguucgaacccgagagagagaaauccgcugccaucgauggggaauaucgccuuaagggcgagagccggaaaaccuuuguggaacugaugagacgcggagaccucccggucuggcuggcgcacaagguggccucugagggcaucaaauacaccgaucggaaguggugcuucgacggggaaagaaacaaucagauucuggaggagaacauggauguugaaaucuggacaaaagagggagaacgcaagaagcuccggccuagauggcuugacgcucgcaccuauuccgauccccuggcccugaaagaguuuaaggacuucgcugccggcagaaaaagcauugcccucgaucuggugacagaaaucgggcgggucccuucucaucuugcuuaccgcacgagaaaugcgcuggacaaccucgugaugcugcacaccuccgagcauggaggccgggccuaucgccacgcugucgaggaacugcccgagacaauggaaacccuccuucugcugggccucaugauucugcuuacagggggagccaugcuguuucucaucagcggcaaggggaucggaaaaaccuccauuggccugaucugugugauuguuucuagcgggaugcuguggauggccgaugugccucuccaguggaucgcuuccgccauugugcuugaguucuuuaugaugguccugcugauccccgagccggaaaagcaaagaacgccucaggacaaucagcucgcguacguugugauuggaauccugacccuugccgcuaucguggccgcuaacgagaugggccugcucgaaacaaccaagcgggaucugggcaugagcaaagagcccggggucgugucucccacauccuaucuggacguugaccuccacccugccagcgcguggacccuuuacgccguggcuacgacagucauuaccccgaugcugagacauacaaucgaaaauucuaccgccaacgugagccuggcugccauugcuaaccaagccgucgugcucaugggacuggauaagggcuggcccaucuccaaaauggaccuugggguuccucugcucgcgcugggaugcuacucucaggugaauccccugacccucacagccgcuguccuucugcuggugacgcacuaugccauuaucggcccugggcuccaggcuaaggccacccgcgaggcccagaaacggacagcggcuggaaucaugaagaaccccaccguugauggcauuaugacaaucgaccuggauccugugauuuacgacagcaaguucgagaaacaacuuggccaggucaugcugcucgugcugugugccgugcagcugcuccuuaugagaaccuccugggcucugugcgaagcccugacgcucgccacagggccgaucaccacccugugggagggaucucccggcaaguuuuggaauacaaccauugcuguuagcauggccaacaucuuccgcggguccuaucuugcgggagccggccuggcuuuuagcaucaugaaaucugucgggacaggacggagaggcacgggcucccagggggaaacccucggagagaaguggaaaaagaagcugaaucaacugagccggaaagaguucgaucucuacaagaaauccggcauuacagagguggaccgcaccgaggccaaggaagggcuuaaaagaggagagacaacccaucacgcugugucucggggcagcgccaagcugcagugguuugucgaacgcaacaugguuaucccugaggggagagugauugaucugggauguggccggggcgggugguccuauuacugcgcgggacucaaaaaggugacggaaguccgcggcuauaccaaaggcgggcccgggcaugaggagccugugcccaugucuacauacggguggaauaucguuaaacugaugagcggaaaggacguguucuaccuuccgccugaaaaaugugauacccugcucugcgacauuggcgaguccagccccucucccacagucgaagaguccagaaccauccgggugcugaagaugguugagccuuggcugaaaaacaaucaguucuguauuaaggugcucaaccccuauaugccuacagucaucgaacaccuugagcgccugcagagaaaguacggcgggaugcuggugcggaauccgcucagcagaaacucuacccacgaaauguauuggaucuccaauggaacgggcaacauugugagcucugucaauaugguuagccgccugcuucugaaccgguuuacaaugacccauagacgccccaccaucgagaaagauguggaccucggggccggaacacggcacgugaacgcugaaccugagacgcccaauauggacgucauuggcgagagaaucaagcgcauuaaagaagaacacuccucuaccuggcacuacgaugacgaaaacccuuauaagacaugggccuaccacgggagcuaugaggugaaagcuaccggauccgccagcuccaugaucaauggcguugugaagcugcugacaaagcccugggaugucgugccgaugguuacccaaauggcuaugacagacaccacgccuuucggccagcagcggguguuuaaagaaaaggucgauaccagaacaccccgcccuaugcccgggacccggaaagugauggagaucacagccgaguggcucuggagaacccugggacgcaacaagaaaccucggcuuugcacgagagaagaguucacaaagaagguucgcaccaaugcggccaugggcgcuguguuuacagaagagaaccaaugggacucugccagagcugccgucgaagaugaggaguucuggaaacugguggaccgggaacgcgagcuccauaagcuggggaaauguggaagcugcgucuacaauaugaugggcaagagagagaagaaacuuggggaguuuggcaaagccaagggaucccgggcgauuugguacauguggcugggcgcuagauaucucgaguucgaagcccugggguuucugaacgaggaucacugguucucucgggaaaauagcuacuccggaguggagggcgaagggcuccauaagcugggauauauccuucgcgacauuucuaaaauccccggcggggccauguacgcugaugacaccgccggcugggacacgagaauuaccgaggaugaccugcacaacgaggaaaagaucacacagcagauggauccggagcaucggcagcucgcuaaugccaucuuuaaacugaccuaucaaaacaagguugugaaaguccagcgcccuacacccaagggaaccgugauggacauuaucagcagaaaggaucagcggggcuccggacaggugggaacauacggccuuaauaccuucacgaacauggaagcgcaacugguucgccagauggagggggaaggagugcucagcaaagccgaccuggagaauccccaucugcucgagaagaaaauuacacaguggcuggaaaccaagggcgucgagagacuuaaacggauggcuaucucuggggaugacugcgugguuaagccuauugaugaccgcuuugccaacgcucugcucgcccugaacgauaugggcaaggugagaaaagacaucccgcaguggcaacccuccaagggauggcacgauuggcagcaggucccuuucuguagccaucacuuccaugaacuuaucaugaaagacggccggaagcuggugguccccugccgcccucaggacgagcucauugggagagcgcggaucucucaaggagccggcuggucccugaaagaaaccgcuugucuggggaaggccuaugcucagauguggagccucauguacuuucaccgcagagaucugcggcuugccucuaaugcuauuugcuccgccgugcccguucacuggaucccuacaagcagaaccacaugguccauucaugcgcaccaucaguggaugacgaccgaggacaugcugacaguguggaaccgcgucuggaucgaggauaaucccuggauggaagacaagaccccgauuacaaccugggaggaugugccuuaccucggaaaacgggaagaccaaugguguggcagccugaucgggcuuacgucuagagccaccugggcucagaacauccugacagccauucagcagguucgcagccucaucggcgaugaggaguuccuggacuauaugcccuccaugaagcgguuuagaaaagaagaggaaucugagggagccauuugguga

SEQ ID NO: 20836 - RNA, 9873 nt, Artificial Sequence
  derived and/or modified CDS sequence (opt5) from DENV-3__EU482459__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacaaaccuggaugagcgccgagggcgcuuggcggcagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaaacccacgcucgacaucgagcugcagaagaccgaagcuacacaacuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggucaccugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccucgcaccggacuugauuucaaugagaugauccugcucacgaugaaaaacaaggcuuggaugguccacagacagugguuuuucgaccugccccuuccguggaccagcggcgccacaaccgagacaccuaccuggaaucggaaagaacugcucgugacguuuaagaacgcccaugcuaaaaagcaagagguugugguccuggggucucaggaaggagcgaugcacacagcccugaccggcgcuacagagauucagaauuccgggggcaccagcaucuucgccggacaccucaagugucgccugaaaauggauaagcuugaacugaaaggcaugucuuacgccaugugccucaacaccuuugugcugaagaaagagguuuccgagacacagcaugggacgauucugaucaagguggaauacaagggagaggacgcucccuguaaaaucccuuucagcaccgaagauggccaagggaaggcccacaacggaagacuuauuacagcgaaucccgucgugaccaaaaaggaggagcccgugaacaucgaagcugagccuccguucggcgaauccaauauuguuaucgggauuggcgacaaagcccucaagaucaacugguauaagaaaggaucuagcaucggcaagauguuugaggccacagcucggggggccagacgcauggcuauucugggagauaccgccugggacuucggcuccgucgggggagugcugaauagccucggcaaaauggugcaucagaucuuugggucugcguacacggcccuguucuccggcgucagcuggauuaugaagaucggaauuggcgugcuucugacauggaucgggcucaacucuaaaaauaccagcauguccuuuucuugcauuguuaucggaaucauuacccuguaucugggcgcugugguccaggccgauauggggugugcuaucaacuggaagggaaaggaacuuaaaugcggcagcgggauuuucgugacaaaugagguucacaccuggacagagcaguacaaguuucaagccgacucccccaaacggcucgcgacggccaucgcuggcgccugggaaaacggaguguguggcauuagaagcaccacacgcauggagaaucugcuguggaagcagaucgcuaacgaacucaauuauauccugugggagaacaauauuaaacuuaccgucgugguuggggauaucauuggagugcuggaacagggcaagcggacacucaccccucagcccauggagcugaaauacucuuggaagacgugggggaaggccaaaaucgucaccgccgagacacaaaacuccagcuucauuaucgacggaccuaacacccccgaaugcccgucugcuuccagagcguggaaugugugggagguggaagacuauggcuuuggcgucuucacaaccaacaucuggcugaagcuucgcgagguuuacacacagagcugugaucaucggcucauguccgccgcuauuaaagacgaaagagccgugcacgccgauaugggguacuggaucgagucucagaagaauggaagcuggaaacuggagaaggcuuccuuuauugaagugaagaccugcacguggccuaaaucucacacacuguggagcaacggcguccucgaguccgacaugaucauucccaagagccuggccgggccuaucucucagcauaaucaccgccccggauaucauacccaaaccgcgggcccuuggcaccuugggaaacuggaacucgauuucaacuacugcgagggaacaaccgugguuaucacggagaauuguggcacacggggccccucccugagaaccacaaccgugagcgggaagcugauucacgaauggugcugucgcucuugcacacuuccgccucuccgguauaugggagaggacggcuguugguacgggauggaaaucagacccauuaacgagaaagaagagaauauggucaagucccuggugagcgcuggaucuggcaagguugauaacuuuaccaugggggugcugugccucgccauccuguucgaggaagucaugcggggaaaauucggcaagaaacauaugauugccggcgugcuuuuuacguucguucugcuccugagcgggcagaucaccuggcgcgacauggcucacacacugauuaugaucggauccaaugccagcgauagaaugggcaugggggugaccuaucuugcgcugaucgcuacauuuaagauucagcccuuccucgcccugggauuuuuccuccggaaacugaccucuagagagaaccuucugcucggcgucgggcuggccauggcuacgacacugcaacuuccugaagacaucgagcagauggccaauggaauugcucugggccucaugacccugaagcucaucacacaguuugaaaccuaccagcuguggaccgcccuugugucccugacauguagcaacacgauuuucacccucacaguggcguggcgcaccgccacacugauccuggcuggcgucucccuucugccgcucugccaaucuagcuccaugcggaagaccgauuggcugcccaugacgguugccgcuaugggggugccuccccucccucuguuuaucuucucucuuaaagacacacccaagagacgcagcuggccucugaaugagggagugauggccgucggccugguguccauucucgccucuagccugcuuagaaacgauguucccauggcugggccgcugguggcgggaggccuccugaucgccuguuaugucauuaccgggaccuccgcugaccucacaguggagaaagccgccgacguuaccugggaagaggaagcugagcagacaggagugagccauaaccugaugaucacggucgaugacgauggcaccaugcggauuaaggacgaugaaacagagaauauccuuaccgugcugcugaaaacagcccuccugaucgucucuggcauuuuuccuuacuccauccccgcgacccuucugguguggcacacguggcagaagcagacccaacgcagcgggguucucugggacgugccuucucccccggagacacagaaagcugaacuggaggaaggagucuacagaauuaagcagcagggcaucuucgggaagacccaagugggaguuggcgugcagaaagagggggucuuucauacaauguggcacgugacccggggagccgugcucacacacaacggcaagcgccuggagccuaauugggccuccguuaaaaaggaucuuauuagcuauggcgggggauggagacugucugcucaguggcaaaaaggcgaagagguccaggugaucgccguggaacccgggaagaacccuaagaauuuccagacgaugcccggaauuuuccagaccacaaccggcgagaucggggcgaucgcucuggacuuuaaacccggaaccuccggcagcccuauuaucaaccgggaaggcaaggucguggggcucuacggaaauggcguugugacaaaaaacgggggauaugucuccggcauugcccaaacgaaugccgagccggaugggcccaccccugagcuggaagaggaaauguucaagaaacgcaaccuuacaaucauggaccugcaucccggcagcggaaagaccagaaaguaccucccugcuauugugcgggaggccaucaaacgcagacugcggacacucauccuggcucccaccagaguuguggccgcggaaauggaggaggcccuuaagggccugccuauucgcuaucagacgacagcuaccaaaucugaacacaccgggcgggagaucgucgaucugaugugccaugccacauuuaccaugagacuccugagcccggugcgcguucccaauuacaaccuuauuaucauggacgaagcucacuucacagauccugccuccauugccgcucggggauauaucucuaccagagugggcaugggggaggcggccgcuaucuuuaugacggccacacccccuggaaccgccgaagcuuucccccagagcaaugccccgauucaggacgaggagcgcgacaucccugaacgguccuggaacucuggcaaugaguggauuacagauuuugucgggaagaccgugugguucgugcccagcaucaaagcgggcaacgacauugcuaacugucugagaaagaauggaaagaaagucauccaacucucccgcaagacguuugauaccgaauaccagaaaacacggcugaacgacugggauuucguugugaccacagacauuucugagaugggcgccaauuuuaaggccgauagagugaucgacccccggcgcugccugaaaccugucauccucaccgaugggcccgagagagugauucuugcuggaccuaugccgguuacagccgcgagcgccgcucagcggcgcggcagaguggggcggaacccccagaaggaaaaugaccaauacaucuucaccggacagccucugaacaaugaugaggaccaugcccacuggacggaagcuaagaugcugcucgacaacauuaauacacccgagggcaucauuccugcccuguucgaacccgagagagagaaauccgcugccaucgauggggaauaucgccuuaagggcgagagccggaaaaccuuugucgaacugaugagacgcggagaccucccgguguggcuggcgcacaagguugccucugagggcaucaaauacaccgaucggaaguggugcuucgacggggaaagaaacaaucagauucuggaggagaacauggauguggaaaucuggacaaaagagggagaacgcaagaagcuccggccuagauggcuugacgcucgcaccuauuccgauccccuggcccugaaagaguuuaaggacuucgcugccggcagaaaaagcauugcccucgaucuggucacagaaaucgggcgggugccuucucaucuugcuuaccgcacgagaaaugcgcuggacaaccucgucaugcugcacaccuccgagcauggaggccgggccuaucgccacgcuguggaggaacugcccgagacaauggaaacccuccuucugcugggccucaugauucugcuuacagggggagccaugcuguuucucaucagcggcaaggggaucggaaaaaccuccauuggccugaucuguguuauugugucuagcgggaugcuguggauggccgaugugccucuccaguggaucgcuuccgccauuguccuugaguucuuuaugaugguucugcugauccccgagccggaaaagcaaagaacgccucaggacaaucagcucgcguacguggugauuggaauccugacccuugccgcuaucgucgccgcuaacgagaugggccugcucgaaacaaccaagcgggaucugggcaugagcaaagagcccggggugguuucucccacauccuaucuggacguggaccuccacccugccagcgcguggacccuuuacgccgucgcuacgacagugauuaccccgaugcugagacauacaaucgaaaauucuaccgccaacgucagccuggcugccauugcuaaccaagccgugguucucaugggacuggauaagggcuggcccaucuccaaaauggaccuuggggugccucugcucgcgcugggaugcuacucucaggucaauccccugacccucacagccgcugugcuucugcugguuacgcacuaugccauuaucggcccugggcuccaggcuaaggccacccgcgaggcccagaaacggacagcggcuggaaucaugaagaaccccaccguggauggcauuaugacaaucgaccuggauccugucauuuacgacagcaaguucgagaaacaacuuggccaggugaugcugcucgugcugugugccguucagcugcuccuuaugagaaccuccugggcucugugcgaagcccugacgcucgccacagggccgaucaccacccugugggagggaucucccggcaaguuuuggaauacaaccauugcugucagcauggccaacaucuuccgcggguccuaucuugcgggagccggccuggcuuuuagcaucaugaaaucuguggggacaggacggagaggcacgggcucccagggggaaacccucggagagaaguggaaaaagaagcugaaucaacugagccggaaagaauucgaucucuacaagaaauccggcauuacagagguggaccgcaccgaggccaaggaagggcuuaaaagaggagagacaacccaucacgcugucucucggggcagcgccaagcugcagugguuuguugaacgcaacauggugaucccugaggggagagugauugaucugggauguggccggggcgggugguccuauuacugcgcgggacucaaaaaggucacggaagugcgcggcuauaccaaggggggacccggccaugaggagccuguucccaugucuacauacggguggaaucuggugaaacuuaugagcggaaaggacgucuucuaccugccgccugaaaaaugugauacccuccugugcgacaucggcgaguccagccccucucccacaguggaagaguccagaaccauucggguucugaagaugguggagccuuggcucaaaaacaaucaguucuguaucaagguccuuaaccccuauaugccuacagugauugaacaccuggagcgccugcagagaaaguacggcgggaugcucgugcggaauccgcugagcagaaacucuacccacgaaauguauuggaucuccaauggaacgggcaacaucgucagcucuguuaauauggugagccgccuucugcucaaccgguuuacaaugacccauagacgccccaccauugagaaagauguggaccugggggccggaacacggcacgucaacgcugaaccugagacgcccaauauggacgugaucggcgagagaauuaagcgcaucaaagaagagcauuccucuaccuggcacuacgaugacgaaaacccuuauaagacaugggccuaccacgggagcuaugagguuaaagcuaccggauccgccagcuccaugauuaauggcguggucaagcugcucacaaagcccugggaugugguuccgauggugacccaaauggcuaugacagacaccacgccuuucggccagcagcgggucuuuaaagaaaagguggauaccagaacaccccgcccuaugcccgggacccggaaaguuauggagaucacagccgaguggcuguggagaacccuuggacgcaacaagaaaccucggcugugcacgagagaagaguucacaaagaaggugcgcaccaaugcggccaugggcgcugucuuuacagaagagaaccaaugggacucugccagagcugccguggaagaugaggaguucuggaaacucgucgaccgggaacgcgagcugcauaagcuugggaaauguggaagcugcguguacaauaugaugggcaagagagaaaaaaagcugggggaguuuggcaaagccaagggaucccgggcgaucugguacauguggcucggcgcuagauaucuggaguucgaagcccugggguuucucaacgaggaucacugguucucucgggaaaauagcuacuccggaguugagggcgaagggcugcauaagcuuggauauauucugcgcgacaucucuaaaauucccggcggggccauguacgcugaugacaccgccggcugggacacgagaaucaccgaggaugaccuccacaacgaggaaaagauuacacagcagauggauccggagcaucggcagcuggcuaaugccaucuuuaaacuuaccuaucaaaacaagguggucaaagugcagcgcccuacacccaagggaaccgugauggacaucauuagcagaaaggaucagcggggcuccgggcagguuggaacauacggccugaauaccuucacgaacauggaagcgcaacucgugcgccagauggagggggaaggaguccugagcaaagccgaccuggagaauccccaccuccuggagaagaaaaucacacaguggcuugaaaccaagggcguggagagacugaaacggauggcuauuucuggggaugacugcguugugaagccuaucgaugaccgcuuugccaacgcucuccuggcccuuaacgauaugggcaaggucagaaaagacauuccgcaguggcaacccuccaagggauggcacgauuggcagcaggugccuuucuguagccaucacuuccaugaacugaucaugaaagacggccggaagcucgucgugcccugccgcccucaggacgagcugaucgggagagcgcggauuucucaaggagccggcuggucccugaaagaaaccgcuugucucgggaaggccuaugcucagauguggagccugauguacuuucaccgcagagaucuucggcuggccucuaaugcuaucugcuccgccguucccgugcacuggauuccuacaagcagaaccacaugguccauccaugcgcaccaucaguggaugacgaccgaggacaugcucacagucuggaaccgcguguggauugaggauaaucccuggauggaagacaagaccccgguuacaaccugggaggaugugccuuaccugggaaaacgggaagaccaaugguguggcagccuuaucgggcugacgucuagagccaccugggcucagaacauucucacagccauccagcagguccgcagccugaucggcgaugaggaguuccuggacuauaugcccuccaugaagcgguuuagaaaagaagaggaaucugagggagccauuugguga

SEQ ID NO: 20837 - RNA, 9873 nt, Artificial Sequence
  derived and/or modified CDS sequence (opt5) from DENV-3__EU482460__SS-prME
accagccugugccucaugaugaugcugcccgccacauucgcuuuucaccuuacguccagagacggcgagccucggaugaucguggggaagaacgaacgcggaaaaucucugcucuucaagaccgccagcggcauuaauauguguacacugaucgcgauggaucuuggggagaugugcgacgauaccgucacauacaaauguccgcugauugcugaaguugagcccgaagacaucgauugcugguguaaccucaccuccacaugggugaccuauggaacgugcaaucaggccggcgagcauagacgggacaagcgcucuguggcccuggcuccucacgucgggaugggacuggauaccagaacacaaaccuggaugagcgccgagggcgcuuggcggcagguggaaaaaguugagacaugggcccuccgccaucccggcuuuaccauucuggcgcuuuuccuggcccacuacaucgggacgucccucacacagaagguggucaucuuuauucugcuuaugcuggugaccccuucuaugacaaugagauguguuggagugggcaaccgggacuucgucgaagggcucagcggagcuaccuggguggaugugguccuggagcauggcgggugcguuaccacaauggccaagaauaaacccacgcuggacaucgagcuccagaagaccgaagcuacacaacuggccacccuucgcaaacuguguauugagggaaagaucacaaacauuaccacggauuccagaugcccuacacagggcgaagcgauccucccggaggaacaggaccagaauuauguguguaaacacaccuacguggaucggggcugggggaacggaugcggccuguuugggaagggaagccuugucaccugcgccaaguuccaaugucuggagcccauugagggcaaagugguucaguaugaaaaucucaaguacacagugaucaucaccguccacacaggggaccagcaucaggugggaaacgacacgcaaggcguuaccguggagauuacaccucaggcuucuaccgucgaagccgugcugcccgaguauggcacacuggggcucgaaugcuccccucgcaccggacuggauuuuaaugagaugauccuucugacgaugaaaaacaaggcuuggaugguccacagacagugguucuuugaccucccccugccguggaccagcggcacaaccacagagaccccuacguggaaucggaaagaacuucuggugacauucaagaacgcccaugccaaaaagcaagagguugugguccucgggucucaggaaggagcuaugcacaccgcgcugacaggcgccaccgagauucagaauuccgggggcaccagcaucuuugcuggacaccugaagugucgccucaaaauggauaagcuggaacuuaaaggcaugucuuacgccaugugccugaacacauucgugcucaagaaagagguuuccgagacgcagcaugggaccauucugaucaagguggaauacaagggagaggacgcccccuguaaaaucccuuucagcacagaagauggccaagggaaggcucacaacggaagacugauuaccgccaaucccgucgugacaaaaaaggaggagcccgugaacaucgaagcggagccuccguuuggcgaauccaauauuguuaucgggauuggcgacaaagcucuuaagaucaacugguauaagaaaggaucuagcaucggcaagauguucgaggccaccgcccggggggcuagacgcauggccauucucggagauacggcuugggacuuuggcuccgucgggggagugcugaauagccugggcaaaauggugcaucagaucuucgggucugccuacacagcgcucuuuuccggcgucagcuggauuaugaagaucggaauuggcgugcugcuuaccuggaucgggcugaacucuaaaaauaccagcauguccuucucuugcauuguuaucggaaucauuacacucuaucugggcgccgugguccaggcugauauggggugugccaucaacuggaagggaaaggaacugaaaugcggcagcgggauuuuugugaccaaugagguucacacauggacggagcaguaccgguuccaagcugacucccccaagagacuugccaccgcgaucgccggcgcuugggaaaacggaguguguggcauucgcagcacaacccggauggagaaucuccuguggaaacagaucgccaacgaacugaauuauauccucugggagaacaauauuaagcugacagucgugguuggggauaucauuggagugcuugaacagggcaaaagagcucuggccccucagcccauggagcucaaguacucuuggaaaaccugggggaaggccaagaucgucacggcugagacccaaaacuccagcuuuauuaucgacggaccuaacacacccgaaugcccgucugcgucccgcgccuggaaugugugggagguggaagacuauggcuucggcgucuuuaccacaaacaucuggcugaaacugcgggagguuuacacccagagcugugaucauagacuuauguccgcugccauuaaggacgaacgcgccgugcacgcugauaugggguacuggaucgagucucagaaaaauggaagcuggaagcucgagaaagccuccuucauugaagugaagacaugcaccuggccuaagucucacacgcuguggagcaacggcguccuggaguccgacaugaucauucccaaaagccucgcggggccuaucucucagcauaaucaccggcccggauaucauacacaaaccgcuggcccuuggcaccuggggaagcuugaacuggauuuuaacuacugcgagggaaccacagugguuaucaccgagaauuguggcacgagaggccccucccuccgcacaaccacagugagcgggaaacugauucacgaauggugcugucggucuugcacccugccgccucuuagauauaugggagaggacggcuguugguacgggauggaaauccggcccauuaacgagaaggaagagaauauggucaaaucccucgugagcgccggaucuggcaagguugauaacuucacaaugggggugcugugccuggccauccucuucgaggaagucaugcgcggaaaguuuggcaaaaagcauaugauugcuggcgugcuguucaccuuuguucuucugcucagcgggcagaucacguggagagacauggcccacacccugauuaugaucggauccaaugcgagcgaucggaugggcaugggggugacauaucuggcucuuaucgccaccuucaaaauucagcccuuucuggcccucggauucuuucugagaaagcucacaucucgcgagaaccugcuucugggcgucgggcucgcuauggccaccacgcugcaacugccugaagacaucgagcagauggcuaauggaauugcccuuggccugaugacacucaaacugaucacccaguucgaaacauaccagcucuggaccgcgcuggugucccuuaccuguagcaacacaauuuuuacgcugaccguggccuggcggacagcuacccucauccuggccggcgucucccugcuuccgcugugccaaucuagcuccaugagaaagacagauuggcuccccaugaccguugcugccaugggggugccuccccugccucucuucaucuuuucucugaaggacacgcccaaacgcagaagcuggccucuuaaugagggagugauggccgucggccugguguccauucuggcuucuagccuccugcggaacgauguucccauggcggggccgcuuguggccggaggccugcucaucgcuuguuaugucauuacagggaccuccgccgaccugaccguggagaaggccgcugacguuacaugggaagaggaagccgagcagaccggagugagccauaaccucaugaucacagucgaugacgauggcacgaugcgcauuaaagacgaugaaaccgagaauauccugacagugcuucugaagaccgcgcugcucaucgucucuggcauuuucccuuacuccauccccgcuacacugcuuguguggcacaccuggcagaaacagacgcaaagaagcgggguucugugggacgugccuucucccccggagacccagaaggccgaacucgaggaaggagucuaccggauuaaacagcagggcaucuuugggaagacacaagugggaguuggcgugcagaaggagggggucuuccauaccauguggcacgugacacgcggagccgugcugacccacaacggcaaaagacucgagccuaauugggcuuccguuaagaaagaucugauuagcuauggcgggggauggcggcuuucugcccaguggcaaaagggcgaagagguccaggugaucgcgguggaacccgggaaaaacccuaagaauuuccagacaaugcccggaauuuuucagacgaccaugggcgagaucggggcuaucgcccuggacuucaagcccggaacauccggcagcccuauuaucaaccgcgaaggcaaagucguggggcuguacggaaauggcguugugaccaagaacgggggauaugucuccggcauugcccaaaccaaugcugagccggaugggcccacaccugagcucgaagaggaaauguuuaaaaagagaaaccugacgaucauggaccuucaucccggcagcggaaaaacccggaaguaccugccugccauugugcgcgaggcuaucaagagacggcucagaacacugauccucgcccccacccgcguuguggcggccgaaauggaggaggcucugaaaggccuuccuauucgguaucagacaaccgccacgaagucugaacacacagggagagagaucgucgaucugaugugccaugcuaccuucaccaugcgccugcucagcccggugcggguucccaauuacaaccugauuaucauggacgaagcccacuuuacagauccugccuccauugcugcgagaggauauaucucuacccgcgugggcaugggggaggccgcugccaucuucaugacagccacccccccuggaacggcugaagccuuuccccagagcaaugcgccgauucaggacgaggagcgggacaucccugaaagauccuggaacucuggcaaugaguggauuacagauuucgucgggaaaaccgugugguuugugcccagcaucaaggcuggcaacgacauugccaacugucuucgcaaaaauggaaagaaggucauccaacugucccggaaaacauucgauaccgaauaccagaagacgagacucaacgacugggauuuuguugugaccacagacauuucugagaugggcgccaauuucaaagcugaucgggugaucgacccccgcagaugccugaagccugucauccugaccgaugggcccgagcgggugauucucgccggaccuaugccgguuacagcggccagcgcugcccagcgcagaggccggguggggagaaacccccagaaagaaaaugaccaauacaucuucaccggacagccucuuaacaaugaugaggaccaugcucacuggacagaagccaagaugcugcuggacaacauuaauacccccgagggcaucauuccugcucucuuugaacccgagcgcgagaaguccgccgcgaucgauggggaauaucggcugaaaggcgagagcagaaagacguucgucgaacuuaugcgccggggagaccugccgguguggcucgcccacaaaguugcuucugagggcaucaaguacacagauagaaaauggugcuuugacggggaacgcaacaaucagauucuggaggagaacauggauguggaaaucuggaccaaggagggagaacggaaaaagcugagaccucgcuggcucgacgccagaaccuauuccgauccccuugcucugaaggaguucaaagacuuugccgccggccggaagagcauugcucuggaucucgucacagaaaucgggcgcgugccuucucaucuggcguacagaacccggaaugcccuugacaaccuggucaugcuccacacauccgagcauggaggccgcgcuuauagacacgccguggaggaacugcccgagacgauggaaacccugcuccuucugggccugaugauucuccugacagggggagccaugcuuuuccugaucagcggcaaagggaucggaaagaccuccauuggccucaucuguguuauugugucuagcgggaugcuguggauggcugaugugccucugcaguggaucgccuccgcgauuguccucgaguuuuucaugaugguucuucugauccccgagccggaaaaacaacggacaccucaggacaaucagcuggccuacguggugauuggaauccucacccuggcugccaucgucgcugccaacgagaugggccuucuggaaacgaccaagagagaucucggcaugagcaaggagcccggggugguuucucccacauccuaucuggacguggaccugcacccugcgagcgccuggacccucuacgcugucgccacaaccgugauuacgccgaugcuucgccauacaaucgaaaauucuaccgcuaacgucagccuggccgcuauugccaaccaagcggugguucugaugggacucgauaaaggcuggcccaucuccaagauggaccugggggugccucuucuggcccucggaugcuacucucaggucaauccccugacacugaccgcugccgugcuccuucugguuacccacuaugcuauuaucggcccugggcugcaggccaaagccacacgggaggcgcagaagagaacggcugccggaaucaugaaaaaccccaccguggauggcauuaugacaaucgaccucgauccugucauuuacgacccgaaguuugagaagcaacugggccaggugaugcuucuggugcucugugcuguucagcugcugcucaugcgcaccagcugggcccuuugcgaagcccugacacuggcuaccgggcccaucacgacacucugggagggauccccuggcaaauucuggaauaccaccauugccgucucuauggcgaacaucuuucgggggagcuaucuggccggagcuggccuugccuucuccaucaugaagagcguggggacaggaagacggggcaccggcucucagggggaaacacugggagagaaauggaagaaaaagcucaaucaacugucccgcaaggaauuugaucuguacaaaaagagcggcauuacggagguggacagaaccgaggcuaaagaagggcucaagcggggagagacaacccaucacgccgucucccgcggcucugcgaaacuucagugguucguugaaagaaacauggugauccccgaggggcgggugauugaucugggauguggccgcggcggguggagcuauuacugcgccggacugaagaaagucacagaagugagaggcuauaccaaggggggaccuggccaugaggagcccguuccgauguccacguacggguggaauaucgugaagcucaugucuggaaaagacgucuucuaccugccucccgaaaagugugauacccuucugugcgacauuggcgagagcucccccagcccuacaguggaagagucucggaccauccgcguucucaaaaugguggagcccuggcugaagaacaaucaguuuuguauuaaaguccugaacccuuauaugccgacagugaucgaacaccucgagagacuucagcggaaguacggcgggaugcuggugagaaauccccugucccgcaacagcacccacgaaauguauuggaucucuaauggaacaggcaacauugucuccagcguuaauauggugucucggcuccugcuuaacagauucaccaugacgcaucgccggccuacaaucgagaaggauguggaccugggggcuggaaccagacacgucaacgccgaacccgagaccccuaauauggacgugauuggcgagcgcaucaaacggauuaaggaagagcauagcuccacauggcacuacgaugacgaaaaccccuauaaaacgugggcuuaccacgggucuuaugagguuaaggccaccggaagcgcuuccagcaugaucaauggcguggucaaacuccugacaaagccgugggaugugguuccuauggugacccaaauggccaugacagacaccacacccuuuggccagcagagagucuucaaggaaaaaguggauacccgcacgccucggcccaugccugggaccagaaagguuauggagaucacagcggaguggcuguggcgcacccucggacggaacaaaaagcccagacugugcacacgcgaagaguuuaccaaaaaggugagaacgaaugccgcuaugggcgccgucuucacagaagagaaccaaugggacuccgcucgggccgccguggaagaugaggaguuuuggaagcuugucgaccgcgaaagagagcugcauaaacucgggaaguguggaucuugcguguacaauaugaugggcaaacgggaaaagaaacugggggaguucggcaaggcgaaaggaagcagagcuauuugguacauguggcuuggcgcccgguaucuggaguuugaagcccucggguuccugaacgaggaucacugguuuucccgcgaaaauucuuacagcggaguugagggcgaagggcugcauaagcucggauauauccugagagacauuuccaagaucccgggcggggcuauguacgccgaugacaccgcuggcugggacacacggauuaccgaggaugaccuucacaacgaggaaaaaaucacgcagcagauggauccugagcaucgccagcuggccaaugcgaucuucaagcucaccuaucaaaacaaaguggucaaggugcagagacccacacccaaaggaaccgugauggacauuaucucucggaaggaucagcgcggcagcgggcagguuggaacauacggccugaauaccuuuacaaacauggaagcccaacuugugagacagauggagggggaaggaguccuguccaaggcugaccucgagaauccucaccugcuggagaaaaagauuacccaguggcucgaaacgaaaggcguggagcggcugaagcgcauggccaucagcggggaugacugcguugugaaaccgauugaugacagauucgcuaacgcccuucuggcgcucaacgauaugggcaagguccggaaggacaucccccaguggcaaccuucuaaaggauggcacgauuggcagcaggugcccuucuguucccaucacuuucaugaacugaucaugaaggacggccgcaaacuugucgugccuugcagaccccaggacgagcugauugggcgggcccgcaucagccaaggagcuggcuggucucucaaggaaacagccugucuggggaaagcuuaugcccagauguggucccugauguacuuccacagacgggaucucagacuggcuagcaaugccauuugcucugcgguuccugugcacuggauccccaccucccgcaccacauggagcauucaugcccaccaucaguggaugaccacagaggacaugcuuacggucuggaaccggguguggaucgaggauaauccguggauggaagacaagaccccuguuacaaccugggaggaugugcccuaccugggaaagagagaagaccaaugguguggcucccucauugggcugacaagccgcgcuaccugggcccagaacauccuuacggccauccagcagguccggucucugauuggcgaugaggaguuucucgacuauaugccuagcaugaaaagauuccgcaaggaagaggaauccgagggagcuaucugguga

SEQ ID NO: 20838 - RNA, 9873 nt, Artificial Sequence
  derived and/or modified CDS sequence (opt5) from DENV-3__EU482461__SS-prME
accagccugugccucaugaugaugcugcccgccacacuugcuuuccaccugacgucccgggacggagaaccucggaugaucguggggaagaacgaacgcggaaagucucuccuguuuaagaccgccagcggcauuaauauguguacacuuaucgcgauggaucugggggaaaugugcgacgauaccgucacauacaaguguccgcucauugcugaaguugagcccgaagacaucgauugcugguguaaccugaccuccacaugggugaccuauggaacgugcaaucaggccggcgagcaucggcgggacaagcgcucuguggcccuggcuccucacgucgggaugggacucgauaccagaacacagaccuggaugagcgccgagggcgcuuggagacagguggaaaagguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaaacccacgcucgacaucgagcugcagaagaccgaagcuacacagcuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggucacaugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccucgcaccggacuugauuucaaugagaugauccugcucacgaugaaaaacaaggcuuggaugguccacagacagugguuuuucgaccugccccuuccguggaccagcggcgccacaaccgagacaccuaccuggaaucggaaagaacugcucgugacguuuaagaacgcccaugcuaaaaagcaagagguugugguccuggggucucaggaaggagcgaugcacacagcccugaccggcgcuacagagauucaaaauuccgggggcaccagcaucuucgccggacaccucaagugucgccugaaaauggauaaacuugaacugaaaggcaugucuuacgccaugugccucaacaccuuugugcugaagaaagagguuuccgagacacagcaugggacgauucugaucaagguggaauacaagggagaggacgcucccuguaaaaucccuuucagcaccgaagauggccaagggaaggcccacaacggaagacuuauuacagcgaaucccgucgugaccaaaaaggaggagcccgugaacaucgaagcugagccuccguucggcgaauccaauauuguuaucgggauuggcgacaaagcccucaagaucaacugguauaagaaaggaucuagcaucggcaagauguuugaggccacagcuagaggggccagacgcauggcuauucugggagauaccgccugggacuucggcuccgucgggggagugcugaauagccucggcaaaauggugcaucagaucuuugggucugcguacacggcccuguucuccggcgucagcuggauuaugaagaucggaauuggcgugcuucugacauggaucgggcucaacucuaaaaauaccagcauguccuuuucuugcauuguuaucggaaucauuacccuguaucugggcgcugugguccaggccgauauggggugugcuaucaacuggaagggaaaggaacuuaaaugcggcagcgggauuuucgugacaaaugagguucacaccuggacagagcaguacaaguuucaagccgacucccccaaacggcucgcgacggccaucgcuggcgccugggaaaacggaguguguggcauuagaagcaccacacgcauggagaaucugcuguggaagcagaucgcuaacgaacucaauuauauccugugggagaacaauauuaaacuuaccgucgugguuggggauaucauuggagugcuggaacagggcaagcggacacucaccccucagcccauggagcugaaauacucuuggaagacgugggggaaggccaaaaucgucaccgccgagacacaaaacuccagcuucauuaucgacggaccuaacacccccgaaugcccgucugcuuccagagcguggaaugugugggagguggaagacuauggcuuuggcgucuucacaaccaacaucuggcugaaacuucgcgagguuuacacacagagcugugaucaucggcucauguccgccgcuauuaaagacgaaagagccgugcacgccgauaugggguacuggaucgagucucagaagaauggaagcuggaaacuggagaaggcuuccuuuauugaagugaagaccugcacguggccuaaaucucacacacuguggagcaacggcguccucgaguccgacaugaucauucccaagagccuggccgggccuaucucucagcauaaucaccgccccggauaucauacccaaaccgcgggcccuuggcaccuugggaaacuggaacucgauuucaacuacugcgagggaacaaccgugguuaucacggagaauuguggcacacggggccccucccugagaaccacaaccgugagcgggaagcugauucacgaauggugcugucgcucuugcacacuuccgccucuccgguauaugggagaggacggcuguugguacgggauggaaaucagacccauuaacgagaaagaagagaauauggucaagucccuggugagcgcuggaucuggcaagguugauaacuuuaccaugggggugcugugccucgccauccuguucgaggaagucaugcggggaaaauucggcaagaaacauaugauugccggcgugcuuuuuacguucguucugcuccugagcgggcagaucaccuggcgcgacauggcucacacacugauuaugaucggauccaaugccagcgauagaaugggcaugggggugaccuaucuugcgcugaucgcuacauuuaagauucagcccuuccucgcccugggauuuuuccuccggaaacugaccucuagagagaaccuucugcucggcgucgggcuggccauggcuacgacacugcaacuuccugaagacaucgagcagauggccaauggaauugcucugggccucaugacccugaagcucaucacacaguuugaaaccuaccagcuguggaccgcccuugugucccugacauguagcaacacgauuuucacccucacaguggcguggcgcaccgccacacugauccuggcuggcgucucccuucugccgcucugccaaucuagcuccaugcggaagaccgauuggcugcccaugacgguugccgcuaugggggugccuccccucccucuguuuaucuucucucuuaaagacacacccaagagacgcagcuggccucugaaugagggagugauggccgucggccugguguccauucucgccucuagccugcuuagaaacgauguucccauggcugggccgcugguggcgggaggccuccugaucgccuguuaugucauuaccgggaccuccgcugaccucacaguggagaaagccgccgacguuaccugggaagaggaagcugagcagacaggagugagccauaaccugaugaucacggucgaugacgauggcaccaugcggauuaaggacgaugaaacagagaauauccuuaccgugcugcugaaaacagcccuccugaucgucucuggcauuuuuccuuacuccauccccgcgacccuucugguguggcacacguggcagaagcagacccaacgcagcgggguucucugggacgugccuucucccccggagacacagaaagcugaacuggaggaaggagucuacagaauuaagcagcagggcaucuucgggaagacccaagugggaguuggcgugcagaaagagggggucuuucauacaauguggcacgugacccggggagccgugcucacacacaacggcaagcgccuggagccuaauugggccuccguuaaaaaggaucuuauuagcuauggcgggggauggagacugucugcucaguggcaaaaaggcgaagagguccaggugaucgccguggaacccgggaagaacccuaagaauuuccagacgaugcccggaauuuuccagaccacaaccggcgagaucggggcgaucgcucuggacuuuaaacccggaaccuccggcagcccuauuaucaaccgggaaggcaaggucguggggcucuacggaaauggcguugugaccaagaacgggggauaugucuccggcauugcccaaacgaaugccgagccggaugggcccaccccugagcuggaagaggaaauguucaagaaacgcaaccuuacaaucauggaccugcaucccggcagcggaaagaccagaaaguaccucccugcuauugugcgggaggccaucaaacgcagacugcggacacucauccuggcucccaccagaguuguggccgcggaaauggaggaggcccuuaagggccugccuauucgcuaucagacgacagcuaccaaaucugaacacaccgggcgggagaucgucgaucugaugugccaugccacauuuaccaugagacuccugagcccggugcgcguucccaauuacaaccuugugauuauggacgaagcucacuucacagauccugccuccaucgccgcucggggauauauuucuaccagagucggcaugggggaggcggccgcuaucuuuaugacggccacacccccuggaaccgccgaggcuuucccccagagcaaugccccgauccaggacgaggagcgcgacauuccugaacgguccuggaacucuggcaaugaguggaucacagauuuuguggggaagaccgugugguucguccccagcauuaaagcgggcaacgacaucgcuaacugucugagaaagaauggaaagaaaguuauucaacucucccgcaagacguuugauaccgaauaccagaaaacacggcugaacgacugggauuucguggugaccacagacaucucugagaugggcgccaauuuuaaggccgauagagucauugacccccggcgcugccugaaaccugugauccucaccgaugggcccgagagaguuauccuugcuggaccuaugccggugacagccgcgagcgccgcucagcggcgcggcagagucgggcggaacccccagaaggaaaaugaccaauacauuuucaccggacagccucugaacaaugaugaggaccaugcccacuggacggaagcuaagaugcugcucgacaacaucaauacacccgagggcauuaucccugcccuguucgaacccgagagagagaaauccgcugccauugauggggaauaucgccuuaagggcgagagccggaaaaccuuuguggaacugaugagacgcggagaccucccgguuuggcuggcgcacaagguggccucugagggcaucaaauacaccgaucggaaguggugcuucgacggggaaagaaacaaucagauccuggaggagaacauggaugucgaaauuuggacaaaagagggagaacgcaagaagcuccggccuagauggcuugacgcucgcaccuauuccgauccccuggcccugaaagaguuuaaggacuucgcugccggcagaaaaagcaucgcccucgaucuggugacagaaauugggcgggucccuucucaucuugcuuaccgcacgagaaaugcgcuggacaaccucgugaugcugcacaccuccgagcauggaggccgggccuaucgccacgcuguugaggaacugcccgagacaauggaaacccuccuucugcugggccucaugauccugcuuacagggggagccaugcuguuucucauuagcggcaaggggaucggaaaaaccuccaucggccugauuugugugaucgugucuagcgggaugcuguggauggccgaugucccucuccaguggauugcuuccgccaucguucuugaguucuuuaugauggugcugcugauucccgagccggaaaagcaaagaacgccucaggacaaucagcucgcguacguggucaucggcauucugacccuugccgcuaucguggccgcuaacgagaugggccugcucgaaacaaccaagcgggaucugggcaugagcaaagagcccgggguugugucucccacauccuaucuggacgucgaccuccacccugccagcgcguggacccuuuacgccguggcuacgacagucaucaccccgaugcugagacauacaauugaaaauucuaccgccaacgugagccuggcugccaucgcuaaccaagccguugugcucaugggacuggauaagggcuggcccauuuccaaaauggaccuuggggucccucugcucgcgcugggaugcuacucucaggugaauccccugacccucacagccgcuguucuucugcuggugacgcacuaugccaucauuggcccugggcuccaggcuaaggccacccgcgaggcccagaaacggacagcggcuggaaucaugaagaaccccaccgucgauggcaucaugacaauugaccuggauccugugaucuacgacagcaaguucgagaaacaacuuggccaggugaugcugcucguucugugugccguccagcugcuccuuaugagaaccuccugggcucugugcgaagcccugacgcucgccacagggccgauuaccacccugugggagggaucucccggcaaguuuuggaauacaaccaucgcugugagcauggccaacauuuuccgcggguccuaucuugcgggagccggccuggcuuuuagcaucaugaaaucuguggggacaggacggagaggcacgggcucccagggggaaacccucggagagaaguggaaaaagaagcugaaucaacugagccggaaagaguucgaucucuacaagaaauccggcaucacagaggucgaccgcaccgaggccaaggaagggcuuaaaagaggagagacaacccaucacgcuguuucucggggcagcgccaagcugcagugguuuguggaacgcaacauggugauuccugaggggagagucaucgaucugggauguggccggggcgggugguccuauuacugcgcgggacucaaaaaggugacggaaguucgcggcuauaccaaaggcgggcccgggcaugaggagccugugcccaugucuacauacggguggaaucuggucaaacuuaugagcggaaaggacguguucuaccugccgccugaaaaaugugauacccuccugugcgacauuggcgaguccagccccucucccacaguugaagaguccagaaccauccgggugcugaagauggucgagccuuggcucaaaaacaaucaguucuguauuaaggugcuuaaccccuauaugccuacagugaucgaacaccuggagcgccugcagagaaaguacggcgggaugcucguccggaauccgcugagcagaaacucuacccacgaaauguauuggauuuccaauggaacgggcaacaucguuagcucugugaauauggugagccgccuucugcucaaccgguuuacaaugacccauagacgccccaccaucgagaaagaugucgaccugggggccggaacacggcacgugaacgcugaaccugagacgcccaauauggacguuauuggcgagagaaucaagcgcauuaaagaagaacauuccucuaccuggcacuacgaugacgaaaacccuuauaagacaugggccuaccacgggagcuaugaggugaaagcuaccggauccgccagcuccaugaucaauggcgucgugaagcugcucacaaagcccugggauguugugccgauggucacccaaauggcuaugacagacaccacgccuuucggccagcagcggguguuuaaagaaaagguugauaccagaacaccccgcccuaugcccgggacccggaaagugauggagauuacagccgaguggcuguggagaacccuuggacgcaacaagaaaccucggcugugcacgagagaagaguucacaaagaagguccgcaccaaugcggccaugggcgcuguguuuacagaagagaaccaaugggacucugccagagcugccgucgaagaugaggaguucuggaaacucguggaccgggaacgcgagcugcauaaacuugggaaauguggaagcugcguuuacaauaugaugggcaagagagagaagaagcugggggaguuuggcaaagccaagggaucccgggcgaucugguacauguggcucggcgcuagauaucuggaguucgaagcccugggguuucucaacgaggaucacugguucucucgggaaaauagcuacuccggaguggagggcgaagggcugcauaaacuuggauauauccugcgcgacauuucuaaaauccccggcggggccauguacgcugaugacaccgccggcugggacacgagaauuaccgaggaugaccuccacaacgaggaaaagaucacacagcagauggauccggagcaucggcagcuggcuaaugccauuuuuaaacuuaccuaucaaaacaaggucgugaaagugcagcgcccuacacccaagggaaccguuauggacaucaucagcagaaaggaucagcggggcuccggacaggugggaacauacggccugaauaccuucacgaacauggaagcgcaacucguccgccagauggagggggaaggagugcugagcaaagccgaccuggagaauccccaccuccuggagaagaaaauuacacaguggcuugaaaccaagggcguugagagacugaaacggauggcuaucucuggggaugacugcguggucaagccuauugaugaccgcuuugccaacgcucuccuggcccuuaacgauaugggcaaggugagaaaagacaucccgcaguggcaacccuccaagggauggcacgauuggcagcaggucccuuucuguagccaucacuuccaugaacugauuaugaaagacggccggaagcucgugguucccugccgcccucaggacgagcugaucgggagagcgcggaucucucaaggagccggcuggucccugaaagaaaccgcuugucucgggaaggccuaugcucagauguggagccugauguacuuucaccgcagagaucuucggcuggccucuaaugcuauuugcuccgccgugcccguccacuggaucccuacaagcagaaccacaugguccauucaugcgcaccaucaguggaugacgaccgaggacaugcucacaguguggaaccgcguuuggaucgaggauaaucccuggauggaagacaagaccccggugacaaccugggaggaugucccuuaccugggaaaacgggaagaccaaugguguggcagccuuauugggcugacgucuagagccaccugggcucagaacauccucacagccauucaacaggugcgcagccugaucggcgaugaggaguuccuggacuauaugcccuccaugaagcgguuuagaaaagaagaggaaucugagggagccaucugguga

SEQ ID NO: 20839 - RNA, 9873 nt, Artificial Sequence
  derived and/or modified CDS sequence (opt5) from DENV-3__EU482462__SS-prME
accucccugugccucaugaugaugcugcccgcuacacuugcuuuccaccugacgucccgggacggagagccucggaugaucguggggaagaacgaacgcggaaagucucuccuguuuaagaccgccagcggcauuaauauguguacacuuaucgcgauggaucugggggagaugugcgacgauaccgucacauacaaguguccgcucauugcugaaguugagcccgaagacaucgauugcugguguaaccugaccuccacaugggugaccuauggaacgugcaaucaggccggcgagcacagacgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggcccgcaauaagcccacgcucgacaucgagcugcagaaaaccgaagcuacacagcuugccacccugagaaagcucuguauugagggaaaaaucacaaacauuaccacggauucccggugcccuacacagggcgaagcgauccugccggaggaacaggaccagaauuauguguguaagcacaccuacguggaucgcggcugggggaacggaugcggccuuuucgggaaaggaagccuggugacaugcgccaaguuucaaugucucgagcccauugagggcaaggugguucaguaugaaaaucugaaauacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccuagaaccggacuugauuucaaugagaugauccugcucacgaugaagaacaaggcuuggaugguccaccggcagugguuuuucgaccugccccuuccguggaccagcggcgccacaaccgagacaccuaccuggaaucgcaaggaacugcucgugacguuuaaaaacgcccaugcuaagaaacaagagguugugguccuggggucucaggaaggagcgaugcacacagcccugaccggcgcuacagagauucaaaauuccgggggcaccagcaucuucgccggacaccucaaguguagacugaagauggauaaacuugaacugaagggcaugucuuacgccaugugccucaacaccuuugugcugaaaaaggagguuuccgagacacagcaugggacgauucugaucaaaguggaauacaagggagaggacgcucccuguaagaucccuuucagcaccgaagauggccaagggaaagcccacaacggacggcuuauuacagcgaaucccgucgugaccaagaaagaggagcccgugaacaucgaagcugagccuccguucggcgaauccaauauuguuaucgggauuggcgacaaggcccucaaaaucaacugguauaagaagggaucuagcaucggcaaaauguuugaggccacagcuagaggggcccgccggauggcuauucugggagauaccgccugggacuucggcuccgucgggggagugcugaauagccucggcaagauggugcaucagaucuuugggucugcguacacggcccuguucuccggcgucagcuggauuaugaaaaucggaauuggcgugcuucugacauggaucgggcucaacucuaagaauaccagcauguccuuuucuugcauuguuaucggaaucauuacccuguaucugggcgcugugguccaggccgauauggggugugcuaucaacuggaaaggaaaggaacuuaagugcggcagcgggauuuucgugacaaaugagguucacaccuggacagagcaguacaaauuucaagccgacucccccaagagacucgcgacggccaucgcuggcgccugggaaaacggaguguguggcauucgcagcaccacacggauggagaaucugcuguggaaacagaucgcuaacgaacucaauuauauccugugggagaacaauauuaaacuuaccgucgugguuggggauaucauuggagugcuggaacagggcaaaagaacacucaccccucagcccauggaccugaaguacucuuggaaaacgugggggaaggccaagaucgucaccgccgagacacaaaacuccagcuucauuaucgacggaccuaacacccccgagugcccgucugcuucccgcgcguggaaugugugggaaguggaggauuauggcuuuggcgucuucacaaccaacaucuggcugaaacuucgggaaguuuacacacagagcugugaccauagacucauguccgccgcuauuaaggaugagcgcgccgugcacgccgacaugggguacuggaucgaaucucagaaaaauggaagcuggaagcuggagaaagcuagcuuuauugaggugaagaccugcacguggccuaagucucacacacuguggagcaacggcguccucgaauccgauaugaucauucccaaaagccuggccgggccuaucucucagcauaaucaccggcccggauaucauacccaaaccgcgggcccuuggcaccuugggaagcuggagcucgacuucaacuacugcgaaggaacaaccgugguuaucacggagaauuguggcacaagaggccccucccugcgcaccacaaccgugagcgggaaacugauucacgaguggugcugucggucuugcacacuuccgccucucagauauaugggagaagauggcuguugguacgggauggagauccggcccauuaacgaaaaggaggaaaauauggucaaaucccuggugagcgcuggaucuggcaagguugacaacuuuaccaugggggugcugugccucgccauccuguucgaggaggucaugcgcggaaaguucggcaaaaagcauaugauugccggcgugcuuuuuacguucguucugcuccugagcgggcagaucaccuggaaagauauggcucacacauuuauuaugaucggauccaaugccagcgacagaaugggcaugggggugaccuaucuggcgcuuaucgcuacauucaagauucagcccuuucuggcccucggauucuuucugcggaaacucaccucuagagaaaaccugcuucugggcgucgggcucgccauggcuacgacacugcaacugccugaggauaucgaacagauggccaauggaauugcucuuggccugaugacccucaagcugaucacacaguucgagaccuaccagcucuggaccgcccuggugucccuuacauguagcaacacgauuuuuacccugacaguggcguggcgcaccgccacacucguccuggcuggcguuucccugcuuccgcugugccaaucuagcuccaugcggaagaccgacuggcuccccaugacgguggccgcuaugggggugccuccccugccucucuucaucuuuucucugaaagauacacccaagagacgcagcuggccucuuaaugaaggagucauggccgugggccugguuuccauccuggccucuagccuccugagaaacgacgugcccauggcugggccgcuugucgcgggaggccugcucauugccuguuaugugaucaccgggaccuccgcugaccugacaguugagaaagccgccgaugugaccugggaggaagaggcugaacagacaggagucagccauaaccucaugauuacgguggacgaugacggcaccaugcggaucaaggaugacgagacagaaaauauucugaccguccuucugaaaacagcccugcucaucgugucuggcaucuucccuuacuccauucccgcgacccugcuuguuuggcacacguggcagaagcagacccaacgcagcggggugcugugggaugucccuucucccccggagacacagaaagcugagcucgaagagggaguguacagaaucaagcagcagggcauuuuugggaagacccaaguuggagugggcguccagaaagaagggguguuccauacaauguggcacgugacccggggagccguucugacacacaacggcaagcgccucgagccuaauugggccuccgucaaaaaggaccugaucagcuauggcgggggauggagacuuucugcucaguggcaaaaaggcgaggaaguccaggugauugccgucgagcccgggaagaacccuaagaauuuccagacgaugcccggaaucuuucagaccacaaccggcgaaauuggggcgaucgcucuggauuucaaacccggaaccuccggcagcccuaucauuaaccgggagggcaaggugguugggcuguacggaaauggcguggucaccaagaacgggggauauguguccggcaucgcccaaacgaaugccgaaccggacgggcccaccccugagcucgaggaagagauguuuaagaaacgcaaccugacaauuauggaucuucaucccggcagcggaaagaccagaaaguaccugccugcuaucguucgggaagccauuaaacgcagacuccggacacugauccucgcucccaccagaguggucgccgcggagauggaagaggcccugaagggccuuccuauccgcuaucagacgacagcuaccaaaucugagcacaccgggcgggaaauuguggaccugaugugccaugccacauucaccaugagacugcucagcccgguucgcgugcccaauuacaaccugaucauuauggaugaggcucacuuuacagacccugccuccaucgccgcucggggauauauuucuaccagagucggcaugggggaagcggccgcuaucuucaugacggccacacccccuggaaccgccgaggcuuuuccccagagcaaugccccgauccaggacgaggaacgcgauauuccugagcgguccuggaacucuggcaaugaauggaucacagacuucguggggaagaccgugugguuuguccccagcauuaaagcgggcaacgauaucgcuaacugucuuagaaagaauggaaagaaaguuauucaacugucccgcaagacguucgacaccgaguaccagaaaacacggcucaacgauugggacuuuguggugaccacagauaucucugaaaugggcgccaauuucaaggccgacagagucauugauccccggcgcugccugaaaccugugauccugaccgacgggcccgagagaguuauccucgcuggaccuaugccggugacagccgcgagcgccgcucagcggcgcggcagagucgggcggaacccccagaaggagaaugaucaauacauuuucaccggacagccucuuaacaaugacgaagaccaugcccacuggacggaggcuaagaugcugcuggauaacaucaauacacccgaaggcauuaucccugcccucuuugagcccgaaagagagaaauccgcugccauugacggggaguaucgccugaagggcgaaagccggaaaaccuucguggagcuuaugagacgcggagaucugccgguuuggcucgcgcacaagguggccucugaaggcaucaaauacaccgaccggaaguggugcuuugauggggagagaaacaaucagauccuggaagagaacauggacgucgagauuuggacaaaagaaggagagcgcaagaagcugcggccuagauggcucgaugcucgcaccuauuccgacccccuugcccugaaagaguucaaggauuuugcugccggcagaaaaagcaucgcccuggaccucgugacagagauugggcgggucccuucucaucuggcuuaccgcacgagaaaugcgcuugauaaccuggugaugcuccacaccuccgaacauggaggccgggccuaucgccacgcuguugaggagcugcccgaaacaauggagacccugcuccuucugggccugaugauccuccugacagggggagccaugcuuuuccugauuagcggcaaggggaucggaaaaaccuccaucggccucauuugugugaucgugucuagcgggaugcuguggauggccgacgucccucugcaguggauugcuuccgccaucguucucgaauuuuucaugauggugcuucugauucccgagccggagaagcaaagaacgccucaggauaaucagcuggcguacguggucaucggcauucucacccuggccgcuaucguggccgcuaacgaaaugggccuucuggagacaaccaagcgggaccucggcaugagcaaagaacccgggguugugucucccacauccuaucuggacgucgaucugcacccugccagcgcguggacccucuacgccguggcuacgacagucaucaccccgaugcuuagacauacaauugaaaauucuaccgccaacgugagccuggcugccaucgcuaaccaagccguugugcugaugggacucgacaagggcuggcccauuuccaaaauggaucugggggucccucuucuggcgcucggaugcuacucucaggugaauccccugacccugacagccgcuguucuccuucuggugacgcacuaugccaucauuggcccugggcugcaggcuaaggccacccgcgaagcccagaaacggacagcggcuggaaucaugaagaaccccaccgucgacggcaucaugacaauugaucucgacccugugaucuacgauagcaaguuugagaaacaacugggccaggugaugcuucugguucucugugccguccagcugcugcucaugagaaccuccugggcucuuugcgaggcccugacgcuggccacagggccgauuaccacccucugggaaggaucucccggcaaguucuggaauacaaccaucgcugugagcauggccaacauuuuucgcggguccuaucuggcgggagccggccuugcuuucagcaucaugaaaucuguggggacaggacggagaggcacgggcucccagggggagacccugggagaaaaguggaaaaagaagcucaaucaacugagccggaaagaguuugaccuguacaagaaauccggcaucacagaagucgaucgcaccgaggccaaggaggggcucaaaagaggagaaacaacccaucacgcuguuucucggggcagcgccaaacuucagugguucguggagcgcaacauggugauuccugaagggagagucaucgaccugggauguggccggggcgggugguccuauuacugcgcgggacugaaaaaggugacggagguucgcggcuauaccaaaggcgggcccgggcaugaagaaccugugcccaugucuacauacggguggaauauugucaaacucaugagcggaaaggauguguucuaccugccgccugagaaaugugacacccuucugugcgauaucggcgaauccagccccucucccacaguugaggaauccagaaccauucgggugcucaagauggucgagccuuggcugaaaaacaaucaguuuuguaucaaggugcugaaccccuauaugccuacagugauugagcaccucgaacgccuucagagaaaguacggcgggaugcugguccggaauccgcugagcagaaacucuacccacgagauguauuggaucuccaauggaacgggcaacaucguuagcucugugaauauggugagccgccuccugcuuaaccgguucacaaugacccauagacgccccaccauugaaaaagacgucgaccugggggccggaacacggcacgugaacgcugagccugaaacgcccaauauggauguuaucggcgagagaauuaagcgcaucaaagaggaacauuccucuaccuggcacuacgacgaugagaacccuuauaagacaugggccuaccacgggagcuaugaagugaaagcuaccggauccgccagcuccaugauuaauggcgucgugaagcuccugacaaagcccugggacguugugccgauggucacccaaauggcuaugacagauaccacgccuuuuggccagcagcggguguucaaagagaagguugacaccagaacaccccgcccuaugcccgggacccggaaagugauggaaaucacagccgaguggcuguggagaacccucggacgcaacaagaaaccucggcugugcacgagagaggaauuuacaaagaagguccgcaccaaugcggccaugggcgcuguguucacagaggaaaaccaaugggauucugccagagcugccgucgaggacgaagaguuuuggaaacuuguggaucgggagcgcgaacugcauaagcucgggaaauguggaagcugcguuuacaauaugaugggcaagagagagaaaaagcugggggaguucggcaaagccaagggaucccgggcgaucugguacauguggcuuggcgcuagauaucuggaguuugaggcccucggguuccugaacgaagaccacugguuuucucgggagaauagcuacuccggaguggaaggcgaggggcugcauaagcucggauauauucugcgcgauaucucuaaaauucccggcggggccauguacgcugacgacaccgccggcugggauacgagaaucaccgaagacgaucuucacaacgaggagaagauuacacagcagauggacccggaacaucggcagcuggcuaaugccaucuucaaacucaccuaucaaaacaaggucgugaaagugcagcgcccuacacccaagggaaccguuauggauaucauuagcagaaaggaccagcggggcuccggacaggugggaacauacggccugaauaccuuuacgaacauggaggcgcaacuuguccgccagauggaaggggagggagugcugagcaaagccgaucucgaaaauccccaucugcuggagaagaaaaucacacaguggcucgagaccaagggcguugaaagacugaaacggauggcuauuucuggggacgauugcguggucaagccuaucgacgaucgcuucgccaacgcccuucuggcccucaacgacaugggcaaggugagaaaagauauuccgcaguggcaacccuccaagggauggcacgacuggcagcaggucccuuucuguagccaucacuuucaugagcugaucaugaaagacggccggaaacuugugguucccugccgcccucaggaugaacugaucgggagagcgcggauuucucaaggagccggcuggucccucaaagagaccgcuugucuggggaaggccuaugcucagauguggagccugauguacuuccaccgcagagaccuccggcuggccucuaaugcuaucugcuccgccgugcccguccacuggauuccuaucagcagaacaaccugguccauucaugcgcaccaucaguggaugacaacggaagauaugcuuaccguguggaaccgcguuuggaucgaggacaaucccuggauggaggauaagacaccggugaccacaugggaagacgucccuuaccugggaaaacgggaggaucaaugguguggcagccucauugggcugaccucuagagccacgugggcucagaacauccuuaccgccauccaacaggugcgcagccugauuggcgacgaagaguuucucgauuauaugcccuccaugaagcgguucagaaaagaggaagagucugaaggagccaucugguga

SEQ ID NO: 20840 - RNA, 9873 nt, Artificial Sequence
  derived and/or modified CDS sequence (opt5) from DENV-3__EU660407__SS-prME
accagccugugccucaugaugaugcugcccgccacacuugcuuuccaccugacgucccgggacggcgagccucggaugaucguggggaagaaugaacgcggaaagucucuccuguuuaagaccgccagcggcauuaauauguguacacuuaucgcgauggaucugggggagaugugcgacgauaccgucacauacaaguguccgcucauugcugaaguugagcccgaagacaucgauugcugguguaaccugaccuccacaugggugaccuauggaacgugcaaucaggccggcgagcaucggcgggacaagcgcucuguggcccuggcuccucacgucgggaugggacucgauaccagaacacagaccuggaugagcgccgagggcgcuuggagacagguggaaaagguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaaacccacgcucgacaucgagcugcagaagaccgaagcuacacaacuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggugacaugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccucgcaccggacuugauuucaaugagaugauccugcucacgaugaaaaacaaggcuuggaugguccacagacagugguuuuucgaccugccccuuccguggaccagcggcgccacaaccgagacaccuaccuggaaucggaaagaacugcucgugacguuuaagaacgcccaugcuaaaaagcaagagguugugguccuggggucucaggaaggagcgaugcacacagcccugaccggcgcuacagagauucagaauagcgggggcaccagcaucuucgccggacaccucaagugucgccugaaaauggauaaacuugaacugaaaggcaugucuuacgccaugugccucaacaccuuugugcugaagaaagagguuuccgagacacagcaugggacgauucugaucaagguggaauacaagggagaggacgcucccuguaaaaucccuuucagcaccgaagauggccaagggaaggcccacaacggaagacuuauuacagcgaaucccgucgugaccaaaaaggaggagcccgugaacaucgaagcugagccuccguucggcgaauccaauauuguuaucgggauuggcgacaaagcccucaagaucaacugguauaagaaaggaucuagcaucggcaagauguuugaggccacagcuagaggggccagacgcauggcuauucugggagauaccgccugggacuucggcuccgucgggggagugcugaauagccucggcaaaauggugcaucagaucuuugggucugcguacacggcccuguucuccggcgucagcuggauuaugaagaucggaauuggcgugcuucugacauggaucgggcucaacucuaaaaauaccagcauguccuuuucuugcauuguuaucggaaucauuacccuguaucugggcgcugugguccaggccgauauggggugugugaucaacuggaagggaaaggaacuuaaaugcggcagcgggauuuucguuacaaaugaggugcacaccuggacagagcaguacaaguuucaagcugacucccccaaacggcucgccacggcgaucgccggcgcuugggaaaacggagucuguggcauuagaagcaccacacgcauggagaaucugcuguggaagcagaucgccaacgaacucaauuauauccugugggagaacaauauuaaacuuaccgugguugugggggauaucauuggaguccuggaacagggcaagcggacacucaccccucagcccauggagcugaaauacucuuggaagacgugggggaaggcuaaaaucgugaccgccgagacacaaaacuccagcuucauuaucgacggaccuaacacccccgaaugcccgucugccuccagagcuuggaaugugugggaggucgaagacuauggcuuuggcguuuucacaaccaacaucuggcugaaacuucgcgagguguacacacagagcugugaucaucggcucauguccgcggccauuaaagacgaaagagcugugcacgccgauaugggguacuggaucgagucucagaagaauggaagcuggaaacuggagaaggccuccuuuauugaagucaagaccugcacguggccuaaaucucacacacuguggagcaacggcgugcucgagaaugacaugaucauucccaagucccuggcugggccuaucagccagcauaaccaccgccccggauaucauacccaaaccgccggcccuuggcaccuugggaaacuggaacucgauuucaauuacugcgagggaacaaccguugugaucacggagaacuguggcacacggggccccucucugagaaccacaaccgucuccgggaagcugauucacgaauggugcugucgcagcugcacacuuccgccucuccgguauaugggagaggacggcuguugguacgggauggaaaucagacccauuaaugagaaagaagagaacauggugaagucucugguuuccgcgggaagcggcaagguggauaauuuuaccauggggguccugugccucgcuauccuguucgaggaagugaugcggggaaaauucggcaagaaacauaugauugccggcguucuuuuuacguucgugcugcuccugucugggcagaucaccuggcgcgacauggcccacacacugauuaugaucggaagcaacgcuuccgauagaaugggcaugggggucaccuaucuugcccugaucgcgacauuuaagauucagcccuuccucgcucugggauuuuuccuccggaaacugaccagcagagagaaucuucugcucggcguggggcuggccauggccacgacacugcaacuuccugaagacaucgagcagauggcuaacggaauugcccugggccucaugacccugaagcucaucacacaguuugaaaccuaccagcuguggaccgcucuugugucucugacauguuccaauacgauuuucacccucacagucgccuggcgcaccgcgacacugauccuggccggcguuagccuucugccgcucugccaauccucuagcaugcggaagaccgauuggcugcccaugacgguggcugccaugggggugccuccccucccucuguuuaucuucucccuuaaagacacacccaagagacgcucuuggccucugaacgagggagucauggcugugggccugguuagcauucucgccuccucucugcuuagaaacgaugugcccauggccgggccgcuggucgcuggaggccuccugaucgcguguuaugugauuaccgggaccagcgccgaccucacaguugagaaagcugccgacgugaccugggaagaggaagccgagcagacaggagucucccauaaucugaugaucacgguggaugacgauggcaccaugcggauuaaggacgaugaaacagagaacauccuuaccguccugcugaaaacagcucuccugaucgugagcggcauuuuuccuuacucuauccccgccacccuucugguuuggcacacguggcagaagcagacccaacgcuccggggugcucugggacgucccuucucccccggagacacagaaagcggaacuggaggaaggaguguacagaauuaagcagcagggcaucuucgggaagacccaaguuggagugggcguccagaaagaggggguguuucauacaauguggcacgugacccggggagcuguucucacacacaauggcaagcgccuggagccuaacugggccuccgucaaaaaggaucuuauuuccuauggcgggggauggagacugagcgcccaguggcaaaaaggcgaagagguccaggugaucgcugucgaacccgggaagaauccuaagaacuuccagacgaugcccggaauuuuccagaccacaaccggcgagaucggggccaucgcgcuggacuuuaaacccggaaccucuggcuccccuauuaucaaucgggaaggcaaggugguugggcucuacggaaacggcguggucaccaagaaugggggauaugugagcggcauugcucaaacgaacgccgagccggaugggcccaccccugagcuggaagaggaaauguucaagaaacgcaaucuuacaaucauggaccugcaucccggcuccggaaagaccagaaaguaccucccugccauuguucgggaggcuaucaaacgcagacugcggacacucauccuggcccccaccagaguggucgcugccgaaauggaggaggcgcuuaagggccugccuauucgcuaucagacgacagccaccaaaagcgaacacaccgggcgggagaucguggaucugaugugccaugcuacauuuaccaugagacuccugucuccgguucgcgugcccaacuacaaucuuauuaucauggacgaagcccacuucacagauccugcuagcauugccgcccggggauauaucuccaccagagucggcaugggggaggcugcggccaucuuuaugacggcuacacccccuggaaccgccgaagccuucccccagucuaacgcuccgauucaggacgaggagcgcgacaucccugaacggagcuggaacuccggcaacgaguggauuacagauuuuguggggaagaccgugugguucguccccucuaucaaagccggcaacgacauugcgaauugucugagaaagaacggaaagaaaguuauccaacucagccgcaagacguuugauaccgaauaccagaaaacaaagcugaaugacugggauuucguggugaccacagacauuuccgagaugggcgcuaacuuuaaagccgaucgggucaucgaccccagacggugccugaagccugugauccucaccgaugggcccgagcgcguuauucuugccggaccuaugccggugacagcugccucugcggcccagagacggggccgcgucgggagaaauccccagaaggaaaacgaccaauacaucuucaccggacagccucugaauaacgaugaggaccaugcucacuggacggaagccaaaaugcugcucgacaauauuaacacacccgagggcaucauuccugcucuguucgaacccgagcgggaaaagagcgccgcuaucgauggggaauauagacuuaaaggcgagucccgcaagaccuuuguggaacugaugcggagaggagaccucccgguuuggcuggcccacaaaguggcgagcgagggcaucaaguacaccgaucgcaaauggugcuucgacggggaacggaauaaccagauucuggaggagaauauggaugucgaaaucuggacaaaggagggagaaagaaagaaacuccgcccucgguggcuugacgccagaaccuauucugauccccuggcucugaaggaguuuaaagacuucgccgcuggccgcaaguccauugcccucgaucuggugacagaaaucgggagagucccuagccaucuugccuaccggacgcgcaacgcucuggacaaucucgugaugcugcacaccucugagcauggaggcagagcguaucggcacgccguugaggaacugcccgagacaauggaaacccuccuucugcugggccucaugauucugcuuacagggggagcuaugcuguuucucaucuccggcaaagggaucggaaagaccagcauuggccugaucugugugauuguguccucugggaugcuguggauggccgaugucccucuccaguggaucgccagcgcuauuguucuugaguucuuuaugauggugcugcugauccccgagccggaaaagcaacgcacgccucaggacaaccagcucgccuacguggucauuggaauccugacccuugcggccaucguggcugccaaugagaugggccugcucgaaacaaccaaaagagaucugggcauguccaaggagcccgggguugugagccccacaucuuaucuggacgucgaccuccacccugcuuccgccuggacccuuuacgcgguggccacgacagucauuaccccgaugcugcggcauacaaucgaaaacagcaccgcuaacgugucucuggccgcuauugccaaucaagcuguugugcucaugggacuggauaaaggcuggcccaucagcaagauggaccuuggggucccucugcucgcccugggaugcuacucccaggugaacccccugacccucacagcggccguucuucugcuggugacgcacuaugcuauuaucggcccugggcuccaggccaaagcuaccagagaggcccagaagcgcacagccgcgggaaucaugaagaaucccaccgucgauggcauuaugacaaucgaccuggauccugugauuuacgacucuaaauucgagaagcaacuuggccaggugaugcugcucguucugugugcuguccagcugcuccuuaugcggaccagcugggcccugugcgaagcucugacgcucgccacagggccgaucaccacccugugggagggaucccccggcaaauuuuggaacacaaccauugccgugucuauggcuaauaucuucagagggagcuaucuugccggagcgggccuggccuuuuccaucaugaaaagcguggggacaggacgccggggcacgggcucucagggggaaacccucggagagaaauggaagaagaaacugaaccaacuguccagaaaggaguucgaucucuacaaaaagagcggcauuacagaggucgaccggaccgaggcuaaagaagggcuuaagcgcggagagacaacccaucacgccguuuccagaggcucugcuaaacugcagugguuuguggaacggaauauggugaucccugaggggcgcgucauugaucugggauguggcagaggcggguggagcuauuacugcgccggacucaagcgggugacggaaguucgcggcuauaccaaaggcgggcccgggcaugaggagccugugcccauguccacauacggguggaacaucgucaaacugaugucuggaaaggacguguucuaccuuccgccugaaaaaugugauacccugcucugcgacauuggcgagagcucccccagccccacaguugaagagucuagaaccauccgggugcugaagauggucgagccuuggcugaaaaauaaccaguucuguauuaaggugcucaaucccuauaugccuacagugaucgaacaccuugagcgccugcagagaaaguacggcgggaugcugguccggaacccgcucuccagaaauagcacccacgaaauguauuggaucucuaacggaacgggcaauauuguuuccagcgugaacauggugucucgccugcuucugaaccgguuuacaaugacccauagacgccccaccaucgagaaagaugucgaccucggggcgggaacacggcacgugaaugccgaaccugagacgcccaacauggacguuauuggcgagagaaucaagcgcauuaaagaagaacacagcuccaccuggcacuacgaugacgaaaauccuuauaagacaugggcuuaccacgggucuuaugaggugaaagccaccggaagcgcuuccagcaugaucaacggcgucgugaagcugcugacaaagcccugggauguugugccgauggucacccaaauggccaugacagacaccacgccuuucggccagcagcggguguuuaaagaaaagguugauaccagaacaccccgcccuaugcccgggacccggaaagugauggagaucacagcugaguggcucuggagaacccugggacgcaauaagaaaccucggcuuugcacgagagaagaguucacaaagaagguccgcaccaacgccgcgaugggcgccguguuuacagaagagaaucaaugggacuccgcuagagccgcugucgaagaugaggaguucuggaaacugguggaccgggaacgcgagcuccauaagcuggggaaauguggaucuugcguuuacaacaugaugggcaagagagagaagaaacuuggggaguuuggcaaagccaagggaagccgggccauuugguacauguggcugggcgcgagauaucucgaguucgaagcucugggguuucugaaugaggaucacugguucucccgggaaaacucuuacagcggaguggagggcgaagggcuccauaagcugggauauauccuucgcgacauuuccaaaauccccggcggggccauguacgccgaugacaccgcuggcugggacacgagaauuaccgaggaugaccugcacaaugaggaaaagaucacacagcagauggauccggagcaucggcagcucgccaacgcuaucuuuaaacugaccuaucaaaauaaggucgugaaagugcagcgcccuacacccaagggaaccguuauggacauuaucucuagaaaggaucagcggggcagcggacaggugggaacauacggccuuaacaccuucacgaauauggaagcccaacugguccgccagauggagggggaaggagugcucuccaaagcggaccuggagaacccccaucugcucgagaagaaaauuacacaguggcuggaaaccaagggcguugagagacuuaaacggauggccaucagcggggaugacugcguggucaagccuauugaugaccgcuuugcuaacgcccugcucgcucugaaugauaugggcaaggugagaaaagacaucccgcaguggcaacccucuaagggauggcacgauuggcagcaggucccuuucuguucccaucacuuccaugaacuuaucaugaaagacggccggaagcuggugguucccugccgcccucaggacgagcucauugggagagcccggaucagccaaggagcgggcuggucucugaaagaaaccgccugucuggggaaggcuuaugcccagauguggucccucauguacuuucaccgcagagaucugcggcuugcuagcaacgccauuugcucugcugugcccguccacuggaucccuacauccagaaccacauggagcauucaugcccaccaucaguggaugacgaccgaggacaugcugacaguguggaaucgcguuuggaucgaggauaaccccuggauggaagacaagaccccggugacaaccugggaggaugucccuuaccucggaaaacgggaagaccaaugguguggcucccugauugggcuuacgagcagagcgaccugggcccagaauauccugacagcuauccaacaggugcgcucucucauuggcgaugaggaguuccuggacuauaugcccagcaugaagcgguuuagaaaagaagaggaauccgagggagccaucugguga

SEQ ID NO: 20841 - RNA, 9873 nt, Artificial Sequence
  derived and/or modified CDS sequence (opt5) from DENV-3__EU660409__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacaaaccuggaugagcgccgagggcgcuuggcggcagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaaacccacgcucgacaucgagcugcagaagaccgaagcuacacgccuugccacccugagaaaacucuguauugagggaaagaucacaaacauuaccacggauucccggugcccuacacaaggcgaagcgauccugccggaggaacaggaccagaauuauguguguaaacacaccuacguggaucgcggcugggggaacggaugcggccuuuucgggaagggaagccuggucaccugcgccaaguuucagugucucgagcugauugagggcaaagugguucaauaugaaaaucugaaguacacagugaucaucaccguccacacaggggaccagcaucaggugggaaacgacacgcagggcgcuaccguugagauuacaccccaagccucuaccguggaagcuguccucccugaguauggcacacuggggcuugaaugcucccccagaaccggacuggauuucaaugagaugauccuccugacgaugaaaaacaaggccuggauggugcaccggcagugguuuuucgaccuuccucugcccuggaccagcggcgccacaaccgagacaccgaccuggaaucgcaaagaacuccuggucacguuuaagaacgcucaugcgaaaaagcaggaggugguugugcuggggucucaagaaggagccaugcacacagcucucaccggcgccacagagauucagaauuccgggggcaccagcaucuucgccggacaccugaaguguagacuuaaaauggauaagcuggaacucaaaggcaugucuuacgcuaugugccugaacaccuuuguccugaagaaagagguguccgagacacagcaugggacgauucuuaucaagguugaauacaagggagaggacgccccuuguaaaauccccuucagcaccgaagauggccaggggaaggcgcacaacggacggcucauuacagcuaauccuguggucaccaaaaaggaggagcccgugaacaucgaagccgagcccccuuucggcgaauccaauauugugaucgggauuggcgacaaagcccugaagaucaacugguauaagaaaggaucuagcaucggcaagauguuugaggcuacagccagaggggcucgccggauggccauucugggagauaccgcgugggacuucggcuccguugggggaguccucaauagccugggcaaaauggugcaucaaaucuuugggucugccuacacggcucuuuucuccggcgugagcuggauuaugaagaucggaauuggcguccugcucacauggaucgggcugaacucuaaaaauaccagcauguccuuuucuugcauugccaucggaaucauuacccuguaucuuggcgcugugguucaggccgauauggggugugugaucaacuggaagggaaaggaacucaaaugcggcagcgggauuuucgucacaaaugaggugcacaccuggacagagcaguacaaguuucaggcggacuccccgaaaagacuggccacggcuaucgccggcgcuugggaaaacggaguuuguggcauucgcagcaccacacggauggagaaucugcucuggaagcaaaucgccaacgaacugaauuauauccuuugggagaacaauauuaaacugaccguggucgugggggauaucauuggaguucucgaacagggcaagagaacacugaccccccagccuauggagcugaaauacucuuggaagacgugggggaaggccaaaaucgugaccgcugagacacagaacuccagcuucauuaucgacggacccaacaccccugaaugccccucugcgucccgcgccuggaaugucugggagguggaagacuauggcuuuggcguguucacaaccaacaucuggcuuaagcuccgggaggucuacacacaaagcugugaucauagacugauguccgcugccauuaaagacgaacgcgccguucacgcugauaugggguacuggaucgagucucagaagaauggaagcuggaaacuggagaaggccuccuuuauugaagugaagaccugcacguggccgaaaucucacacacucuggagcaacggcgugcuggaguccgacaugaucauuccuaagagccuugcggggcccaucucucagcauaaucaccggccuggauaucauacccagaccgcuggccccuggcaccuggggaaacucgaacuggauuucaacuacugcgagggaacaaccgucgugaucacggagaauuguggcacaagaggcccuucccugcgcaccacaaccguuagcgggaagcuuauucacgaauggugcugucggucuugcacacuccccccgcugagauauaugggagaggacggcuguugguacgggauggaaauccggccuauuaacgagaaagaagagaauauggugaagucccuggucagcgccggaucuggcaagguggauaacuuuaccaugggggcccucugccuggcuauccuuuucgaggaaguuaugcgcggaaaauucggcaagaaacauaugauugccggcgugcuguuuacguucguccuccugcugagcgggcaaaucaccuggagagacauggcgcacacacuuauuaugaucggauccaaugcuagcgaucggaugggcaugggggugaccuaucuggcccucaucgccacauuuaagauucagcccuuccuggcucucggauuuuuccugagaaaacuuaccucucgcgagaaccugcuccugggcguugggcuggccauggcuacgacacuucagcugcccgaagacaucgagcaaauggccaauggaauugcgcucggccugaugacccucaagcugaucacacaguuugaaaccuaccagcuuuggaccgcccuggugucccucacauguagcaacacgauuuucacccugacagucgcuuggcggaccgccacacugauccuugcuggcgugucccugcucccucugugccagucuagcuccaugagaaagaccgauuggcucccgauggccguggccgcuauggggguccccccucugccccuuuuuaucuucucucugaaagacacgccuaagcgcagaagcuggccccugaaugagggaguuauggcggugggccucguguccauucuggccucuagccuucugcggaacgaugucccuauggcugggccccucguggccggaggccugcucaucgccuguuauguuauuacagggaccuccgcugaccugaccguggagaaagucgccgacgugacaugggaagaggaagcggagcaaaccggaguuagccauaaccuuaugaucacaguggaugacgauggcacgaugcgcauuaaggacgaugaaaccgagaauauccugacaguccugcucaaaaccgcucugcuuaucgugucuggcauuuuuccguacuccaucccugccacacugcucgucuggcacaccuggcagaagcagacgcagagaagcggggugcugugggacguucccucuccucccgagacccaaaaagccgaacucgaggaaggaguguaccggauuaagcagcagggcaucuucgggaagacacaggucggagugggcguucaaaaagaggggguguuucauaccauguggcacgucacacgcggagcugugcugacccacaacggcaagagacuugagccgaauugggccuccgugaaaaaggaucugauuagcuauggcgggggauggcggcugucugcgcaguggcagaaaggcgaagagguucaagucaucgcuguggaaccugggaagaaccccaagaauuuccagacaaugccuggaauuuuccagacgaccacaggcgagaucggggccaucgcccucgacuuuaaacccggaaccuccggcagccccauuaucaaccgcgaaggcaagguggucgggcuguacggaaauggcgugguuaccaaaaacgggggauauguguccggcauugcucagacaaaugccgagccugaugggccgacgcccgagcuugaagaggaaauguucaagaaaagaaaccugaccaucauggaccuccauccuggcagcggaaagacacggaaguaccugcccgcuauuguccgcgaggccaucaaaagacggcucagaacccugauccuugcgccuacacgcgugguugccgcugaaauggaggaggcccugaagggccugcccauucgguaucaaaccacggcuacaaaaucugaacacaccgggagagagaucguggaucucaugugccaugccaccuuuacaaugcgccugcuuagcccuguccgggugccgaauuacaaccugauuaucauggacgaagcccacuucaccgaucccgcuuccauugcggccagaggauauaucucuacacgcguuggcaugggggaggcugccgccaucuuuaugaccgcuacgccucccggaacagccgaagcguucccucagagcaaugcucccauucaggacgaggagcgggacaucccggaaagauccuggaacucuggcaaugaguggauuaccgauuuuguggggaagacagucugguucgugccuagcaucaaagccggcaacgacauugccaacugucuccgcaagaauggaaagaaagugauccagcugucccggaagaccuuugauacggaauaccaaaaaaccagacugaacgacugggauuucgucguuacaaccgacauuucugagaugggcgcuaauuuuaaggccgaucgggugaucgacccccgcagaugccucaaacccgugauccuuacagaugggccugagcgggucauucuggcgggacccaugccugugaccgccgcuagcgccgcucagcgcagaggccggguugggagaaacccgcagaaggaaaaugaccaguacaucuucacaggacaaccccugaacaaugaugaggaccaugcccacuggaccgaagcuaagaugcuccuggacaacauuaauacgccugagggcaucauucccgcccuuuucgaaccugagcgcgagaaauccgcggccaucgauggggaauaucggcugaagggcgagagcagaaaaacauuuguggaacucaugcgccggggagaccugcccgucuggcuggcucacaagguggccucugagggcaucaaauacaccgauagaaaguggugcuucgacggggaacgcaacaaucagauucucgaggagaacauggauguugaaaucuggaccaaagagggagaacggaagaagcuuagaccgcgcuggcuggacgcuagaacauauuccgauccucuggcccucaaagaguuuaaggacuucgccgcuggccggaaaagcauugcgcuggaucuugugaccgaaaucgggcgcguccccucucaucuggccuacagaacacggaaugcucucgacaaccuggugaugcugcacacguccgagcauggaggccgcgccuauagacacgccgucgaggaacucccugagaccauggaaacacuucugcugcucggccugaugauucuucugaccgggggagcuaugcucuuucugaucagcggcaaggggaucggaaaaacauccauuggccugaucugugugaccguuucuagcgggaugcucuggauggccgaugugccccuucaguggauugcguccgccaucgugcuggaguucuuuaugaugguccugcucauuccugagcccgaaaagcagcggacgccgcaagacaaucagcuggcuuacguugugaucggaauucuuacccuggccgcuaucguggccgcgaacgagaugggccuccuggaaacaaccaagagagaucugggcaugagcaaagagccuggggucgugucucccacauccuaucucgacguugaccuucaccccgccagcgcuuggacccuguacgccguggcuacgacagucaucaccccuaugcugcgccauacaauugaaaauucuaccgccaacgugagccucgcugccaucgcgaaccaggccgucgugcugaugggacuugauaagggcuggccgauuuccaaaauggaccuggggguuccccuccuggcucugggaugcuacucucaagugaauccucucacccuuacagccgcuguccugcugcucgugacgcacuaugccaucauuggccccgggcugcaggccaaggcgacccgggaggcucagaaaagaacagccgcuggaaucaugaagaacccuaccguugauggcaucaugacaauugaccuugaucccgugaucuacgacagcaaguucgagaaacagcugggccaagucaugcuccuggugcugugugccgugcagcuccuucugaugcgcaccuccugggcccugugcgaagcucucacgcuggccacagggccuauuaccacccuuugggagggaucuccgggcaaguuuuggaauacaaccaucgcgguuagcauggccaacauuuuccggggguccuaucuggcuggagccggccucgcuuuuagcaucaugaaaucugucgggacaggaagacggggcacgggcucccagggggaaacccugggagagaaguggaaaaagaagcugaaucagcucagccgcaaagaauucgaucuuuacaagaaauccggcaucacagagguggacagaaccgaggccaaggaagggcugaaacggggagagacaacccaucacgcggugucucgcggcagcgccaagcugcaaugguuugucgaaagaaacaugguuauucccgaggggcgggugaucgaucucggauguggccgcggcgggugguccuauuacugcgcuggacugaaaaaggugacggaagucagaggcuauaccaaggggggaccuggccaugaggagcccgugccuaugucuacauacggguggaauauuguuaaacuuaugagcggaaaggacguguucuaccugcccccggaaaaaugugauacccuccugugcgacaucggcgaguccagcccuucucccacagucgaagagucccggaccauucgcgugcugaagaugguugagcccuggcucaaaaacaaucaguucuguaucaaggugcuuaacccuuauaugcccacagucauugaacaccuggagagacugcagcggaaguacggcgggaugcucgugagaaauccucugagccgcaacucuacccacgaaauguauuggaucuccaauggaacgggcaacaucgugagcucugucaauaugguuagccggcuucugcucaacagauuuacaaugacccaucgccggccgaccauugagaaagauguggaccugggggccggaacaagacacgugaacgcugaacccgagacgccuaauauggacgucaucggcgagcgcauuaagcggaucaaagaagagcauuccucuaccuggcacuacgaugacgaaaaccccuauaagacaugggccuaccacgggagcuaugaggugaaagcuaccggauccgccagcuccaugauuaauggcguugugaagcugcucacaaagccuugggaugucgugcccaugguuacccagauggcgaugacagacaccacgccguucggccaacagagaguguuuaaagaaaaggucgauacccgcacaccucggcccaugccugggaccagaaaagugauggagaucacagccgaguggcuguggcgcacccuuggacggaacaagaaacccagacugugcacgcgcgaagaguucacaaagaagguuagaaccaaugcugccaugggcgcuguguuuacagaagagaaccagugggacucugcccgggccgcggucgaagaugaggaguucuggaaacucguggaccgcgaaagagagcugcauaagcuugggaaauguggaagcugcgucuacaauaugaugggcaagcgggaaaaaaagcugggggaguuuggcaaagcuaagggauccagagccaucugguacauguggcucggcgcccgguaucuggaguucgaagcucugggguuucucaacgaggaucacugguucucucgcgaaaauagcuacuccggaguggagggcgaagggcugcauaagcuuggauauauucugagagacaucucuaaaauuccuggcggggccauguacgcugaugacaccgccggcugggacacgcggaucaccgaggaugaccuccacaacgaggaaaagauuacacaacagauggaucccgagcaucgccagcuggcgaaugccaucuuuaaacuuaccuaucagaacaagguugugaaaguccaaagaccgacaccuaagggaaccgugauggacaucauuagccggaaggaucagcgcggcuccgggcaggugggaacauacggccugaauaccuucacgaacauggaagcucagcucguuagacaaauggagggggaaggagugcugagcaaagccgaccuggagaauccccaccuccuggagaagaaaaucacacaguggcuugaaaccaagggcgucgagcggcugaaacgcauggcuauuucuggggaugacugcgugguuaagcccaucgaugacagauuugccaacgcgcuccuggcccuuaacgauaugggcaaggugcggaaagacauuccucaguggcagccguccaagggauggcacgauuggcaacagguccccuucuguagccaucacuuccaugaacugaucaugaaagacggccgcaagcucguggucccuugcagaccccaggacgagcugaucgggcgggcucgcauuucucagggagccggcuggucccugaaagaaaccgcuugucucgggaaggccuaugcucaaauguggagccugauguacuuucacagacgggaucuuagacuggccucuaaugcgaucugcuccgccgugccuguucacuggauucccacaagccgcaccacaugguccauccaugcucaccaucaguggaugacgaccgaggacaugcucacaguguggaaccgggucuggauugaggauaauccuuggauggaagacaagacccccgugacaaccugggaggauguuccguaccugggaaaaagagaagaccagugguguggcagccuuaucgggcugacgucucgcgccaccugggcccaaaacauucucacagcuauccagcaggugcggagccugaucggcgaugaggaguuccuggacuauaugccuuccaugaagagauuucgcaaagaagaggaaucugagggagccauuugguga

SEQ ID NO: 20842 - RNA, 9873 nt, Artificial Sequence
  derived and/or modified CDS sequence (opt5) from DENV-3__EU660410__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacaaaccuggaugagcgccgagggcgcuuggcggcagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggcccgcaauaagcccacgcucgacaucgagcugcagaaaaccgaagcuacacaacuugccacccugagaaagcucuguauugagggaaaaaucacaaacauuaccacggauucccggugcccuacacagggcgaagcgauccugccggaggaacaggaccagaauuauguguguaagcacaccuacguggaucgcggcugggggaacggaugcggccuuuucgggaaaggaagccuggucaccugcgccaaguuucaaugucucgagcccauugagggcaaggugguucaguaugaaaaucugaaauacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccuagaaccggacuugauuucaaugagaugauccugcucacgaugaagaacaaagcuuggaugguccaccggcagugguuuuucgaccugccccuuccguggaccagcggcgccacaaccgagacaccuaccuggaaucgcaaggaacugcucgugacguuuaaaaacgcccaugcuaagaaacaagagguugugguccuggggucucaggaaggagcgaugcacacagcccugaccggcgcuacagagauucagaauuccgggggcaccagcaucuucgccggacaccucaaguguagacugaagauggauaaacuugaacugaagggcaugucuuacgccaugugccucaacaccuuugugcugaaaaaggagguuuccgagacacagcaugggacgauucugaucaaaguggaauacaagggagaggacgcucccuguaagaucccuuucagcaccgaagauggccaagggaaagcccacaacggacggcuuauuacagcgaaucccgucgugaccaagaaagaggagcccgugaacaucgaagcugagccuccguucggcgaauccaauauuguuaucgggauuggcgacaaggcccucaaaaucaacugguauaagaagggaucuagcaucggcaaaauguuugaggccacagcuagaggggcccgccggauggcuauucugggagauaccgccugggacuucggcuccgucgggggagugcugaauagccucggcaagauggugcaucagaucuuugggucugcguacacggcccuguucuccggcgucagcuggauuaugaaaaucggaauuggcgugcuucugacauggaucgggcucaacucuaagaauaccagcauguccuuuucuugcauuguuaucggaaucauuacccuguaucugggcgcugugguccaggccgauauggggugugcuaucaacuggaaaggaaaggaacuuaagugcggcagcgggauuuucgugacaaaugagguucacaccuggacagagcaguacaaauuucaagccgacucccccaagagacucgcgacggccaucgcuggcgccugggaaaacggaguguguggcauucgcagcaccacacggauggagaaucugcuguggaaacagaucgcuaacgaacucaauuauauccugugggagaacaauauuaagcuuaccgucgugguuggggauaucauuggagugcuggaacagggcaaaagaacacucaccccucagcccauggagcugaaguacucuuggaaaacgugggggaaggccaagaucgucaccgccgagacacaaaacuccagcuucauuaucgacggaccuaacacccccgaaugcccgucugcuucccgcgcguggaaugugugggagguggaagacuauggcuuuggcgucuucacaaccaacaucuggcugaaacuucgggagguuuacacacagagcugugaucauagacucauguccgccgcuauuaaggacgaacgcgccgugcacgccgauaugggguacuggaucgagucucagaaaaauggaagcuggaagcuggagaaagcuuccuuuauugaagugaagaccugcacguggccuaagucucacacacuguggagcaacggcguccucgaguccgacaugaucauucccaaaagccuggccgggccuaucucucagcauaaucaccggcccggauaucauacccaaaccgcgggcccuuggcaccuugggaagcuggaacucgauuucaacuacugcgagggaacaaccgugguuaucacggagaauuguggcacaagaggccccucccugcgcaccacaaccgugagcgggaaacugauucacgaauggugcugucggucuugcacacuuccgccucucagauauaugggagaggacggcuguugguacgggauggaaauccggcccauuaacgagaaggaagagaauauggucaaaucccuggugagcgcuggaucuggcaagguugauaacuuuaccaugggggugcugugccucgccauccuguucgaggaagucaugcgcggaaaguucggcaaaaagcauaugauugccggcgugcuuuuuacguucguucugcuccugagcgggcagaucaccuggagagacauggcucacacauuuauuaugaucggauccaaugccagcgaucggaugggcaugggggugaccuaucuggcgcuuaucgcuacauucaaaauucagcccuuucuggcccucggauucuuucugagaaagcucaccucucgcgagaaccugcuucugggcgucgggcucgccauggcuacgacacugcaacugccugaagacaucgagcagauggccaauggaauugcucuuggccugaugacccucaaacugaucacacaguucgaaaccuaccagcucuggaccgcccuggugucccuuacauguagcaacacgauuuuuacccugacaguggcguggcggaccgccacacucguccuggcuggcguuucccugcuuccgcugugccaaucuagcuccaugagaaagaccgauuggcuccccaugacgguggccgcuaugggggugccuccccugccucucuucaucuuuucucugaaggacacacccaaacgcagaagcuggccucuuaaugagggagucauggccgugggccugguuuccauccuggccucuagccuccugcggaacgaugugcccauggcugggccgcuugucgcgggaggccugcucauugccuguuaugugaucaccgggaccuccgcugaccugacaguugagaaggccgccgacgugaccugggaagaggaagcugagcagacaggagucagccauaaccucaugauuacgguggaugacgauggcaccaugcgcaucaaagacgaugaaacagagaauauucugaccguccuucugaagacagcccugcucaucgugucuggcaucuucccuuacuccauucccgcgacccugcuuguuuggcacacguggcagaaacagacccaaagaagcggggugcugugggacgucccuucucccccggagacacagaaggcugaacucgaggaaggaguguaccggaucaaacagcagggcauuuuugggaagacccaaguuggagugggcguccagaaggaggggguguuccauacaauguggcacgugacccgcggagccguucugacacacaacggcaaaagacucgagccuaauugggccuccgucaagaaagaucugaucagcuauggcgggggauggcggcuuucugcucaguggcaaaagggcgaagaggugcaggugauugccgucgaacccgggaaaaacccuaagaauuuccagacgaugcccggaaucuuucagaccacaaccggcgagauuggggcgaucgcucuggacuucaagcccggaaccuccggcagcccuaucauuaaccgcgaaggcaaagugguugggcuguacggaaauggcguggucacaaagaacgggggauauguguccggcaucgcccaaacgaaugccgagccggaugggcccaccccugagcucgaagaggaaauguuuaaaaagagaaaccugacaauuauggaccuucaucccggcagcggaaaaacccggaaguaccugccugcuaucguucgcgaggccauuaagagacggcucagaacacugauccucgcucccacccgcguggucgccgcggaaauggaggaggcccugaaaggccuuccuauccgguaucagacgacagcuaccaagucugaacacaccgggagagagauuguggaucugaugugccaugccacauucaccaugcgccugcucagcccgguucgggugcccaauuacaaccugaucauuauggacgaagcucacuuuacagauccugccuccaucgccgcuagaggauauauuucuacccgcgucggcaugggggaggcggccgcuaucuucaugacggccacacccccuggaaccgccgaagcuuuuccccagagcaaugccccgauccaggacgaggagcgggacauuccugaaagauccuggaacucuggcaaugaguggaucacagauuucguggggaaaaccgugugguuuguccccagcauuaaggcgggcaacgacaucgcuaacugucuucgcaaaaauggaaagaagguuauucaacugucccggaaaacguucgauaccgaauaccagaagacaagacucaacgacugggauuuuguggugaccacagacaucucugagaugggcgccaauuucaaagccgaucgggucauugacccccgcagaugccugaagccugugauccugaccgaugggcccgagcggguuauccucgcuggaccuaugccggugacagccgcgagcgccgcucagcgcagaggccgggucgggagaaacccccagaaagaaaaugaccaauacauuuucaccggacagccucuuaacaaugaugaggaccaugcccacuggacggaagcuaagaugcugcuggacaacaucaauacacccgagggcauuaucccugcccucuuugaacccgagcgcgagaaguccgcugccauugauggggaauaucggcugaaaggcgagagcagaaagaccuucguggaacuuaugcgccggggagaccugccgguuuggcucgcgcacaaaguggccucugagggcaucaaguacaccgauagaaaauggugcuuugacggggaacgcaacaaucagauccuggaggagaacauggaugucgaaauuuggacaaaggagggagaacggaaaaagcugagaccucgcuggcucgacgcuagaaccuauuccgauccccuugcccugaaggaguucaaagacuuugcugccggccggaagagcaucgcccuggaucucgugacagaaauugggcgcgucccuucucaucuggcuuacagaacgcggaaugcgcuugacaaccuggugaugcuccacaccuccgagcauggaggccgcgccuauagacacgcuguugaggaacugcccgagacaauggaaacccugcuccuucugggccugaugauccuccugacagggggagccaugcuuuuccugauuagcggcaaagggaucggaaagaccuccaucggccucauuugugugaucgugucuagcgggaugcuguggauggccgaugucccucugcaguggauugcuuccgccaucguucucgaguuuuucaugauggugcuucugauucccgagccggaaaaacaacggacgccucaggacaaucagcuggcguacguggucaucggaauucucacccuggccgcuaucguggccgcuaacgagaugggccuucuggaaacaaccaagagagaucucggcaugagcaaggagcccgggguugugucucccacauccuaucuggacgucgaccugcacccugccagcgcguggacccucuacgccguggcuacgacagucaucaccccgaugcuucgccauacaauugaaaauucuaccgccaacgugagccuggcugccaucgcuaaccaagccguugugcugaugggacucgauaaaggcuggcccauuuccaagauggaccugggggcgccucuucuggcccucggaugcuacucucaggucaauccccugacccugacagcugccgugcuccuucugguuacgcacuaugcuaucauuggcccugggcugcaggccaaagccacccgggaggcgcagaagagaacagcugccggaaucaugaaaaaccccaccguggauggcaucaugacaauugaccucgauccugucaucuacgacagcaaguuugagaagcaacugggccaggugaugcuucuggugcucugugcuguucagcugcugcucaugcgcaccuccugggcccuuugcgaagcccugacgcuggcuacagggccgauuaccacccucugggagggaucucccggcaaauucuggaauacaaccaucgccgucagcauggcgaacauuuuucggggguccuaucuggccggagcuggccuugccuucagcaucaugaagucuguggggacaggaagacggggcacgggcucccagggggaaacccugggagagaaauggaagaaaaagcucaaucaacugagccgcaaggaauuugaucuguacaaaaaguccggcaucacagagguggacagaaccgaggcuaaagaagggcucaagcggggagagacaacccaucacgccgucucucgcggcagcgcgaaacuucagugguucguugaaagaaacauggugauuccugaggggcgggugaucgaucugggauguggccgcggcgggugguccuauuacugcgccggacugaagaaagucacggaagugagaggcuauaccaaggggggacccggccaugaggagccuguucccaugucuacauacggguggaauauugugaagcucaugagcggaaaagacgucuucuaccugccgccugaaaagugugauacccuucugugcgacaucggcgaguccagccccucucccacaguggaagagucccggaccauucgcguucucaaaaugguggagccuuggcugaagaacaaucaguuuuguaucaaaguccugaaccccuauaugccuacagugauugaacaccucgagagacuucagcggaaguacggcgggaugcuggugagaaauccgcugagccgcaacucuacccacgaaauguauuggaucuccaauggaacgggcaacaucgucagcucuguuaauauggugagccggcuccugcuuaacagauucacaaugacccaucgccggcccaccauugagaaggauguggaccugggggcuggaacaagacacgucaacgccgaaccugagacgcccaauauggacgugaucggcgagcgcauuaaacggaucaaggaagagcauuccucuaccuggcacuacgaugacgaaaacccuuauaaaacaugggcuuaccacgggagcuaugagguuaaggccaccggauccgcuagcuccaugauuaauggcguggucaaacuccugacaaagcccugggaugugguuccgauggugacccaaauggccaugacagacaccacgccuuuuggccagcagagagucuucaaggaaaaaguggauacccgcacaccccggccuaugcccgggaccagaaagguuauggagaucacagcggaguggcuguggcgcacccucggacggaacaaaaagccuagacugugcacgcgcgaagaguuuacaaaaaaggugagaaccaaugccgcuaugggcgccgucuucacagaagagaaccaaugggacucugcucgggccgccguggaagaugaggaguuuuggaagcuugucgaccgcgaaagagagcugcauaaacucgggaaguguggaagcugcguguacaauaugaugggcaaacgggaaaagaaacugggggaguucggcaaggcgaaaggauccagagcuaucugguacauguggcuuggcgcccgguaucuggaguuugaagcccucggguuccugaacgaggaucacugguuuucucgcgaaaauagcuacuccggaguugagggcgaagggcugcauaagcucggauauauucugagagacaucucuaagauucccggcggggcuauguacgccgaugacaccgcuggcugggacacgcggaucaccgaggaugaccuucacaacgaggaaaaaauuacacagcagauggauccggagcaucgccagcuggccaaugcgaucuucaagcucaccuaucaaaacaaaguggucaaggugcagagaccuacacccaaaggaaccgugauggacaucauuagccggaaggaucagcgcggcuccgggcagguuggaacauacggccugaauaccuuuacgaacauggaagcccaacuugugagacagauggagggggaaggaguccugagcaaggcugaccucgagaauccccaccugcuggagaaaaagaucacacaguggcucgaaaccaaaggcguggagcggcugaagcgcauggccauuucuggggaugacugcguugugaaaccuaucgaugacagauucgcuaacgcccuucuggcgcucaacgauaugggcaagguccggaaggacauuccgcaguggcaacccuccaaaggauggcacgauuggcagcaggugccuuucuguagccaucacuuucaugaacugaucaugaaggacggccgcaaacuugucgugcccugcagaccucaggacgagcugaucgggcgggcccgcauuucucaaggagcuggcuggucccucaaggaaaccgccugucuggggaaagcuuaugcccagauguggagccugauguacuuccacagacgggaucucagacuggcuucuaaugccaucugcuccgcgguucccgugcacuggauuccuaucagccgcacaaccugguccauucaugcccaccaucaguggaugacaacggaggacaugcuuaccgucuggaaccggguguggaucgaggauaaucccuggauggaagacaagacaccgguuaccacaugggaggaugugccuuaccugggaaagagagaagaccaaugguguggcagccucauugggcugaccucucgcgcuacgugggcccagaacauccuuaccgccauccagcagguccggagccugauuggcgaugaggaguuucucgacuauaugcccuccaugaaaagauuccgcaaggaagaggaaucugagggagcuaucugguga

SEQ ID NO: 20843 - RNA, 9873 nt, Artificial Sequence
  derived and/or modified CDS sequence (opt5) from DENV-3__EU660411__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacaaaccuggaugagcgccgagggcgcuuggcggcagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaaacccacgcucgacaucgagcugcagaagaccgaagcuacacaacuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggucaccugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccucgcaccggacuugauuucaaugagaugauccugcucacgaugaaaaacaaggcuuggaugguccacagacagugguuuuucgaccugccccuuccguggaccagcggcgccacaaccgagacaccuaccuggaaucggaaagaacugcucgugacguuuaagaacgcccaugcuaaaaagcaagagguugugguccuggggucucaggaaggagcgaugcacacagcccugaccggcgcuacagagauucagaauuccgggggcaccagcaucuucgccggacaccucaagugucgccugaaaauggauaagcuugaacugaaaggcaugucuuacgccaugugccucaacaccuuugugcugaagaaagagguuuccgagacacagcaugggacgauucugaucaagguggaauacaagggagaggacgcucccuguaaaaucccuuucagcaccgaagauggccaagggaaggcccacaacggaagacuuauuacagcgaaucccgucgugaccaaaaaggaggagcccgugaacaucgaagcugagccuccguucggcgaauccaauauuguuaucgggauuggcgacaaagcccucaagaucaacugguauaagaaaggaucuagcaucggcaagauguuugaggccacagcucggggggccagacgcauggcuauucugggagauaccgccugggacuucggcuccgucgggggagugcugaauagccucggcaaaauggugcaucagaucuuugggucugcguacacggcccuguucuccggcgucagcuggauuaugaagaucggaauuggcgugcuucugacauggaucgggcucaacucuaaaaauaccagcauguccuuuucuugcauuguuaucggaaucauuacccuguaucugggcgcugugguccaggccgauauggggugugugaucaacuggaagggaaaggaacuuaaaugcggcagcgggauuuucguuacaaaugaggugcacaccuggacagagcaguacaaguuucaagcugacucccccaaacggcucgccacggcgaucgccggcgcuugggaaaacggagucuguggcauuagaagcaccacacgcauggagaaucugcuguggaagcagaucgccaacgaacucaauuauauccugugggagaacaauauuaaacuuaccgugguugugggggauaucauuggaguccuggaacagggcaagcggacacucaccccucagcccauggagcugaaauacucuuggaagacgugggggaaggcuaaaaucgugaccgccgagacacaaaacuccagcuucauuaucgacggaccuaacacccccgaaugcccgucugccuccagagcuuggaaugugugggaggucgaagacuauggcuuuggcguuuucacaaccaacaucuggcugaagcuucgcgagguguacacacagagcugugaucaucggcucauguccgcggccauuaaagacgaaagagcugugcacgccgauaugggguacuggaucgagucucagaagaauggaagcuggaaacuggagaaggccuccuuuauugaagucaagaccugcacguggccuaaaucucacacacuguggagcaacggcgugcucgaguccgacaugaucauucccaagagccuggcugggccuaucucucagcauaaucaccgccccggauaucauacccaaaccgccggcccuuggcaccuugggaaacuggaacucgauuucaacuacugcgagggaacaaccguugugaucacggagaauuguggcacacggggccccucccugagaaccacaaccgucagcgggaagcugauucacgaauggugcugucgcucuugcacacuuccgccucuccgguauaugggagaggacggcuguugguacgggauggaaaucagacccauuaacgagaaagaagagaauauggugaagucccugguuagcgcgggaucuggcaagguggauaacuuuaccauggggguccugugccucgcuauccuguucgaggaagugaugcggggaaaauucggcaagaaacauaugauugccggcguucuuuuuacguucgugcugcuccugagcgggcagaucaccuggcgcgacauggcccacacacugauuaugaucggauccaaugcuagcgauagaaugggcaugggggucaccuaucuugcccugaucgcgacauuuaagauucagcccuuccucgcucugggauuuuuccuccggaaacugaccucuagagagaaccuucugcucggcguggggcuggccauggccacgacacugcaacuuccugaagacaucgagcagauggcuaauggaauugcccugggccucaugacccugaagcucaucacacaguuugaaaccuaccagcuguggaccgcucuugugucccugacauguagcaacacgauuuucacccucacagucgccuggcgcaccgcgacacugauccuggccggcguuucccuucugccgcucugccaaucuagcuccaugcggaagaccgauuggcugcccaugacgguggcugccaugggggugccuccccucccucuguuuaucuucucucuuaaagacacacccaagagacgcagcuggccucugaaugagggagucauggcugugggccugguuuccauucucgccucuagccugcuuagaaacgaugugcccauggccgggccgcuggucgcuggaggccuccugaucgcguguuaugugauuaccgggaccuccgccgaccucacaguugagaaagcugccgacgugaccugggaagaggaagccgagcagacaggagucagccauaaccugaugaucacgguggaugacgauggcaccaugcggauuaaggacgaugaaacagagaauauccuuaccguccugcugaaaacagcucuccugaucgugucuggcauuuuuccuuacuccauccccgccacccuucugguuuggcacacguggcagaagcagacccaacgcagcggggugcucugggacgucccuucucccccggagacacagaaagcggaacuggaggaaggaguguacagaauuaagcagcagggcaucuucgggaagacccaaguuggagugggcguccagaaagaggggguguuucauacaauguggcacgugacccggggagcuguucucacacacaacggcaagcgccuggagccuaauugggccuccgucaaaaaggaucuuauuagcuauggcgggggauggagacugucugcccaguggcaaaaaggcgaagaggugcaggugaucgcugucgaacccgggaagaacccuaagaauuuccagacgaugcccggaauuuuccagaccacaaccggcgagaucggggccaucgcgcuggacuuuaaacccggaaccuccggcagcccuauuaucaaccgggaaggcaagauuguggggcucuacggaaauggcguugugacaaaaaacgggggauaugucuccggcaucgcucaaacgaaugccgagccggaugggcccaccccugagcuggaagaggaaauguucaagaaacgcaaccuuacaauuauggaccugcaucccggcagcggaaagaccagaaaguaccucccugccaucgugcgggaggcuaucaaacgcagacugcggacacucauucuggcccccaccagaguuguggcugccgaaauggaggaggcgcuuaagggccugccuauccgcuaucagacgacagccauuaaaucugaacacaccgggcgggagaucgucgaucugaugugccaugcuaccuuuacaaugagacuccugagcccggugcgcguucccaauuacaaccuuauuaucauggacgaagcccacuucaccgauccugcuuccaucgccgcccggggauauauuucuacaagagugggcaugggggaggcugcggccaucuuuaugaccgcuacgcccccuggaacagccgaagccuucccccagagcaaugcuccgauucaggacgaggagcgcgacaucccugaacgguccuggaacucuggcaaugaguggauuaccgauuuugucgggaagacagugugguucgugcccagcaucaaagccggcaacgacauugcgaacugucugagaaagaauggaaagaaagucauccaacucucccgcaagaccuuugauacggaauaccagaaaacccggcugaacgacugggauuucguugugacaaccgacaucucugagaugggcgcuaauuuuaaggccgauagagugauugacccccggcgcugccugaaaccugucauccucacagaugggcccgagagagugauucuugccggaccuaugccgguuaccgcugccagcgcggcccagcggcgcggcagaguggggcggaacccccagaaggaaaaugaccaauacaucuucacaggacagccucugaacaaugaugaggaccaugcucacuggaccgaagccaagaugcugcucgacaacauuaauacgcccgagggcaucaucccugcucuguucgaacccgagagagagaaauccgccgcuauugauggggaauaucgccuuaagggcgagagccggaaaacauuugucgaacugaugagacgcggagaccucccgguguggcuggcccacaagguugcgucugagggcaucaaauacaccgaucggaaguggugcuucgacggggaaagaaacaaucagauucuggaggagaacauggauguggaaaucuggaccaaagagggagaacgcaagaagcuccggccuagauggcuugacgcccgcacauauuccgauccccuggcucugaaagaguuuaaggacuucgccgcuggcagaaaaagcauugcccucgaucuggucaccgaaaucgggcgggugccuucucaucuugccuaccgcacaagaaaugcucuggacaaccucgucaugcugcacacguccgagcauggaggccgggcguaucgccacgccguggaggaacugcccgagaccauggaaacacuccuucugcugggccucaugauccugcuuaccgggggagcuaugcuguuucucauuagcggcaaggggaucggaaaaacauccauuggccugaucuguguuauugugucuagcgggaugcuguggauggccgaugugccucuccaguggaucgccuccgcuauuguccuugaguucuuuaugaugguucugcugauccccgagccggaaaagcaaagaaccccucaggacaaucagcucgccuacguggugaucggaauucugacgcuugcggccaucgucgcugccaacgagaugggccugcucgaaaccacaaagcgggaucugggcaugagcaaagagcccggggugguuucucccaccuccuaucuggacguggaccuccacccugcuagcgccuggacacuuuacgcggucgccaccacggugauuacaccgaugcugagacauaccaucgaaaauucuacagcuaacgucagccuggccgcuauugccaaccaagcugugguucucaugggacuggauaagggcuggcccaucuccaaaauggaccuuggggugccucugcucgcccugggaugcuacucucaggucaauccccugacccucaccgcggccgugcuucugcugguuacacacuaugcuaucauuggcccugggcuccaggccaaggcuacgcgcgaggcccagaaacggaccgccgcgggaaucaugaagaaccccacaguggauggcauuaugaccaucgaccuggauccugucauuuacgacagcaaguucgagaaacaacuuggccaggugaugcugcucgugcugugugcuguucagcugcuccuuaugagaacauccugggcccugugcgaagcucugacccucgccacggggccgaucacaacccugugggagggaucucccggcaaguuuuggaauaccacaaucgccgucagcauggcuaacauuuuccgcggguccuaucuugccggagcgggccuggccuuuagcaucaugaaaucuguggggaccggacggagaggcacaggcucccagggggaaacgcucggagagaaguggaaaaagaagcugaaucaacugagccggaaagaauucgaucucuacaagaaauccggcauuaccgagguggaccgcacagaggcuaaggaagggcuuaaaagaggagagaccacacaucacgccgucucucggggcagcgcuaagcugcagugguuuguugaacgcaacauggugaucccugaggggagagugauugaucugggauguggccggggcgggugguccuauuacugcgccggacucaaaaaggucaccgaagugcgcggcuauacgaaggggggacccggccaugaggagccuguucccaugucuaccuacggguggaauaucgugaaacugaugagcggaaaggacgucuucuaccuuccgccugaaaaaugugauacacugcucugcgacauuggcgaguccagccccucucccaccguggaagaguccagaacaauccggguucugaagaugguggagccuuggcugaaaaacaaucaguucuguaucaagguccucaaccccuauaugccuaccgugauugaacaccuugagcgccugcagagaaaguacggcgggaugcuggugcggaauccgcucagcagaaacucuacacacgaaauguauuggaucuccaauggaaccggcaacauugucagcucuguuaauauggugagccgccugcuucugaaccgguuuacgaugacacauagacgccccaccaucgagaaagauguggaccucggggcgggaacccggcacgucaacgccgaaccugagacacccaauauggacgugauuggcgagagaaucaagcgcaucaaagaagagcauuccucuacguggcacuacgaugacgaaaacccuuauaagaccugggcuuaccacgggagcuaugagguuaaagccacaggauccgcuagcuccaugauuaauggcguggucaagcugcugaccaagcccugggaugugguuccgauggugacacaaauggccaugaccgacacaaccccuuucggccagcagcgggucuuuaaagaaaagguggauacgagaaccccccgcccuaugcccgggacacggaaaguuauggagaucaccgcugaguggcucuggagaacacugggacgcaacaagaaaccucggcuuugcaccagagaagaguucacgaagaaggugcgcacaaaugccgcgaugggcgccgucuuuaccgaagagaaccaaugggacucugcuagagccgcuguggaagaugaggaguucuggaaacuggucgaccgggaacgcgagcuccauaagcuggggaaauguggaagcugcguguacaauaugaugggcaagagagaaaaaaagcuuggggaguuuggcaaagccaagggaucccgggccauuugguacauguggcugggcgcgagauaucucgaguucgaagcucugggguuucugaacgaggaucacugguucucucgggaaaauagcuacuccggaguugagggcgaagggcuccauaagcugggauauauccuucgcgacauuucuaaaauccccggcggggccauguacgccgaugacacagcuggcugggacaccagaaucacggaggaugaccugcacaacgaggaaaagauuacccagcagauggauccggagcaucggcagcucgccaaugcuaucuuuaaacugacauaucaaaacaagguggucaaagugcagcgcccuacccccaagggaacagugauggacauuaucagcagaaaggaucagcggggcuccgggcagguuggaaccuacggccuuaauacauucaccaacauggaagcccaacuggugcgccagauggagggggaaggaguccucagcaaagcggaccuggagaauccccaccugcucgagaagaaaauuacgcaguggcuggaaacaaagggcguggagagacuuaaacggauggccaucucuggggaugacugcguugugaagccuaucgaugaccgcuuugcuaacgcccugcucgcucugaacgauaugggcaaggucagaaaagacauuccgcaguggcaacccuccaagggauggcacgauuggcagcaggugccuuucuguagccaucacuuccaugaacuuaucaugaaagacggccggaagcuggucgugcccugccgcccucaggacgagcucauugggagagcccggaucucucaaggagcgggcuggucccugaaagaaaccgccugucuggggaaggcuuaugcccagauguggagccucauguacuuucaccgcagagaucugcggcuugcuucuaaugccauuugcuccgcuguucccgugcacuggaucccuaccagcagaacaaccugguccauucaugcccaccaucaguggaugacaacggaggacaugcugaccgucuggaaccgcguguggaucgaggauaaucccuggauggaagacaagacaccgguuaccacaugggaggaugugccuuaccucggaaaacgggaagaccaaugguguggcagccugaucgggcuuaccucuagagcgacgugggcccagaacauucugaccgcuauccagcagguccgcagccucauuggcgaugaggaguuccuggacuauaugcccuccaugaagcgguuuagaaaagaagaggaaucugagggagccaucugguga

SEQ ID NO: 20844 - RNA, 9873 nt, Artificial Sequence
  derived and/or modified CDS sequence (opt5) from DENV-3__FJ432722__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacaaaccuggaugagcgccgagggcgcuuggcggcagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaaacccacgcucgacaucgagcugcagaagaccgaagcuacacaacuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggucaccugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccucgcaccggacuugauuucaaugagaugauccugcucacgaugaaaaacaaggcuuggaugguccacagacagugguuuuucgaccugccccuuccguggaccagcggcgccacaaccgagacaccuaccuggaaucggaaagaacugcucgugacguuuaagaacgcccaugcuaaaaagcaagagguugugguccuggggucucaggaaggagcgaugcacacagcccugaccggcgcuacagagauucagaauuccgggggcaccagcaucuucgccggacaccucaagugucgccugaaaauggauaagcuugaacugaaaggcaugucuuacgccaugugccucaacaccuuugugcugaagaaagagguuuccgagacacagcaugggacgauucugaucaagguggaauacaagggagaggacgcucccuguaaaaucccuuucagcaccgaagauggccaagggaaggcccacaacggaagacuuauuacagcgaaucccgucgugaccaaaaaggaggagcccgugaacaucgaagcugagccuccguucggcgaauccaauauuguuaucgggauuggcgacaaagcccucaagaucaacugguauaagaaaggaucuagcaucggcaagauguuugaggccacagcucggggggccagacgcauggcuauucugggagauaccgccugggacuucggcuccgucgggggagugcugaauagccucggcaaaauggugcaucagaucuuugggucugcguacacggcccuguucuccggcgucagcuggauuaugaagaucggaauuggcgugcuucugacauggaucgggcucaacucuaaaaauaccagcauguccuuuucuugcauuguuaucggaaucauuacccuguaucugggcgcugugguccaggccgauauggggugugugaucaacuggaagggaaaggaacuuaaaugcggcagcgggauuuucguuacaaaugaggugcacaccuggacagagcaguacaaguuucaagcugacucccccaaacggcucgccacggcgaucgccggcgcuugggaaaacggagucuguggcauuagaagcaccacacgcauggagaaucugcuguggaagcagaucgccaacgaacucaauuauauccugugggagaacaauauuaaacuuaccgugguugugggggauaucauuggaguccuggaacagggcaagcggacacucaccccucagcccauggagcugaaauacucuuggaagacgugggggaaggcuaaaaucgugaccgccgagacacaaaacuccagcuucauuaucgacggaccuaacacccccgaaugcccgucugccuccagagcuuggaaugugugggaggucgaagacuauggcuuuggcguuuucacaaccaacaucuggcugaagcuucgcgagguguacacacagagcugugaucaucggcucauguccgcggccauuaaagacgaaagagcugugcacgccgauaugggguacuggaucgagucucagaagaauggaagcuggaaacuggagaaggccuccuuuauugaagucaagaccugcacguggccuaaaucucacacacuguggagcaacggcgugcucgaguccgacaugaucauucccaagagccuggcugggccuaucucucagcauaaucaccgccccggauaucauacccaaaccgccggcccuuggcaccuugggaaacuggaacucgauuucaacuacugcgagggaacaaccguugugaucacggagaauuguggcacacggggccccucccugagaaccacaaccgucagcgggaagcugauucacgaauggugcugucgcucuugcacacuuccgccucuccgguauaugggagaggacggcuguugguacgggauggaaaucagacccauuaacgagaaagaagagaauauggugaagucccugguuagcgcgggaucuggcaagguggauaacuuuaccauggggguccugugccucgcuauccuguucgaggaagugaugcggggaaaauucggcaagaaacauaugauugccggcguucuuuuuacguucgugcugcuccugagcgggcagaucaccuggcgcgacauggcccacacacugauuaugaucggauccaaugcuagcgauagaaugggcaugggggucaccuaucuugcccugaucgcgacauuuaagauucagcccuuccucgcucugggauuuuuccuccggaaacugaccucuagagagaaccuucugcucggcguggggcuggccauggccacgacacugcaacuuccugaagacaucgagcagauggcuaauggaauugcccugggccucaugacccugaagcucaucacacaguuugaaaccuaccagcuguggaccgcucuugugucccugacauguagcaacacgauuuucacccucacagucgccuggcgcaccgcgacacugauccuggccggcguuucccuucugccgcucugccaaucuagcuccaugcggaagaccgauuggcugcccaugacgguggcugccaugggggugccuccccucccucuguuuaucuucucucuuaaagacacacccaagagacgcagcuggccucugaaugagggagucauggcugugggccugguuuccauucucgccucuagccugcuuagaaacgaugugcccauggccgggccgcuggucgcuggaggccuccugaucgcguguuaugugauuaccgggaccuccgccgaccucacaguugagaaagcugccgacgugaccugggaagaggaagccgagcagacaggagucagccauaaccugaugaucacgguggaugacgauggcaccaugcggauuaaggacgaugaaacagagaauauccuuaccguccugcugaaaacagcucuccugaucgugucuggcauuuuuccuuacuccauccccgccacccuucugguuuggcacacguggcagaagcagacccaacgcagcggggugcucugggacgucccuucucccccggagacacagaaagcggaacuggaggaaggaguguacagaauuaagcagcagggcaucuucgggaagacccaaguuggagugggcguccagaaagaggggguguuucauacaauguggcacgugacccggggagcuguucucacacacaacggcaagcgccuggagccuaauugggccuccgucaaaaaggaucuuauuagcuauggcgggggauggagacugucugcccaguggcaaaaaggcgaagaggugcaggugaucgcugucgaacccgggaagaacccuaagaauuuccagacgaugcccggaauuuuccagaccacaaccggcgagaucggggccaucgcgcuggacuuuaaacccggaaccuccggcagcccuauuaucaaccgggaaggcaaggugguugggcucuacggaaauggcguggucacaaaaaacgggggauauguguccggcauugcucaaacgaaugccgagccggaugggcccaccccugagcuggaagaggaaauguucaagaaacgcaaccuuacaaucauggaccugcaucccggcagcggaaagaccagaaaguaccucccugccauuguucgggaggcuaucaaacgcagacugcggacacucauccuggcccccaccagaguggucgcugccgaaauggaggaggcgcuuaagggccugccuauucgcuaucagacgacagccaccaaaucugaacacaccgggcgggagaucguggaucugaugugccaugcuacauuuaccaugagacuccugagcccgguucgcgugcccaauuacaaccuuauuaucauggacgaagcccacuucacagauccugcuuccauugccgcccggggauauaucucuaccagagucggcaugggggaggcugcggccaucuuuaugacggcuacacccccuggaaccgccgaagccuucccccagagcaaugcuccgauucaggacgaggagcgcgacaucccugaacgguccuggaacucuggcaaugaguggauuacagauuuuguggggaagaccgugugguucguccccagcaucaaagccggcaacgacauugcgaacugucugagaaagaauggaaagaaaguuauccaacucucccgcaagacguuugauaccgaauaccagaaaacaaagcugaacgacugggauuucguggugaccacagacauuucugagaugggcgcuaauuuuaaagccgaucgggucaucgaccccagacggugccugaagccugugauccucaccgaugggcccgagcgcguuauucuugccggaccuaugccggugacagcugccagcgcggcccagagacggggccgcgucgggagaaacccccagaaggaaaaugaccaauacaucuucaccggacagccucugaacaaugaugaggaccaugcucacuggacggaagccaaaaugcugcucgacaacauuaauacacccgagggcaucauuccugcucuguucgaacccgagcgggagaaguccgccgcuaucgauggggaauauagacuuaaaggcgagagccgcaagaccuuuguggaacugaugcggagaggagaccucccgguuuggcuggcccacaaaguggcgucugagggcaucaaguacaccgaucgcaaauggugcuucgacggggaacggaacaaucagauucuggaggagaacauggaugucgaaaucuggacaaaggagggagaaagaaagaaacuccgcccucgguggcuugacgccagaaccuauuccgauccccuggcucugaaggaguuuaaagacuucgccgcuggccgcaagagcauugcccucgaucuggugacagaaaucgggagagucccuucucaucuugccuaccggacgcgcaaugcucuggacaaccucgugaugcugcacaccuccgagcauggaggcagagcguaucggcacgccguugaggaacugcccgagacaauggaaacccuccuucugcugggccucaugauucugcuuacagggggagcuaugcuguuucucaucagcggcaaagggaucggaaagaccuccauuggccugaucugugugauugugucuagcgggaugcuguggauggccgaugucccucuccaguggaucgccuccgcuauuguucuugaguucuuuaugauggugcugcugauccccgagccggaaaagcaacgcacgccucaggacaaucagcucgccuacguggucauuggaauccugacccuugcggccaucguggcugccaacgagaugggccugcucgaaacaaccaaaagagaucugggcaugagcaaggagcccgggguugugucucccacauccuaucuggacgucgaccuccacccugcuagcgccuggacccuuuacgcgguggccacgacagucauuaccccgaugcugcggcauacaaucgaaaauucuaccgcuaacgugagccuggccgcuauugccaaccaagcuguugugcucaugggacuggauaaaggcuggcccaucuccaagauggaccuuggggucccucugcucgcccugggaugcuacucucaggugaauccccugacccucacagcggccguucuucugcuggugacgcacuaugcuauuaucggcccugggcuccaggccaaagcuaccagagaggcccagaagcgcacagccgcgggaaucaugaagaaccccaccgucgauggcauuaugacaaucgaccuggauccugugauuuacgacagcaaauucgagaagcaacuuggccaggugaugcugcucguucugugugcuguccagcugcuccuuaugcggaccuccugggcccugugcgaagcucugacgcucgccacagggccgaucaccacccugugggagggaucucccggcaaauuuuggaauacaaccauugccgugagcauggcuaacaucuucagaggguccuaucuugccggagcgggccuggccuuuagcaucaugaagucuguggggacaggacgccggggcacgggcucccagggggaaacccucggagagaaauggaagaagaaacugaaucaacugagcagaaaggaauucgaucucuacaaaaaguccggcauuacagaggucgaccggaccgaggcuaaagaagggcuuaagcgcggagagacaacccaucacgccguuucuagaggcagcgcuaaacugcagugguuuguggaacggaacauggugaucccugaggggcgcgucauugaucugggauguggcagaggcgggugguccuauuacugcgccggacucaagaaggugacggaaguucggggcuauaccaaagggggacccggccaugaggagccugugcccaugucuacauacggguggaauaucgucaagcugaugagcggaaaagacguguucuaccuuccgccugaaaagugugauacccugcucugcgacauuggcgaguccagccccucucccacaguugaagagucccgcaccaucagagugcugaaaauggucgagccuuggcugaagaacaaucaguucuguauuaaggugcucaaccccuauaugccuacagugaucgaacaccuugagcggcugcagcgcaaauacggcgggaugcuggucagaaauccgcucagccggaacucuacccacgaaauguauuggaucuccaauggaacgggcaacauuguuagcucugugaauauggugagcagacugcuucugaaccgcuuuacaaugacccaucggagacccaccaucgagaaggaugucgaccucggggcgggaacacgccacgugaacgccgaaccugagacgcccaauauggacguuauuggcgagcggaucaaaagaauuaaggaagagcauuccucuaccuggcacuacgaugacgaaaacccuuauaaaacaugggcuuaccacgggagcuaugaggugaaggccaccggauccgcuagcuccaugaucaauggcgucgugaagcugcugacaaaacccugggauguugugccgauggucacccaaauggccaugacagacaccacgccuuucggccagcagcgcguguuuaaggaaaaaguugauacccggacacccagaccuaugcccgggacccgcaaggugauggagaucacagcugaguggcucuggcggacccugggaagaaacaaaaagccucgccuuugcacgcgggaagaguucacaaagaaagucagaaccaaugccgcgaugggcgccguguuuacagaagagaaccaaugggacucugcucgcgccgcugucgaagaugaggaguucuggaagcugguggacagagaacgggagcuccauaaacuggggaaguguggaagcugcguuuacaauaugaugggcaaacgcgaaaagaaacuuggggaguuuggcaaggccaagggauccagagccauuugguacauguggcugggcgcgcgguaucucgaguucgaagcucugggguuucugaacgaggaucacugguucucuagagaaaauagcuacuccggaguggagggcgaagggcuccauaaacugggauauauccuucgggacauuucuaagauccccggcggggccauguacgccgaugacaccgcuggcugggacacgcgcauuaccgaggaugaccugcacaacgaggaaaaaaucacacagcagauggauccggagcauagacagcucgccaaugcuaucuuuaagcugaccuaucaaaacaaagucgugaaggugcagcggccuacacccaagggaaccguuauggacauuaucagccgcaaagaucagagaggcuccgggcaggugggaacauacggccuuaauaccuucacgaacauggaagcccaacugguccggcagauggagggggaaggagugcucagcaaggcggaccuggagaauccccaccugcucgagaaaaagauuacacaguggcuggaaaccaaaggcguugagcgccuuaagagaauggccaucucuggggaugacugcguggucaagccuauugaugaccgguuugcuaacgcccugcucgcucugaacgauaugggcaaagugcgcaaggacaucccgcaguggcaacccuccaaaggauggcacgauuggcagcaggucccuuucuguagccaucacuuccaugaacuuaucaugaaggacggcagaaaacuggugguucccugccggccucaggacgagcucauugggcgcgccagaaucucucaaggagcgggcuggucccugaaggaaaccgccugucuggggaaggcuuaugcccagauguggagccucauguacuuucaccggcgcgaucugagacuugcuucuaaugccauuugcuccgcugugcccguccacuggaucccuacaagccggaccacaugguccauucaugcccaccaucaguggaugacgaccgaggacaugcugacaguguggaacagaguuuggaucgaggauaaucccuggauggaagacaaaaccccggugacaaccugggaggaugucccuuaccucggaaagcgcgaagaccaaugguguggcagccugauugggcuuacgucucgggcgaccugggcccagaacauccugacagcuauccagcaggugagaagccucauuggcgaugaggaguuccuggacuauaugcccuccaugaaacgcuuucggaaggaagaggaaucugagggagugaucugguga

SEQ ID NO: 20845 - RNA, 9873 nt, Artificial Sequence
  derived and/or modified CDS sequence (opt5) from DENV-3__FJ432728__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacaaaccuggaugagcgccgagggcgcuuggcggcagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaaacccacgcucgacaucgagcugcagaagaccgaagcuacacaacuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggucaccugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccucgcaccggacuugauuucaaugagaugauccugcucacgaugaaaaacaaggcuuggaugguccacagacagugguuuuucgaccugccccuuccguggaccagcggcgccacaaccgagacaccuaccuggaaucggaaagaacugcucgugacguuuaagaacgcccaugcuaaaaagcaagagguugugguccuggggucucaggaaggagcgaugcacacagcccugaccggcgcuacagagauucagaauuccgggggcaccagcaucuucgccggacaccucaagugucgccugaaaauggauaagcuugaacugaaaggcaugucuuacgccaugugccucaacaccuuugugcugaagaaagagguuuccgagacacagcaugggacgauucugaucaagguggaauacaagggagaggacgcucccuguaaaaucccuuucagcaccgaagauggccaagggaaggcccacaacggaagacuuauuacagcgaaucccgucgugaccaaaaaggaggagcccgugaacaucgaagcugagccuccguucggcgaauccaauauuguuaucgggauuggcgacaaagcccucaagaucaacugguauaagaaaggaucuagcaucggcaagauguuugaggccacagcucggggggccagacgcauggcuauucugggagauaccgccugggacuucggcuccgucgggggagugcugaauagccucggcaaaauggugcaucagaucuuugggucugcguacacggcccuguucuccggcgucagcuggauuaugaagaucggaauuggcgugcuucugacauggaucgggcucaacucuaaaaauaccagcauguccuuuucuugcauuguuaucggaaucauuacccuguaucugggcgcugugguccaggccgauauggggugugcuaucaacuggaagggaaaggaacuuaaaugcggcagcgggauuuucgugacaaaugagguucacaccuggacagagcaguacaaguuucaagccgacucccccaaacggcucgcgacggccaucgcuggcgccugggaaaacggaguguguggcauuagaagcaccacacgcauggagaaucugcuguggaagcagaucgcuaacgaacucaauuauauccugugggagaacaauauuaaacuuaccgucgugguuggggauaucauuggagugcuggaacagggcaagcggacacucaccccucagcccauggagcugaaauacucuuggaagacgugggggaaggccaaaaucgucaccgccgagacacaaaacuccagcuucauuaucgacggaccuaacacccccgaaugcccgucugcuuccagagcguggaaugugugggagguggaagacuauggcuuuggcgucuucacaaccaacaucuggcugaagcuucgcgagguuuacacacagagcugugaucaucggcucauguccgccgcuauuaaagacgaaagagccgugcacgccgauaugggguacuggaucgagucucagaagaauggaagcuggaaacuggagaaggcuuccuuuauugaagugaagaccugcacguggccuaaaucucacacacuguggagcaacggcguccucgaguccgacaugaucauucccaagagccuggccgggccuaucucucagcauaaucaccgccccggauaucauacccaaaccgcgggcccuuggcaccuugggaaacuggaacucgauuucaacuacugcgagggaacaaccgugguuaucacggaggacuguggcacacggggccccucccugagaaccacaaccgugagcgggaagcugauucacgaauggugcugucgcucuugcacacuuccgccucuccgguauaugggagaggauggcuguugguacgggauggaaaucagacccauuaaugagaaagaagagaacauggucaagucccuggugagcgcuggaucuggcaagguugacaauuuuaccaugggggugcugugccucgccauccuguucgaggaagucaugcggggaaaauucggcaagaaacauaugauugccggcgugcuuuuuacguucguucugcuccugagcgggcagaucaccuggcgcgauauggcucacacacugauuaugaucggauccaacgccagcgacagaaugggcaugggggugaccuaucuugcgcugaucgcuacauuuaagauucagcccuuccucgcccugggauuuuuccuccggaaacugaccucuagagagaaucuucugcucggcgucgggcuggccauggcuacgacacugcaacuuccugaagauaucgagcagauggccaacggaauugcucugggccucaugacccugaagcucaucacacaguuugaaaccuaccagcuguggaccgcccuugugucccugacauguagcaauacgauuuucacccucacaguggcguggcgcaccgccacacugauccuggcuggcgucucccuucugccgcucugccaaucuagcuccaugcggaagaccgacuggcugcccaugacgguugccgcuaugggggugccuccccucccucuguuuaucuucucucuuaaagauacacccaagagacgcagcuggccucugaacgagggagugauggccgucggccugguguccauucucgccucuagccugcuuagaaaugacguucccauggcugggccgcugguggcgggaggccuccugaucgccuguuaugucauuaccgggaccuccgcugaccucacaguggagaaagccgccgauguuaccugggaagaggaagcugagcagacaggagugagccauaaccugaugaucacggucgacgaugacggcaccaugcggauuaaggaugacgaaacagagaacauccuuaccgugcugcugaaaacagcccuccugaucgucucuggcauuuuuccuuacuccauccccgcgacccuucugguguggcacacguggcagaagcagacccaacgcagcgggguucucugggaugugccuucucccccggagacacagaaagcugaacuggaggaaggagucuacagaauuaagcagcagggcaucuucgggaagacccaagugggaguuggcgugcagaaagagggggucuuucauacaauguggcacgugacccggggagccgugcucacacacaauggcaagcgccuggagccuaacugggccuccguuaaaaaggaccuuauuagcuauggcgggggauggagacugucugcucaguggcaaaaaggcgaagagguccaggugaucgccguggaacccgggaagaauccuaagaacuuccagacgaugcccggaauuuuccagaccacaaccggcgagaucggggcgaucgcucuggauuuuaaacccggaaccuccggcagcccuauuaucaaucgggaaggcaaggucguggggcucuacggaaacggcguugugacaaaaaaugggggauaugucuccggcauugcccaaacgaacgccgagccggacgggcccaccccugagcuggaagaggaaauguucaagaaacgcaaucuuacaaucauggaucugcaucccggcagcggaaagaccagaaaguaccucccugcuauugugcgggaggccaucaaacgcagacugcggacacucauccuggcucccaccagaguuguggccgcggaaauggaggaggcccuuaagggccugccuauucgcuaucagacgacagcuaccaaaucugaacacaccgggcgggagaucgucgaccugaugugccaugccacauuuaccaugagacuccugagcccggugcgcguucccaacuacaaucuuauuaucauggaugaagcucacuucacagacccugccuccauugccgcucggggauauaucucuaccagagugggcaugggggaggcggccgcuaucuuuaugacggccacacccccuggaaccgccgaagcuuucccccagagcaacgccccgauucaggacgaggagcgcgauaucccugaacgguccuggaauucuggcaacgaguggauuacagacuuugucgggaagaccgugugguucgugcccagcaucaaagcgggcaaugauauugcuaacugucugagaaagaacggaaagaaagucauccaacucucccgcaagacguuugacaccgaauaccagaaaacacggcugaaugauugggacuucguugugaccacagauauuucugagaugggcgccaacuuuaaggccgacagagugaucgauccccggcgcugccugaaaccugucauccucaccgacgggcccgagagagugauucuugcuggaccuaugccgguuacagccgcgagcgccgcucagcggcgcggcagaguggggcggaauccccagaaggaaaacgaucaauacaucuucaccggacagccucugaauaacgacgaggaccaugcccacuggacggaagcuaagaugcugcucgauaauauuaacacacccgagggcaucauuccugcccuguucgaacccgagagagagaaauccgcugccaucgacggggaauaucgccuuaagggcgagagccggaaaaccuuugucgaacugaugagacgcggagaucucccgguguggcuggcgcacaagguugccucugagggcaucaaauacaccgaccggaaguggugcuucgauggggaaagaaauaaccagauucuggaggagaauauggacguggaaaucuggacaaaagagggagaacgcaagaagcuccggccuagauggcuugaugcucgcaccuauuccgacccccuggcccugaaagaguuuaaggauuucgcugccggcagaaaaagcauugcccucgaccuggucacagaaaucgggcgggugccuucucaucuugcuuaccgcacgagaaacgcgcuggauaaucucgucaugcugcacaccuccgagcauggaggccgggccuaucgccacgcuguggaggaacugcccgagacaauggaaacccuccuucugcugggccucaugauucugcuuacagggggagccaugcuguuucucaucagcggcaaggggaucggaaaaaccuccauuggccugaucuguguuauugugucuagcgggaugcuguggauggccgacgugccucuccaguggaucgcuuccgccauuguccuugaguucuuuaugaugguucugcugauccccgagccggaaaagcaaagaacgccucaggauaaccagcucgcguacguggugauuggaauccugacccuugccgcuaucgucgccgcuaaugagaugggccugcucgaaacaaccaagcgggaccugggcaugagcaaagagcccggggugguuucucccacauccuaucuggacguggaucuccacccugccagcgcguggacccuuuacgccgucgcuacgacagugauuaccccgaugcugagacauacaaucgaaaacucuaccgccaaugucagccuggcugccauugcuaaccaagccgugguucucaugggacuggacaagggcuggcccaucuccaaaauggaucuuggggugccucugcucgcgcugggaugcuacucucaggucaacccccugacccucacagccgcugugcuucugcugguuacgcacuaugccauuaucggcccugggcuccaggcuaaggccacccgcgaggcccagaaacggacagcggcuggaaucaugaagaaucccaccguggacggcauuaugacaaucgaucuggacccugucauuuacgauagcaaguucgagaaacaacuuggccaggugaugcugcucgugcugugugccguucagcugcuccuuaugagaaccuccugggcucugugcgaagcccugacgcucgccacagggccgaucaccacccugugggagggaucucccggcaaguuuuggaacacaaccauugcugucagcauggccaauaucuuccgcggguccuaucuugcgggagccggccuggcuuuuagcaucaugaaaucuguggggacaggacggagaggcacgggcucccagggggaaacccucggagagaaguggaaaaagaagcugaaccaacugagccggaaagaauucgaccucuacaagaaauccggcauuacagagguggaucgcaccgaggccaaggaagggcuuaaaagaggagagacaacccaucacgcugucucucggggcagcgccaagcugcagugguuuguugaacgcaauauggugaucccugaggggagagugauugaccugggauguggccggggcgggugguccuauuacugcgcgggacucaaaaaggucacggaagugcgcggcuauaccaaggggggacccggccaugaggagccuguucccaugucuacauacggguggaaccuggugaaacuuaugagcggaaaggaugucuucuaccugccgccugaaaaaugugacacccuccugugcgauaucggcgaguccagccccucucccacaguggaagaguccagaaccauucggguucugaagaugguggagccuuggcucaaaaauaaccaguucuguaucaagguccuuaaucccuauaugccuacagugauugaacaccuggagcgccugcagagaaaguacggcgggaugcucgugcggaacccgcugagcagaaauucuacccacgaaauguauuggaucuccaacggaacgggcaauaucgucagcucuguuaacauggugagccgccuucugcucaaucgguuuacaaugacccauagacgccccaccauugagaaagacguggaccugggggccggaacacggcacgucaacgcugaaccugagacgcccaacauggaugugaucggcgagagaauuaagcgcaucaaagaagagcauuccucuaccuggcacuacgacgaugaaaauccuuauaagacaugggccuaccacgggagcuaugagguuaaagcuaccggauccgccagcuccaugauuaacggcguggucaagcugcucacaaagcccugggacgugguuccgauggugacccaaauggcuaugacagauaccacgccuuucggccagcagcgggucuuuaaagaaaagguggacaccagaacaccccgcccuaugcccgggacccggaaaguuauggagaucacagccgaguggcuguggagaacccuuggacgcaauaagaaaccucggcugugcacgagagaagaguucacaaagaaggugcgcaccaacgcggccaugggcgcugucuuuacagaagagaaucaaugggauucugccagagcugccguggaagacgaggaguucuggaaacucgucgaucgggaacgcgagcugcauaagcuugggaaauguggaagcugcguguacaacaugaugggcaagagagaaaaaaagcugggggaguuuggcaaagccaagggaucccgggcgaucugguacauguggcucggcgcuagauaucuggaguucgaagcccugggguuucucaaugaggaccacugguucucucgggaaaacagcuacuccggaguugagggcgaagggcugcauaagcuuggauauauucugcgcgauaucucuaaaauucccggcggggccauguacgcugacgacaccgccggcugggauacgagaaucaccgaggacgaucuccacaaugaggaaaagauuacacagcagauggacccggagcaucggcagcuggcuaacgccaucuuuaaacuuaccuaucaaaauaagguggucaaagugcagcgcccuacacccaagggaaccgugauggauaucauuagcagaaaggaccagcggggcuccgggcagguuggaacauacggccugaacaccuucacgaauauggaagcgcaacucgugcgccagauggagggggaaggaguccugagcaaagccgaucuggagaacccccaccuccuggagaagaaaaucacacaguggcuugaaaccaagggcguggagagacugaaacggauggcuauuucuggggacgauugcguugugaagccuaucgacgaucgcuuugccaaugcucuccuggcccuuaacgacaugggcaaggucagaaaagauauuccgcaguggcaacccuccaagggauggcacgacuggcagcaggugccuuucuguagccaucacuuccaugaacugaucaugaaagacggccggaagcucgucgugcccugccgcccucaggaugagcugaucgggagagcgcggauuucucaaggagccggcuggucccugaaagaaaccgcuugucucgggaaggccuaugcucagauguggagccugauguacuuucaccgcagagaccuucggcuggccucuaacgcuaucugcuccgccguucccgugcacuggauuccuacaagcagaaccacaugguccauccaugcgcaccaucaguggaugacgaccgaggauaugcucacagucuggaaucgcguguggauugaggacaaccccuggauggaagauaagaccccgguuacaaccugggaggacgugccuuaccugggaaaacgggaagaucaaugguguggcagccuuaucgggcugacgucuagagccaccugggcucagaauauucucacagccauccagcagguccgcagccugaucggcgacgaggaguuccuggauuauaugcccuccaugaagcgguuuagaaaagaagaggaaucugagggagccauuugguga

SEQ ID NO: 20846 - RNA, 9873 nt, Artificial Sequence
  derived and/or modified CDS sequence (opt5) from DENV-3__FJ432731__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacaaaccuggaugagcgccgagggcgcuuggcggcagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaaacccacgcucgacaucgagcugcagaagaccgaagcuacacaacuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggucaccugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccucgcaccggacuugauuucaaugagaugauccugcucacgaugaaaaacaaggcuuggaugguccacagacagugguuuuucgaccugccccuuccguggaccagcggcgccacaaccgagacaccuaccuggaaucggaaagaacugcucgugacguuuaagaacgcccaugcuaaaaagcaagagguugugguccuggggucucaggaaggagcgaugcacacagcccugaccggcgcuacagagauucagaauuccgggggcaccagcaucuucgccggacaccucaagugucgccugaaaauggauaagcuugaacugaaaggcaugucuuacgccaugugccucaacaccuuugugcugaagaaagagguuuccgagacacagcaugggacgauucugaucaagguggaauacaagggagaggacgcucccuguaaaaucccuuucagcaccgaagauggccaagggaaggcccacaacggaagacuuauuacagcgaaucccgucgugaccaaaaaggaggagcccgugaacaucgaagcugagccuccguucggcgaauccaauauuguuaucgggauuggcgacaaagcccucaagaucaacugguauaagaaaggaucuagcaucggcaagauguuugaggccacagcucggggggccagacgcauggcuauucugggagauaccgccugggacuucggcuccgucgggggagugcugaauagccucggcaaaauggugcaucagaucuuugggucugcguacacggcccuguucuccggcgucagcuggauuaugaagaucggaauuggcgugcuucugacauggaucgggcucaacucuaaaaauaccagcauguccuuuucuugcauuguuaucggaaucauuacccuguaucugggcgcugugguccaggccgauauggggugugcuaucaacuggaagggaaaggaacuuaaaugcggcagcgggauuuucgugacaaaugagguucacaccuggacagagcaguacaaguuucaagccgacucccccaaacggcucgcgacggccaucgcuggcgccugggaaaacggaguguguggcauuagaagcaccacacgcauggagaaucugcuguggaagcagaucgcuaacgaacucaauuauauccugugggagaacaauauuaaacuuaccgucgugguuggggauaucauuggagugcuggaacagggcaagcggacacucaccccucagcccauggagcugaaauacucuuggaagacgugggggaaggccaaaaucgucaccgccgagacacaaaacuccagcuucauuaucgacggaccuaacacccccgaaugcccgucugcuuccagagcguggaaugugugggagguggaagacuauggcuuuggcgucuucacaaccaacaucuggcugaagcuucgcgagguuuacacacagagcugugaucaucggcucauguccgccgcuauuaaagacgaaagagccgugcacgccgauaugggguacuggaucgagucucagaagaauggaagcuggaaacuggagaaggcuuccuuuauugaagugaagaccugcacguggccuaaaucucacacacuguggagcaacggcguccucgaguccgacaugaucauucccaagagccuggccgggccuaucucucagcauaaucaccgccccggauaucauacccaaaccgcgggcccuuggcaccuugggaaacuggaacucgauuucaacuacugcgagggaacaaccgugguuaucacggagaauuguggcacacggggccccucccugagaaccacaaccgugagcgggaagcugauucacgaauggugcugucgcucuugcacacuuccgccucuccgguauaugggagaggacggcuguugguacgggauggaaaucagacccauuaacgagaaagaagagaauauggucaagucccuggugagcgcuggaucuggcaagguugauaacuuuaccaugggggugcugugccucgccauccuguucgaggaagucaugcggggaaaauucggcaagaaacauaugauugccggcgugcuuuuuauguucguucugcuccugagcgggcagaucacguggcgcgacauggcucagacccugauuaugaucggauccaaugccagcgauagaaugggcaugggggugacauaucuugcgcugaucgcuaccuuuaagauucaacccuuccucgcccugggauuuuuccuccggaaacugacaucuagagagaaccuucugcucggcgucgggcuggccaugaccacgacacugcagcuuccugaagacaucgagcagauggcuaauggaauugcccugggccucaugacccugaagcucaucacacaguuugaaaccuaccaacuguggaccgcucuugugucccugacauguagcaacacgauuuucacccucacaguggccuggcgcaccgcgacacugauccuggccggcgucucccuucugccgcucugccagucuagcuccaugcggaagaccgauuggcugcccaugacgguugcugccaugggggugccuccccucccucuguuuaucuucucucuuaaagacacacccaagagacgcagcuggccucugaaugagggagugauggcugucggccugguguccauucucgccucuagccugcuuagaaacgauguucccauggccgggccgcugguggcuggaggccuccugaucgcguguuaugucauuaccgggaccuccgccgaccucacaguggagaaagcugccgacguuaccugggaagaggaagccgagcagacaggagugagccacaaccugaugaucacggucgaugacgauggcaccaugcggauuaaggacgaugaaacagagaauauccuuaccgugcugcugaaaacagcucuccugaucgucucuggcauuuuuccuuacuccauccccgccacccuucugguguggcauacguggcagaagcaaacccagcgcagcgggguucucugggacgugccuucucccccggagacacagaaagcggaacuggaggaaggagucuacagaauuaagcagcaaggcaucuucgggaagacccaggugggaguuggcgugcagaaagagggggucuuucacacaauguggcaugugacccggggagcugugcucacacacaacggcaagcgccuggagccuaauugggccuccguuaaaaaggaucuuauuagcuauggcgggggauggagacugucugcccaauggcagaaaggcgaagagguccaggugaucgcuguggaacccgggaagaacccuaagaauuuccagacgaugcccggaauuuuccaaaccacaaccggcgagaucggggccaucgcgcuggacuuuaaacccggaaccuccggcagcccuauuaucaaccgggaaggcaaggucguggggcucuacggaaauggcguugugacaaaaaacgggggauaugucuccggcauugcucagacgaaugccgagccggaugggcccaccccugagcuggaagaggaaauguucaagaaacgcaaccuuacaaucauggaccugcaccccggcagcggaaagaccagaaaguaccucccugccauugugcgggaggcuaucaaacgcagacugcggacacucauccuggcccccaccagaguuguggcugccgaaauggaggaggcgcuuaagggccugccuauucgcuaucagacgacagccaccaaaucugaacauaccgggcgggagaucgucgaucugaugugccacgcuacauuuaccaugagacuccugagcccggugcgcguucccaauuacaaccuuauuaucauggacgaagcccauuucacagauccugcuuccauugccgcccggggauauaucucuaccagagugggcaugggggaggcugcggccaucuuuaugacggcuacacccccuggaaccgccgaagccuucccccagagcaaugcuccgauucaagacgaggagcgcgacaucccugaacgguccuggaacucuggcaaugaguggauuacagauuuugucgggaagaccgugugguucgugcccagcaucaaagccggcaacgacauugcgaacugucugagaaagaauggaaagaaagucauccagcucucccgcaagacguuugauaccgaauaccagaaaacacggcugaacgacugggauuucguugugaccacagacauuucugagaugggcgcuaauuuuaaggccgauagagugaucgacccccggcgcugccugaaaccugucauccucaccgaugggcccgagagagugauucuugccggaccuaugccgguuacagcugccagcgcggcccagcggcgcggcagaguggggcggaacccccaaaaggaaaaugaccaguacaucuucaccggacagccucugaacaaugaugaggaccacgcucauuggacggaagccaagaugcugcucgacaacauuaauacacccgagggcaucauuccugcucuguucgaacccgagagagagaaauccgccgcuaucgauggggaauaucgccuuaagggcgagagccggaaaaccuuugucgaacugaugagacgcggagaccucccgguguggcuggcccacaagguugcgucugagggcaucaaauacaccgaucggaaguggugcuucgacggggaaagaaacaaucagauucuggaggagaacauggauguggaaaucuggacaaaagagggagaacgcaagaagcuccggccuagauggcuugacgcccgcaccuauuccgauccccuggcucugaaagaguuuaaggacuucgccgcuggcagaaaaagcauugcccucgaucuggucacagaaaucgggcgggugccuucucaccuugccuaccgcacgagaaaugcucuggacaaccucgucaugcugcauaccuccgagcacggaggccgggcguaucgccaugccguggaggaacugcccgagacaauggaaacccuccuucugcugggccucaugauucugcuuacagggggagcuaugcuguuucucaucagcggcaaggggaucggaaaaaccuccauuggccugaucuguguuauugugucuagcgggaugcuguggauggccgaugugccucuccaauggaucgccuccgcuauuauccuugaguucuuuaugaugguccugcugauucccgagccggaaaagcagagaacgccucaggacaaucaacucgccuacguugugaucggaauccugacccuugcggccauuguggcugccaacgagaugggccugcucgaaacaaccaagcgggaucugggcaugagcaaagagcccggggucgugucucccacauccuaucuggacguugaccuccacccugcuagcgccuggacccuuuacgcgguggccacgacagucaucaccccgaugcugagacacacaauugaaaauucuaccgcuaacgugagccuggccgcuaucgccaaccaggcugucgugcucaugggacuggauaagggcuggcccauuuccaaaauggaccuugggguuccucugcucgcccugggaugcuacucucaggugaauccccugacccucacagcggccguccuucugcuggugacgcauuaugcuaucaucggcccugggcuccaggccaaggcuacccgcgaggcccaaaaacggacagccgcgggaauuaugaagaaccccaccguugauggcaucaugacaauugaccuggauccugugaucuacgacagcaaguucgagaaacagcuuggccaggucaugcugcucgugcugugugcugugcagcugcuccuuaugagaaccuccugggcccugugcgaagcucugacgcucgccacagggccgauuaccacccugugggagggaucucccggcaaguuuuggaauacaaccaucgccguuagcauggcuaacaucuuccgcggguccuaucuugccggagcgggccuggccuuuagcauuaugaaaucugucgggacaggacggagaggcacgggcucccaaggggaaacccucggagagaaguggaaaaagaagcugaaucagcugagccggaaagaauucgaucucuacaagaaauccggcaucacagagguggaccgcaccgaggcuaaggaagggcuuaaaagaggagagacaacccaccaugccgugucucggggcagcgcuaagcugcagugguuugucgaacgcaacaugguuauuccugaggggagagugaucgaucugggauguggccggggcgggugguccuauuacugcgccggacucaaaaaggugacggaaguccgcggcuauaccaaggggggacccggccacgaggagccugugcccaugucuacauacggguggaaucugguuaaacuuaugagcggaaaggacguguucuaccugccgccugaaaaaugugauacccuccugugcgacauuggcgaguccagccccucucccacagucgaagaguccagaaccauccgggugcugaagaugguugagccuuggcucaaaaacaaucaguucuguauuaaggugcuuaaccccuauaugccuacagucaucgaacaucuggagcgccugcaaagaaaguacggcgggaugcucgugcggaauccgcugagcagaaacucuacccacgaaauguauuggaucuccaauggaacgggcaacauugugagcucugucaauaugguuagccgccuucugcucaaccgguuuacaaugacccacagacgccccaccaucgagaaagauguggaccugggggcgggaacacggcaugugaacgccgaaccugagacgcccaauauggacgucauuggcgagagaaucaagcgcauuaaagaagagcacuccucuaccuggcauuacgaugacgaaaacccuuauaagacaugggcuuaccacgggagcuaugaggugaaagccaccggauccgcuagcuccaugaucaauggcguugugaagcugcucacaaagcccugggaugucgugccgaugguuacccagauggccaugacagacaccacgccuuucggccagcaacggguguuuaaagaaaaggucgauaccagaacaccccgcccuaugcccgggacccggaaagugauggagaucacagcugaguggcuguggagaacccuuggacgcaacaagaaaccucggcugugcacgagagaagaguucacaaagaagguucgcaccaaugccgcgaugggcgccguguuuacagaagagaaccagugggacucugcuagagccgcugucgaagaugaggaguucuggaaacucguggaccgggaacgcgagcugcacaagcuugggaaauguggaagcugcgucuacaauaugaugggcaagagagaaaaaaagcugggggaguuuggcaaagccaagggaucccgggccauuugguacauguggcucggcgcgagauaucuggaguucgaagcucugggguuucucaacgaggaucauugguucucucgggaaaauagcuacuccggaguggagggcgaagggcugcacaagcuuggauauauccugcgcgacauuucuaaaauccccggcggggccauguacgccgaugacaccgcuggcugggacacgagaauuaccgaggaugaccuccauaacgaggaaaagaucacacagcagauggauccggagcaccggcaacuggccaaugcuaucuuuaaacuuaccuaucagaacaagguugugaaaguccagcgcccuacacccaagggaaccgugauggacauuaucagcagaaaggaucagcggggcuccgggcaagugggaacauacggccugaauaccuucacgaacauggaagcccagcucguucgccagauggagggggaaggagugcugagcaaagcggaccuggagaauccccaucuccuggagaagaaaauuacacaguggcuugaaaccaagggcgucgagagacugaaacggauggccaucucuggggaugacugcgugguuaagccuauugaugaccgcuuugcuaacgcccuccuggcucuuaacgauaugggcaaggugagaaaagacaucccgcaauggcagcccuccaagggauggcacgauuggcagcaggucccuuucuguagccaccauuuccacgaacugaucaugaaagacggccggaagcucgugguccccugccgcccucaagacgagcugauugggagagcccggaucucucagggagcgggcuggucccugaaagaaaccgccugucucgggaaggcuuaugcccagauguggagccugauguacuuucaucgcagagaucuucggcuggcuucuaaugccauuugcuccgcugugcccguucacuggaucccuacaagcagaaccacaugguccauucacgcccaucaccaauggaugacgaccgaggacaugcucacaguguggaaccgcgucuggaucgaggauaaucccuggauggaagacaagaccccggugacaaccugggaggauguuccuuaccugggaaaacgggaagaccagugguguggcagccuuauugggcugacgucuagagcgaccugggcccagaacauccucacagcuauccagcaagugcgcagccugauuggcgaugaggaguuccuggacuauaugcccuccaugaagcgguuuagaaaagaagaggaaucugagggagccaucugguga

SEQ ID NO: 20847 - RNA, 9873 nt, Artificial Sequence
  derived and/or modified CDS sequence (opt5) from DENV-3__FJ562097__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacaaaccuggaugagcgccgagggcgcuuggcggcagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaaacccacgcucgacaucgagcugcagaagaccgaagcuacacaacuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggucaccugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccucgcaccggacuugauuucaaugagaugauccugcucacgaugaaaaacaaggcuuggaugguccacagacagugguuuuucgaccugccccuuccguggaccagcggcgccacaaccgagacaccuaccuggaaucggaaagaacugcucgugacguuuaagaacgcccaugcuaaaaagcaagagguugugguccuggggucucaggaaggagcgaugcacacagcccugaccggcgcuacagagauucagaauuccgggggcaccagcaucuucgccggacaccucaagugucgccugaaaauggauaagcuugaacugaaaggcaugucuuacgccaugugccucaacaccuuugugcugaagaaagagguuuccgagacacagcaugggacgauucugaucaagguggaauacaagggagaggacgcucccuguaaaaucccuuucagcaccgaagauggccaagggaaggcccacaacggaagacuuauuacagcgaaucccgucgugaccaaaaaggaggagcccgugaacaucgaagcugagccuccguucggcgaauccaauauuguuaucgggauuggcgacaaagcccucaagaucaacugguauaagaaaggaucuagcaucggcaagauguuugaggccacagcucggggggccagacgcauggcuauucugggagauaccgccugggacuucggcuccgucgggggagugcugaauagccucggcaaaauggugcaucagaucuuugggucugcguacacggcccuguucuccggcgucagcuggauuaugaagaucggaauuggcgugcuucugacauggaucgggcucaacucuaaaaauaccagcauguccuuuucuugcauuguuaucggaaucauuacccuguaucugggcgcugugguccaggccgauauggggugugugaucaacuggaagggaaaggaacuuaaaugcggcagcgggauuuucguuacaaaugaggugcacaccuggacagagcaguacaaguuucaagcugacucccccaaacggcucgccacggcgaucgccggcgcuugggaaaacggagucuguggcauuagaagcaccacacgcauggagaaucugcuguggaagcagaucgccaacgaacucaauuauauccugugggagaacaauauuaaacuuaccgugguugugggggauaucauuggaguccuggaacagggcaagcggacacucaccccucagcccauggagcugaaauacucuuggaagacgugggggaaggcuaaaaucgugaccgccgagacacaaaacuccagcuucauuaucgacggaccuaacacccccgaaugcccgucugccuccagagcuuggaaugugugggaggucgaagacuauggcuuuggcguuuucacaaccaacaucuggcugaagcuucgcgagguguacacacagagcugugaucaucggcucauguccgcggccauuaaagacgaaagagcugugcacgccgauaugggguacuggaucgagucucagaagaauggaagcuggaaacuggagaaggccuccuuuauugaagucaagaccugcacguggccuaaaucucacacacuguggagcaacggcgugcucgaguccgacaugaucauucccaagagccuggcugggccuaucucucagcauaaucaccgccccggauaucauacccaaaccgccggcccuuggcaccuugggaaacuggaacucgauuucaacuacugcgagggaacaaccguugugaucacggagaauuguggcacacggggccccucccugagaaccacaaccgucagcgggaagcugauucacgaauggugcugucgcucuugcacacuuccgccucuccgguauaugggagaggacggcuguugguacgggauggaaaucagacccauuaacgagaaagaagagaauauggugaagucccugguuagcgcgggaucuggcaagguggauaacuuuaccauggggguccugugccucgcuauccuguucgaggaagugaugcggggaaaauucggcaagaaacauaugauugccggcguucuuuuuacguucgugcugcuccugagcgggcagaucaccuggcgcgacauggcccacacacugauuaugaucggauccaaugcuagcgauagaaugggcaugggggucaccuaucuugcccugaucgcgacauuuaagauucagcccuuccucgcucugggauuuuuccuccggaaacugaccucuagagagaaccuucugcucggcguggggcuggccauggccgcuacgcugcaacuuccugaagacaucgagcagauggccaauggaauugcucugggccucaugacacugaagcucaucacccaguuugaaacauaccagcuguggaccgcccuugugucccugaccuguagcaacacaauuuucacgcucaccgucgcguggcgcacagccacccugauccuggcuggcguuucccuucugccgcucugccaaucuagcuccaugcggaagacagauuggcugcccaugaccguggccgcuaugggggugccuccccucccucuguuuaucuucucucuuaaagacacgcccaagagacgcagcuggccucugaaugagggagucauggccgugggccugguuuccauucucgccucuagccugcuuagaaacgaugugcccauggcugggccgcuggucgcgggaggccuccugaucgccuguuaugugauuacagggaccuccgcugaccucaccguugagaaagccgccgacgugacaugggaagaggaagcugagcagaccggagucagccauaaccugaugaucacaguggaugacgauggcacgaugcggauuaaggacgaugaaaccgagaauauccuuacaguccugcugaaaaccgcccuccugaucgugucuggcguuuuuccuuacuccauucccgcgacacuucugguguggcacaccuggcagaagcagacgcaacgcagcgggguccucugggacgugccuucucccccggagacccagaaagcugaacuggaggaaggaguuuacagaaucaagcagcagggcauuuucgggaagacacaagugggagucggcgugcagaaagaggggguguuucauaccauguggcacguuacacggggagccguccucacccacaacggcaagcgccuggagccuaauugggccuccgugaaaaaggaucuuaucagcuauggcgggggauggagacugucugcucaguggcaaaaaggcgaagaggugcaggucauugccguggaacccgggaagaacccuaagaauuuccagacaaugcccggaaucuuccagacgaccacaggcgagauuggggcgaucgcucuggacuuuaaacccggaaccuccggcagcccuaucauuaaccgggaaggcaagguuguggggcucuacggaaauggcgucgugaccaaaaacgggggauauguuuccggcaucgcccaaacaaaugccgagccggaugggcccacgccugagcuggaagaggaaauguucaagaaacgcaaccuuaccauuauggaccugcaucccggcagcggaaagacaagaaaguaccucccugcuaucgugcgggaggccauuaaacgcagacugcggacccucauccuggcucccacaagagucguggccgcggaaauggaggaggcccuuaagggccugccuauccgcuaucagaccacggcuacaaaaucugaacacaccgggcgggagauuguugaucugaugugccaugccaccuuuacaaugagacuccugagcccggugcgcguccccaauuacaaccuuaucauuauggacgaagcucacuucaccgauccugccuccaucgccgcucggggauauauuucuacaagagugggcaugggggaggcggccgcuaucuuuaugaccgccacgcccccuggaacagccgaagcuuucccccagagcaaugccccgauccaggacgaggagcgcgacauuccugaacgguccuggaacucuggcaaugaguggaucaccgauuuuguggggaagacagucugguucguucccagcauuaaagcgggcaacgacaucgcuaacugucugagaaagaauggaaagaaagugauucaacucucccgcaagaccuuugauacggaauaccagaaaaccaagcugaacgacugggauuucguggucacaaccgacaucucugagaugggcgccaauuuuaaagccgaucgggugauugaccccagacggugccugaagccuguuauccucacagaugggcccgagcgcgugauccuugcuggaccuaugccggucaccgccgcgagcgccgcucagagacggggccgcguggggagaaacccccagaaggaaaaugaccaauacauuuucacaggacagccucugaacaaugaugaggaccaugcccacuggaccgaagcuaaaaugcugcucgacaacaucaauacgcccgagggcauuaucccugcccuguucgaacccgagcgggagaaguccgcugccauugauggggaauauagacuuaaaggcgagagccgcaagacauuuguugaacugaugcggagaggagaccucccgguguggcuggcgcacaaagucgccucugagggcaucaaguacaccgaucgcaaauggugcuucgacggggaacggaacaaucagauccuggaggagaacauggauguggaaauuuggaccaaggagggagaaagaaagaaacuccgcccucgguggcuugacgcuagaacauauuccgauccccuggcccugaaggaguuuaaagacuucgcugccggccgcaagagcaucgcccucgaucuggucaccgaaauugggagagugccuucucaucuugcuuaccggacacgcaaugcgcuggacaaccucguuaugcugcacacguccgagcauggaggcagagccuaucggcacgcuguggaggaacugcccgagaccauggaaacacuccuucugcugggccucaugauccugcuuaccgggggagccaugcuguuucucauuagcggcaaagggaucggaaagacauccaucggccugauuugugugaucgucucuagcgggaugcuguggauggccgauguuccucuccaguggauugcuuccgccaucgugcuugaguucuuuaugauggugcugcugauucccgagccggaaaagcaacgcaccccucaggacaaucagcucgcguacgucgugaucggaauucugacgcuugccgcuaucguugccgcuaacgagaugggccugcucgaaaccacaaaaagagaucugggcaugagcaaggagcccgggguggucucucccaccuccuaucuggacguggaccuccacccugccagcgcguggacacuuuacgccgucgcuaccacggugaucacaccgaugcugcggcauaccauugaaaauucuacagccaacguuagccuggcugccaucgcuaaccaagccgugguccucaugggacuggauaaaggcuggcccauuuccaagauggaccuuggggugccucugcucgcgcugggaugcuacucucagguuaauccccugacccucaccgccgcugugcuucugcuggucacacacuaugccaucauuggcccugggcuccaggcuaaagccacgagagaggcccagaagcgcaccgcggcuggaaucaugaagaaccccacaguggauggcaucaugaccauugaccuggauccugugaucuacgacagcaaauucgagaagcaacuuggccagguuaugcugcucguccugugugccgugcagcugcuccuuaugcggacauccugggcucugugcgaagcccugacccucgccacggggccgauuacaacccugugggagggaucucccggcaaauuuuggaauaccacaaucgcugugagcauggccaacauuuucagaggguccuaucuugcgggagccggccuggcuuuuagcaucaugaagucugucgggaccggacgccggggcacaggcucccagggggaaacgcucggagagaaauggaagaagaaacugaaucaacugagcagaaaggaauucgaucucuacaaaaaguccggcaucaccgagguugaccggacagaggccaaagaagggcuuaagcgcggagagaccacacaucacgcugugucuagaggcagcgccaaacugcagugguuuguggaacggaacauggucauuccugaggggcgcgugaucgaucugggauguggcagaggcgggugguccuauuacugcgcgggacucaagaagguuaccgaagugcggggcuauacgaaagggggacccggccaugaggagccuguccccaugucuaccuacggguggaauauugugaagcugaugagcggaaaagacguuuucuaccuuccgccugaaaagugugauacacugcucugcgacaucggcgaguccagccccucucccaccguggaagagucccgcacaauuagaguccugaaaaugguggagccuuggcugaagaacaaucaguucuguaucaaggugcucaaccccuauaugccuaccgucauugaacaccuugagcggcugcagcgcaaauacggcgggaugcugguuagaaauccgcucagccggaacucuacacacgaaauguauuggaucuccaauggaaccggcaacaucgugagcucugugaauauggucagcagacugcuucugaaccgcuuuacgaugacacaucggagacccaccauugagaaggauguggaccucggggccggaacccgccacguuaacgcugaaccugagacacccaauauggacgugaucggcgagcggauuaaaagaaucaaggaagagcauuccucuacguggcacuacgaugacgaaaacccuuauaaaaccugggccuaccacgggagcuaugaggucaaggcuacaggauccgccagcuccaugauuaauggcgugguuaagcugcugaccaaacccugggauguggucccgauggugacacaaauggcuaugaccgacacaaccccuuucggccagcagcgcguuuuuaaggaaaaaguggauacgcggacccccagaccuaugcccgggacacgcaaggucauggagaucaccgccgaguggcucuggcggacacugggaagaaacaaaaagccucgccuuugcacccgggaagaguucacgaagaaagugagaacaaaugcggccaugggcgcugucuuuaccgaagagaaccaaugggacucugcccgcgcugccguggaagaugaggaguucuggaagcugguugacagagaacgggagcuccauaaacuggggaaguguggaagcugcguguacaauaugaugggcaaacgcgaaaagaaacuuggggaguuuggcaaggccaagggauccagagcgaucugguacauguggcugggcgcucgguaucucgaguucgaagcccugggguuucugaacgaggaucacugguucucuagagaaaauagcuacuccggagucgagggcgaagggcuccauaaacugggauauauucuucgggacaucucuaagauucccggcggggccauguacgcugaugacacagccggcugggacacccgcaucacggaggaugaccugcacaacgaggaaaaaauuacccagcagauggauccggagcauagacagcucgcuaaugccaucuuuaagcugacauaucaaaacaaaguggugaagguucagcggccuacccccaagggaacagugauggacaucauuagccgcaaagaucagagaggcuccgggcaggucggaaccuacggccuuaauacauucaccaacauggaagcgcaacuggugcggcagauggagggggaaggaguucucagcaaggccgaccuggagaauccccaccugcucgagaaaaagaucacgcaguggcuggaaacaaaaggcguggagcgccuuaagagaauggcuauuucuggggaugacugcgucgugaagccuaucgaugaccgguuugccaacgcucugcucgcccugaacgauaugggcaaaguccgcaaggacauuccgcaguggcaacccuccaaaggauggcacgauuggcagcaggugccuuucuguagccaucacuuccaugaacuuaucaugaaggacggcagaaaacugguugugcccugccggccucaggacgagcucaucgggcgcgcgagaauuucucaaggagccggcuggucccugaaggaaaccgcuugucuggggaaggccuaugcucagauguggagccucauguacuuucaccggcgcgaucugagacuugccucuaaugcuaucugcuccgccguccccgugcacuggauuccuaccagccggacaaccugguccauccaugcgcaccaucaguggaugacaacggaggacaugcugaccguuuggaacagaguguggauugaggauaaucccuggauggaagacaaaacaccggucaccacaugggaggaugugccuuaccucggaaagcgcgaagaccaaugguguggcagccugaucgggcuuaccucucgggccacgugggcucagaacauucugaccgccauccagcaggugagaagccucaucggcgaugaggaguuccuggacuauaugcccuccaugaaacgcuuucggaaggaagaggaaucugagggagccauuugguga

SEQ ID NO: 20848 - RNA, 9873 nt, Artificial Sequence
  derived and/or modified CDS sequence (opt5) from DENV-3__FJ432741__SS-prME
accagccugugccucaugaugaugcugcccgccacccuugcuuuccaccugacgucccgggacggcgagccucggaugaucguggggaagaacgaacgcggaaagucucuccuguuuaagaccgccagcggcauuaauauguguacacuuaucgcgauggaucugggggagaugugcgacgauaccgugacauacaaguguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacagaccuggaugagcgccgagggcgcuuggcggcaggucgaaaagguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaagcccacgcucgacaucgagcugcagaagaccgaagcuacacagcuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggugaccugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccucgcaccggacuugauuucaaugagaugauccugcucacgaugaaaaacaaggcuuggaugguccacagacagugguuuuucgaccugccccuuccguggaccagcggcgccacaaccgagacaccuaccuggaaucggaaagaacugcucgugacguuuaagaacgcccaugcuaaaaagcaagagguugugguccuggggucucaggaaggagcgaugcacacagcccugaccggcgcuacagagauucaaaauuccgggggcaccagcaucuucgccggacaccucaagugucgccugaaaauggauaaacuugaacugaaaggcaugucuuacgccaugugccucaacaccuuugugcugaagaaagagguuuccgagacacagcaugggacgauucugaucaagguggaauacaagggagaggacgcucccuguaaaaucccuuucagcaccgaagauggccaagggaaggcccacaacggaagacuuauuacagcgaaucccgucguggcuaaaaaggaggagcccgugaacaucgaagccgagccuccguucggcgaauccaauauuguuaucgggauuggcgacaaagcccucaagaucaacugguauaagaaaggaucuagcaucggcaagauguuugaggcuaccgccagaggggcuagacgcauggccauucugggagauacagcgugggacuucggcuccgucgggggagugcugaauagccucggcaaaauggugcaucagaucuuugggucugccuacaccgcucuguucuccggcgucagcuggauuaugaagaucggaauuggcgugcuucugacguggaucgggcucaacucuaaaaauacaagcauguccuuuucuugcauuguuaucggaaucauuacccuguaucugggcgccgugguccaggcugauauggggugugccaucaacuggaagggaaaggaacuuaaaugcggcagcgggauuuucgugaccaaugagguucacacauggaccgagcaguacaaguuucaagcggacucccccaaacggcucgccacagcuaucgccggcgcuugggaaaacggaguguguggcauuagaagcacgacccgcauggagaaucugcuguggaagcagaucgccaacgaacucaauuauauccugugggagaacaauauuaaacuuacagucgugguuggggauaucauuggagugcuggaacagggcaagcggacccucacaccucagcccauggagcugaaauacucuuggaagaccugggggaaggccaaaaucgucacggcugagacccaaaacuccagcuucauuaucgacggaccuaacacacccgaaugcccgucugcguccagagccuggaaugugugggagguggaagacuauggcuuuggcgucuucaccacaaacaucuggcugaaacuucgcgagguucauacccagagcugugaucaccggcucauguccgcugccauuaaagacgaaagagccgugcacgcugauaugggguacuggaucgagucucagaagaauggaagcuggaaacuggagaaggccuccuuuauugaagugaagacaugcaccuggccuaaaucucauacgcuguggagcaacggcguccucgaguccgacauggugauccccaagagccuggcggggccuauuucucagcacaaucaucgccccggauaccacacacaaaccgcuggcccuuggcaccuugggaaacuggaacucgauuucaacuauugcgagggaaccacaguugugaucaccgagaauuguggcacgcggggccccucccugagaacaaccacagucagcgggaagcugauccaugaauggugcugucgcucuugcacccuuccgccucuccgguacaugggagaggacggcuguugguaugggauggaaauuagacccaucaacgagaaagaagagaauauggugaagucccugguuagcgccggaucuggcaagguggauaacuuuacaauggggguccugugccucgccauucuguucgaggaagugaugcggggaaaauucggcaagaaacacaugaucgcuggcguucuuuuuaccuucgugcugcuccugagcgggcagauuacguggcgcgacauggcccauacccugaucaugauuggauccaaugcgagcgauagaaugggcaugggggucacauaccuugcucugaucgccaccuuuaagauccagcccuuccucgcccugggauuuuuccuccggaaacugacaucuagagagaaccuucugcucggcguggggcuggcuauggccaccacgcugcaacuuccugaagacauugagcagauggcuaauggaaucgcccugggccucaugacacugaagcucauuacccaguuugaaacauaucagcuguggaccgcgcuugugucccugaccuguagcaacacaaucuucacgcucaccgucgccuggcgcacagcuacccugauucuggccggcguuucccuucugccgcucugccaaucuagcuccaugcggaagacagauuggcugcccaugaccguggcugccaugggggugccuccccucccucuguuuaucuucucucuuaaagacacgcccaagagacgcagcuggccucugaaugagggagucauggccgugggccugguuuccauccucgcuucuagccugcuuagaaacgaugugcccauggcggggccgcuggucgccggaggccuccugauugcuuguuacgugaucacagggaccuccgccgaccucaccguugagaaagccgcugacgugacaugggaagaggaagccgagcagaccggagucagccacaaccugaugauuacaguggaugacgauggcacgaugcggaucaaggacgaugaaaccgagaauauucuuacaguccugcugaaaaccgcgcuccugaucgugucuggcaucuuuccuuauuccauucccgcuacacuucugguuuggcauaccuggcagaagcagacgcaacgcagcggggugcucugggacgucccuucucccccggagacccagaaagccgaacuggaggaaggaguguacagaaucaagcagcagggcauuuucgggaagacacaaguuggagugggcguccagaaagaggggguguuucacaccauguggcacgugacacggggagccguucucacccauaacggcaagcgccuggagccuaauugggcuuccgucaaaaaggaucuuaucagcuacggcgggggauggagacugucugcccaguggcaaaaaggcgaagagguccaggugauugcggucgaacccgggaagaacccuaagaauuuccagacaaugcccggaaucuuccagacgaccacaggcgagauuggggcuaucgcccuggacuuuaaacccggaaccuccggcagcccuaucauuaaccgggaaggcaaggugguugggcucuauggaaauggcguggucaccaaaaacgggggauacguguccggcaucgcccaaacaaaugcugagccggaugggcccacgccugagcuggaagaggaaguuuucaagaaacgcaaccuuaccauuauggaccugcaccccggcagcggaaagacaagaaaguaucucccugccaucgugcgggaggcuauuaaacgcagacugcggacccucauccuggcccccacaagagucguggcggccgaaauggaggaggcucuuaagggccugccuauccgcuaccagaccacggccacaaaaucugaacauaccgggcgggagauuguugaucugaugugccacgcuaccuuuacaaugagacuccugagcccggugcgcguccccaauuauaaccuuaucauuauggacgaagcccauuucaccgauccugccuccaucgcugcgcggggauacauuucuacaagagugggcaugggggaggccgcugccaucuuuaugaccgccacgcccccuggaacagcugaagccuucccccagagcaaugcgccgauccaggacgaggagcgcgacauuccugaacgguccuggaacucuggcaaugaguggaucaccgauuuuguggggaagacagucugguucguucccagcauuaaagcuggcaacgacaucgccaacugucugagaaagaauggaaagaaagugauucaacucucccgcaagaccuuugauacggaauaucagaaaacccggcugaacgacugggauuucguggucacaaccgacaucucugagaugggcgccaauuuuaaggcugauagagugauugacccccggcgcugccugaaaccuguuauccucacagaugggcccgagagagugauccuugccggaccuaugccggucaccgcggccagcgcugcccagcggcgcggcagaguggggcggaacccccagaaggaaaaugaccaauacauuuucacaggacagccucugaacaaugaugaggaccacgcucacuggaccgaagccaagaugcugcucgacaacaucaauacgcccgagggcauuaucccugcucuguucgaacccgagagagagaaauccgccgcgauugauggggaauaccgccuuaagggcgagagccggaaaacauuuguugaacugaugagacgcggagaccucccgguguggcuggcccauaaggucgcuucugagggcaucaaauauaccgaucggaaguggugcuucgacggggaaagaaacaaucagauccuggaggagaacauggauguggaaauuuggaccaaagagggagaacgcaagaagcuccggccuagauggcuugacgcccgcacauacuccgauccccuggcucugaaagaguuuaaggacuucgccgccggcagaaaaagcaucgcucucgaucuggucaccgaaauugggcgggugccuucucaccuugcguaucgcacaagaaaugcccuggacaaccucguuaugcugcauacguccgagcacggaggccgggcuuaccgccacgccguggaggaacugcccgagaccauggaaacacuccuucugcugggccucaugauccugcuuaccgggggagccaugcuguuucucauuagcggcaaggggaucggaaaaacauccaucggccugauuugugugaucgucucuagcgggaugcuguggauggcugauguuccucuccaguggauugccuccgcgaucauucuugaguucuuuaugauggugcugcugauccccgagccggaaaagcaaagaaccccucaggacaaucagcucgccuauguggucauuggaauccugacgcuugcugccaucguggcugccaacgagaugggccugcucgaaaccacaaagcgggaucugggcaugagcaaagagcccgggguugugucucccaccuccuaccuggacgucgaccuccauccugcgagcgccuggacacuuuaugcuguggccaccacggucauuacaccgaugcugagacacaccaucgaaaauucuacagcuaacgugagccuggccgcuauugccaaccaagcgguugugcucaugggacuggauaagggcuggcccaucuccaaaauggaccuuggggucccucugcucgcccugggaugcuacucucaggugaauccccugacccucaccgcugccguucuucugcuggugacacauuacgcuauuaucggcccugggcuccaggccaaggccacgcgcgaggcgcagaaacggaccgcugccggaaucaugaagaaccccacagucgauggcauuaugaccaucgaccuggauccugugauuuaugacagcaaguucgagaaacaacuuggccaggugaugcugcucguucugugugcuguccagcugcuccuuaugagaacauccugggcccugugcgaagcccugacccucgcuacggggccgaucacaacccugugggagggaucucccggcaaguuuuggaauaccacaauugccgugagcauggcgaacaucuuccgcggguccuaccuugccggagcuggccuggccuuuagcaucaugaaaucuguggggaccggacggagaggcacaggcucccagggggaaacgcucggagagaaguggaaaaagaagcugaaucaacugagccggaaagaguucgaucucuauaagaaauccggcauuaccgaggucgaccgcacagaggcuaaggaagggcuuaaaagaggagagaccacacaccaugccguuucucggggcagcgcgaagcugcagugguuuguggaacgcaacauggugaucccugaggggagagucauugaucugggauguggccggggcgggugguccuacuauugcgccggacucaaaaaggugaccgaaguucgcggcuacacgaaaggcgggcccgggcacgaggagccugugcccaugucuaccuauggguggaaucuggucaaacuuaugagcggaaaggacguguucuaccugccgccugaaaaaugugauacacuccugugcgacaucggcgaguccagccccucucccaccguugaagaguccagaacaauucgggugcugaagauggucgagccuuggcucaaaaacaaucaguucuguaucaaggugcuuaaccccuacaugccuaccgugauugaacaccuggagcgccugcagagaaaguauggcgggaugcucguccggaauccgcugagcagaaacucuacacaugaaauguacuggaucuccaauggaaccggcaacaucguuagcucugugaauauggugagccgccuucugcucaaccgguuuacgaugacacacagacgccccaccauugagaaagaugucgaccugggggcuggaacccggcaugugaacgccgaaccugagacacccaauauggacguuaucggcgagagaauuaagcgcaucaaagaagaacacuccucuacguggcacuaugaugacgaaaacccuuacaagaccugggcuuaucaugggagcuacgaggugaaagccacaggauccgcuagcuccaugauuaauggcgucgugaagcugcucaccaagcccugggauguugugccgauggucacacaaauggccaugaccgacacaaccccuuucggccagcagcggguguuuaaagaaaagguugauacgagaacaccccgcccuaugcccgggacacggaaagugauggagaucaccgcggaguggcuguggagaacacuuggacgcaacaagaaaccucggcugugcaccagagaagaguucacgaagaagguccgcacaaaugccgcuaugggcgccguguuuaccgaagagaaccaaugggacucugcuagagccgccgucgaagaugaggaguucuggaaacucguggaccgggaacgcaagcugcacaaacuugggaaguguggaagcugcguuuauaauaugaugggcaaaagagagaagaaacugggggaauuuggcaaggcgaagggaucccgggcuaucugguacauguggcucggcgccagauaccuggaguucgaggcccugggguuucucaacgaagaucauugguucucucgggagaauagcuauuccggaguggaaggcgaggggcugcacaaacuuggauacauucugcgcgacaucucuaagauucccggcggggcuauguaugccgaugacacagcuggcugggacaccagaaucacggaagaugaccuccauaacgaggagaaaauuacccagcagauggauccggaacaccggcagcuggccaaugcgaucuuuaaacuuacauaccaaaacaaagucgugaaggugcagcgcccuacccccaagggaacaguuauggacaucauuagcagaaaagaucagcggggcuccggacaggugggaaccuauggccugaauacauucaccaacauggaggcccaacucguccgccagauggaaggggagggagugcugagcaaggcugaccuggaaaauccccaccuccuggagaaaaagaucacgcaguggcuugagacaaaaggcguugaaagacugaagcggauggccauuucuggggaugacugcguggucaagccuaucgaugaccgcuuugcuaacgcccuccuggcgcuuaacgauaugggcaaagugagaaaggacauuccgcaguggcaacccuccaaaggauggcaugauuggcagcaggucccuuucuguagccaccauuuccacgagcugaucaugaaggacggccggaaacucgugguucccugccgcccucaggacgaacugaucgggagagcccggauuucucaaggagcuggcuggucccugaaggagaccgccugucucgggaaggcuuacgcccagauguggagccugauguauuuucaccgcagagaucuucggcuggcuucuaaugccaucugcuccgcggugcccguccauuggauuccuaccagcagaacaaccugguccauccacgcccaucaccaguggaugacaacggaagacaugcucaccguguggaaccgcguuuggauugaggauaaucccuggauggaggacaaaacaccggugaccacaugggaagaugucccuuaccugggaaagcgggaggaccaaugguguggcagccuuaucgggcugaccucuagagcuacgugggcccagaacauucucaccgccauccaacaggugcgcagccugaucggcgaugaagaguuccuggacuacaugcccuccaugaaacgguuuagaaaggaggaagagucugaaggagcuauuugguga

SEQ ID NO: 20849 - RNA, 9873 nt, Artificial Sequence
  derived and/or modified CDS sequence (opt5) from DENV-3__FJ562099__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacaaaccuggaugagcgccgagggcgcuuggcggcagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaaacccacgcucgacaucgagcugcagaagaccgaagcuacacaacuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggucaccugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccucgcaccggacuugauuucaaugagaugauccugcucacgaugaaaaacaaggcuuggaugguccacagacagugguuuuucgaccugccccuuccguggaccagcggcgccacaaccgagacaccuaccuggaaucggaaagaacugcucgugacguuuaagaacgcccaugcuaaaaagcaagagguugugguccuggggucucaggaaggagcgaugcacacagcccugaccggcgcuacagagauucagaauuccgggggcaccagcaucuucgccggacaccucaagugucgccugaaaauggauaagcuugaacugaaaggcaugucuuacgccaugugccucaacaccuuugugcugaagaaagagguuuccgagacacagcaugggacgauucugaucaagguggaauacaagggagaggacgcucccuguaaaaucccuuucagcaccgaagauggccaagggaaggcccacaacggaagacuuauuacagcgaaucccgucgugaccaaaaaggaggagcccgugaacaucgaagcugagccuccguucggcgaauccaauauuguuaucgggauuggcgacaaagcccucaagaucaacugguauaagaaaggaucuagcaucggcaagauguuugaggccacagcucggggggccagacgcauggcuauucugggagauaccgccugggacuucggcuccgucgggggagugcugaauagccucggcaaaauggugcaucagaucuuugggucugcguacacggcccuguucuccggcgucagcuggauuaugaagaucggaauuggcgugcuucugacauggaucgggcucaacucuaaaaauaccagcauguccuuuucuugcauuguuaucggaaucauuacccuguaucugggcgcugugguccaggccgauauggggugugugaucaacuggaagggaaaggaacuuaaaugcggcagcgggauuuucguuacaaaugaggugcacaccuggacagagcaguacaaguuucaagcugacucccccaaacggcucgccacggcgaucgccggcgcuugggaaaacggagucuguggcauuagaagcaccacacgcauggagaaucugcuguggaagcagaucgccaacgaacucaauuauauccugugggagaacaauauuaaacuuaccgugguugugggggauaucauuggaguccuggaacagggcaagcggacacucaccccucagcccauggagcugaaauacucuuggaagacgugggggaaggcuaaaaucgugaccgccgagacacaaaacuccagcuucauuaucgacggaccuaacacccccgaaugcccgucugccuccagagcuuggaaugugugggaggucgaagacuauggcuuuggcguuuucacaaccaacaucuggcugaagcuucgcgagguguacacacagagcugugaucaucggcucauguccgcggccauuaaagacgaaagagcugugcacgccgauaugggguacuggaucgagucucagaagaauggaagcuggaaacuggagaaggccuccuuuauugaagucaagaccugcacguggccuaaaucucacacacuguggagcaacggcgugcucgaguccgacaugaucauucccaagagccuggcugggccuaucucucagcauaaucaccgccccggauaucauacccaaaccgccggcccuuggcaccuugggaaacuggaacucgauuucaacuacugcgagggaacaaccguugugaucacggagaauuguggcacacggggccccucccugagaaccacaaccgucagcgggaagcugauucacgaauggugcugucgcucuugcacacuuccgccucuccgguauaugggagaggacggcuguugguacgggauggaaaucagacccauuaacgagaaagaagagaauauggugaagucccugguuagcgcgggaucuggcaagguggauaacuuuaccauggggguccugugccucgcuauccuguucgaggaagugaugcggggaaaauucggcaagaaacauaugauugccggcguucuuuuuacguucgugcugcuccugagcgggcagaucaccuggcgcgacauggcccacacacugauuaugaucggauccaaugcuagcgauagaaugggcaugggggucaccuaucuugcccugaucgcgacauuuaagauucagcccuuccucgcucugggauuuuuccuccggaaacugaccucuagagagaaccuucugcucggcguggggcuggccauggccacgacacugcaacuuccugaagacaucgagcagauggcuaauggaauugcccugggccucaugacccugaagcucaucacacaguuugaaaccuaccagcuguggaccgcucuugugucccugacauguagcaacacgauuuucacccucacagucgccuggcgcaccgcgacacugauccuggccggcguuucccuucugccgcucugccaaucuagcuccaugcggaagaccgauuggcugcccaugacgguggcugccaugggggugccuccccucccucuguuuaucuucucucuuaaagacacacccaagagacgcagcuggccucugaaugagggagucauggcugugggccugguuuccauucucgccucuagccugcuuagaaacgaugugcccauggccgggccgcuggucgcuggaggccuccugaucgcguguuaugugauuaccgggaccuccgccgaccucacaguugagaaagcugccgacgugaccugggaagaggaagccgagcagacaggagucagccauaaccugaugaucacgguggaugacgauggcaccaugcggauuaaggacgaugaaacagagaauauccuuaccguccugcugaaaacagcucuccugaucgugucuggcguuuuuccuuacuccauucccgccacccuucugguguggcacacguggcagaagcagacccaacgcagcgggguccucugggacgugccuucucccccggagacacagaaagcggaacuggaggaaggaguuuacagaaucaagcagcagggcauuuucgggaagacccaagugggagucggcgugcagaaagaggggguguuucauacaauguggcacguuacccggggagcuguccucacacacaacggcaagcgccuggagccuaauugggccuccgugaaaaaggaucuuaucagcuauggcgggggauggagacugucugcccaguggcaaaaaggcgaagaggugcaggucauugcuguggaacccgggaagaacccuaagaauuuccagacgaugcccggaaucuuccagaccacaaccggcgagauuggggccaucgcgcuggacuuuaaacccggaaccuccggcagcccuaucauuaaccgggaaggcaagguuguggggcucuacggaaauggcgucgugacaaaaaacgggggauauguuuccggcaucgcucaaacgaaugccgagccggaugggcccaccccugagcuggaagaggaaauguucaagaaacgcaaccuuacaauuauggaccugcaucccggcagcggaaagaccagaaaguaccucccugccaucgugcgggaggcuauuaaacgcagacugcggacacucauccuggcccccaccagagucguggcugccgaaauggaggaggcgcuuaagggccugccuauccgcuaucagacgacagccaccaaaucugaacacaccgggcgggagauuguugaucugaugugccaugcuacauuuaccaugagacuccugagcccggugcgcguccccaauuacaaccuuaucauuauggacgaagcccacuucacagauccugcuuccaucgccgcccggggauauauuucuaccagagugggcaugggggaggcugcggccaucuuuaugacggcuacacccccuggaaccgccgaagccuucccccagagcaaugcuccgauccaggacgaggagcgcgacauuccugaacgguccuggaacucuggcaaugaguggaucacagauuuuguggggaagaccgucugguucguucccagcauuaaagccggcaacgacaucgcgaacugucugagaaagaauggaaagaaagugauucaacucucccgcaagacguuugauaccgaauaccagaaaacaaagcugaacgacugggauuucguggucaccacagacaucucugagaugggcgcuaauuuuaaagccgaucgggugauugaccccagacggugccugaagccuguuauccucaccgaugggcccgagcgcgugauccuugccggaccuaugccggucacagcugccagcgcggcccagagacggggccgcguggggagaaacccccagaaggaaaaugaccaauacauuuucaccggacagccucugaacaaugaugaggaccaugcucacuggacggaagccaaaaugcugcucgacaacaucaauacacccgagggcauuaucccugcucuguucgaacccgagcgggagaaguccgccgcuauugauggggaauauagacuuaaaggcgagagccgcaagaccuuuguugaacugaugcggagaggagaccucccgguguggcuggcccacaaagucgcgucugagggcaucaaguacaccgaucgcaaauggugcuucgacggggaacggaacaaucagauccuggaggagaacauggauguggaaauuuggacaaaggagggagaaagaaagaaacuccgcccucgguggcuugacgccagaaccuauuccgauccccuggcucugaaggaguuuaaagacuucgccgcuggccgcaagagcaucgcccucgaucuggucacagaaauugggagagugccuucucaucuugccuaccggacgcgcaaugcucuggacaaccucguuaugcugcacaccuccgagcauggaggcagagcguaucggcacgccguggaggaacugcccgagacaauggaaacccuccuucugcugggccucaugauccugcuuacagggggagcuaugcuguuucucauuagcggcaaagggaucggaaagaccuccaucggccugauuugugugaucgucucuagcgggaugcuguggauggccgauguuccucuccaguggauugccuccgcuaucgugcuugaguucuuuaugauggugcugcugauucccgagccggaaaagcaacgcacgccucaggacaaucagcucgccuacgucgugaucggaauucugacccuugcggccaucguugcugccaacgagaugggccugcucgaaacaaccaaaagagaucugggcaugagcaaggagcccgggguggucucucccacauccuaucuggacguggaccuccacccugcuagcgccuggacccuuuacgcggucgccacgacagugaucaccccgaugcugcggcauacaauugaaaauucuaccgcuaacguuagccuggccgcuaucgccaaccaagcugugguccucaugggacuggauaaaggcuggcccauuuccaagauggaccuuggggugccucugcucgcccugggaugcuacucucagguuaauccccugacccucacagcggccgugcuucugcuggucacgcacuaugcuaucauuggcccugggcuccaggccaaagcuaccagagaggcccagaagcgcacagccgcgggaaucaugaagaaccccaccguggauggcaucaugacaauugaccuggauccugugaucuacgacagcaaauucgagaagcaacuuggccagguuaugcugcucguccugugugcugugcagcugcuccuuaugcggaccuccugggcccugugcgaagcucugacgcucgccacagggccgauuaccacccugugggagggaucucccggcaaauuuuggaauacaaccaucgccgugagcauggcuaacauuuucagaggguccuaucuugccggagcgggccuggccuuuagcaucaugaagucugucgggacaggacgccggggcacgggcucccagggggaaacccucggagagaaauggaagaagaaacugaaucaacugagcagaaaggaauucgaucucuacaaaaaguccggcaucacagagguugaccggaccgaggcuaaagaagggcuuaagcgcggagagacaacccaucacgccgugucuagaggcagcgcuaaacugcagugguuuguggaacggaacauggucauuccugaggggcgcgugaucgaucugggauguggcagaggcgggugguccuauuacugcgccggacucaagaagguuacggaagugcggggcuauaccaaagggggacccggccaugaggagccuguccccaugucuacauacggguggaauauugugaagcugaugagcggaaaagacguuuucuaccuuccgccugaaaagugugauacccugcucugcgacaucggcgaguccagccccucucccacaguggaagagucccgcaccauuagaguccugaaaaugguggagccuuggcugaagaacaaucaguucuguaucaaggugcucaaccccuauaugccuacagucauugaacaccuugagcggcugcagcgcaaauacggcgggaugcugguuagaaauccgcucagccggaacucuacccacgaaauguauuggaucuccaauggaacgggcaacaucgugagcucugugaauauggucagcagacugcuucugaaccgcuuuacaaugacccaucggagacccaccauugagaaggauguggaccucggggcgggaacacgccacguuaacgccgaaccugagacgcccaauauggacgugaucggcgagcggauuaaaagaaucaaggaagagcauuccucuaccuggcacuacgaugacgaaaacccuuauaaaacaugggcuuaccacgggagcuaugaggucaaggccaccggauccgcuagcuccaugauuaauggcgugguuaagcugcugacaaaacccugggauguggucccgauggugacccaaauggccaugacagacaccacgccuuucggccagcagcgcguuuuuaaggaaaaaguggauacccggacacccagaccuaugcccgggacccgcaaggucauggagaucacagcugaguggcucuggcggacccugggaagaaacaaaaagccucgccuuugcacgcgggaagaguucacaaagaaagugagaaccaaugccgcgaugggcgccgucuuuacagaagagaaccaaugggacucugcucgcgccgcuguggaagaugaggaguucuggaagcugguugacagagaacgggagcuccauaaacuggggaaguguggaagcugcguguacaauaugaugggcaaacgcgaaaagaaacuuggggaguuuggcaaggccaagggauccagagccaucugguacauguggcugggcgcgcgguaucucgaguucgaagcucugggguuucugaacgaggaucacugguucucuagagaaaauagcuacuccggagucgagggcgaagggcuccauaaacugggauauauucuucgggacaucucuaagauucccggcggggccauguacgccgaugacaccgcuggcugggacacgcgcaucaccgaggaugaccugcacaacgaggaaaaaauuacacagcagauggauccggagcauagacagcucgccaaugcuaucuuuaagcugaccuaucaaaacaaaguggugaagguucagcggccuacacccaagggaaccgugauggacaucauuagccgcaaagaucagagaggcuccgggcaggucggaacauacggccuuaauaccuucacgaacauggaagcccaacuggugcggcagauggagggggaaggaguucucagcaaggcggaccuggagaauccccaccugcucgagaaaaagaucacacaguggcuggaaaccaaaggcguggagcgccuuaagagaauggccauuucuggggaugacugcgucgugaagccuaucgaugaccgguuugcuaacgcccugcucgcucugaacgauaugggcaaaguccgcaaggacauuccgcaguggcaacccuccaaaggauggcacgauuggcagcaggugccuuucuguagccaucacuuccaugaacuuaucaugaaggacggcagaaaacugguugugcccugccggccucaggacgagcucaucgggcgcgccagaauuucucaaggagcgggcuggucccugaaggaaaccgccugucuggggaaggcuuaugcccagauguggagccucauguacuuucaccggcgcgaucugagacuugcuucuaaugccaucugcuccgcuguccccgugcacuggauuccuacaagccggaccacaugguccauccaugcccaccaucaguggaugacgaccgaggacaugcugacaguuuggaacagaguguggauugaggauaaucccuggauggaagacaaaaccccggucacaaccugggaggaugugccuuaccucggaaagcgcgaagaccaaugguguggcagccugaucgggcuuacgucucgggcgaccugggcccagaacauucugacagcuauccagcaggugagaagccucaucggcgaugaggaguuccuggacuauaugcccuccaugaaacgcuuucggaaggaagaggaaucugagggagccauuugguga

SEQ ID NO: 20850 - RNA, 9873 nt, Artificial Sequence
  derived and/or modified CDS sequence (opt5) from DENV-3__KF955457__SS-prME
accagccugugccucaugaugaugcugcccgccacacuugcuuuccaccugacgucccgggacggcgagccucggaugaucguggggaagaaugaacgcggaaagucucuccuguuuaagaccgccagcggcauuaauauguguacacuuaucgcgauggaucugggggagaugugcgacgauaccgucacauacaaguguccgcucauugcugaaguugagcccgaagacaucgauugcugguguaaccugaccuccacaugggugaccuauggaacgugcaaucaggccggcgagcaucggcgggacaagcgcucuguggcccuggcuccucacgucgggaugggacucgauaccagaacacagaccuggaugagcgccgagggcgcuuggagacagguggaaaagguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaagcccacgcucgacaucgagcugcagaagaccgaagcuacacaacuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggucacaugcgccaaguuucaaugucucgagcccauugagggcaaagugguucaguaugaaaaucugaaguacacagugaucaucaccguccacacaggggaccagcaucaggugggaaacgacacgcaaggcgcuaccguugagauuacaccucaggccucuaccguggaagcuguccugcccgaguauggcacacucgggcuggaaugcuccccucgcaccggacuugauuucaaugagaugauccugcucacgaugaaaaacaaggccuggauggugcacagacagugguuuuucgaccugccccuuccguggaccagcggcgccacaaccgagacaccuaccuggaaucggaaagaacugcucgucacguuuaagaacgcucaugcgaaaaagcaagaggugguugugcuggggucucaggaaggagccaugcacacagcucugaccggcgccacagagauucagaauagcgggggcaccagcaucuucgccggacaccucaagugucgccugaaaauggauaaacuugaacugaaaggcaugucuuacgcuaugugccucaacaccuuuguccugaagaaagagguguccgagacacagcaugggacgauucugaucaagguugaauacaagggagaggacgcccccuguaaaaucccuuucagcaccgaagauggccaagggaaggcgcacaacggaagacuuauuacagcuaaucccguggucaccaaaaaggaggagcccgugaacaucgaagccgagccuccguucggcgaauccaauauugugaucgggauuggcgacaaagcccucaagaucaacugguauaagaaaggaucuagcaucggcaagauguuugaggcuacagccagaggggcuagacgcauggccauucugggagauaccgcgugggacuucggcuccguugggggaguccugaauagccucggcaaaauggugcaucagaucuuugggucugccuacacggcucuguucuccggcgugagcuggauuaugaagaucggaauuggcguccuucugacauggaucgggcucaacucuaaaaauaccagcauguccuuuucuugcauugugaucggaaucauuacccuguaucugggcgccguugugcaggcugauauggggugugccaucaacuggaagggaaaggaacuuaaaugcggcagcgggauuuucgucacaaaugaggugcacaccuggacagagcaguacaaguuucaagcggacucccccaaacggcucgccacggcuaucgccggcgcuugggaaaacggaguuuguggcauuagaagcaccacacgcauggagaaucugcuguggaagcagaucgccaacgaacucaauuauauccugugggagaacaauauuaaacuuaccguggucgugggggauaucauuggaguucuggaacagggcaagcggacacucaccccucagcccauggagcugaaauacucuuggaagacgugggggaaggccaaaaucgugaccgcugagacacaaaacuucuccuuuauuaucgacggaccuaacacccccgaaugcccgagcgcgucuagagccuggaaugucugggagguggaagacuauggcuucggcguguuuacaaccaacaucuggcugaaacuucgcgaggucuacacacaguccugugaucaucggcucaugagcgcugccauuaaagacgaaagagccguucacgcugauaugggguacuggaucgagucccagaagaauggaucuuggaaacuggagaaggccagcuucauugaagugaagaccugcacguggccuaaaucccacacacuguggucuaacggcgugcucgagagcgacaugaucauucccaagucccuggcggggccuaucagccagcauaaucaccgccccggauaucauacccaaaccgcuggcccuuggcaccuugggaaacuggaacucgauuuuaacuacugcgagggaacaaccgucgugaucacggaggacuguggcacacggggccccucucugagaaccacaaccguuuccgggaagcugauucacgaauggugcugucgcagcugcacacuuccgccucuccgguauaugggagaggauggcuguugguacgggauggaaaucagacccauuaaugagaaagaagagaacauggugaagucucuggucuccgccggaagcggcaagguggacaauuucaccauggggguucugugccucgccauccuguucgaggaagugaugcggggaaaauuuggcaagaaacauaugauugcuggcguccuuuucacguuugugcugcuccugucugggcagaucaccuggcgcgauauggcccacacacugauuaugaucggaagcaacgcguccgacagaaugggcauggggguuaccuaucuugcucugaucgccacauucaagauucagcccuuucucgcccugggauucuuucuccggaaacugaccagcagagagaaucuucugcucggcguggggcuggcuauggccacgacacugcaacuuccugaagauaucgagcagauggcuaacggaauugcccugggccucaugacccugaagcucaucacacaguucgaaaccuaccagcuguggaccgcgcuugucucucugacauguuccaauacgauuuuuacccucacaguggccuggcgcaccgcuacacugauccuggccggcgugagccuucugccgcucugccaauccucuagcaugcggaagaccgacuggcugcccaugacggucgcugccauggggguuccuccccucccucuguucaucuuuucccuuaaagauacacccaagagacgcucuuggccucugaacgagggagugauggccgugggccuggucagcauucucgcuuccucucugcuuagaaaugacgugcccauggcggggccgcugguugccggaggccuccugaucgcuuguuaugugauuaccgggaccagcgccgaccucacagucgagaaagccgcugaugugaccugggaagaggaagccgagcagacaggaguuucccauaaccugaugaucacgguggacgaugacggcaccaugcggauuaaggaugacgaaacagagaacauccuuaccguccugcugaaaacagcgcuccugaucgugagcggcauuuucccuuacucuauccccgcuacccuucuggucuggcacacguggcagaagcagacccaacgcuccggggugcucugggauguuccuucucccccggagacacagaaagccgaacuggaggaaggaguguacagaauuaagcagcagggcaucuuugggaagacccaagucggagugggcguucagaaagaggggguguuccauacaauguggcacgucacccggggagccgugcucacacacaauggcaagcgccuggagccuaacugggcuuccgugaaaaaggaccuuauuuccuauggcgggggauggagacugagcgcccaguggcaaaaaggcgaagagguucaggucaucgcgguggaacccgggaagaauccuaagaacuuccagacgaugcccggaauuuuucagaccacaaccggcgagaucggggcuaucgcccuggauuucaaacccggaaccucuggcuccccuauuaucaaucgggaaggcaagguggucgggcucuacggaaacggcgugguuaccaagaaugggggauaugugagcggcauugcccaaacgaacgcugagccggacgggcccaccccugagcuggaagaggaaauguuuaagaaacgcaaucuuacaaucauggaucugcaucccggcuccggaaagaccagaaaguaccucccugccauuguccgggaggcuaucaaacgcagacugcggacacucauccuggcccccaccagagugguugcggccgaaauggaggaggcucuuaagggccugccuauucgcuaucagacgacagccaccaaaagcgaacacaccgggcgggagaucguggaccugaugugccaugcuacauucaccaugagacuccugucuccgguccgcgugcccaacuacaaucuuauuaucauggaugaagcccacuuuacagacccugccagcauugcugcgcggggauauaucuccaccagaguuggcaugggggaggccgcugccaucuucaugacggccacacccccuggaaccgcugaagccuuuccccagucuaacgcgccgauucaggacgaggagcgcgauaucccugaacggagcuggaacuccggcaacgaguggauuacagacuucguggggaagaccgucugguuugugcccucuaucaaagcuggcaaugauauugccaacugucugagaaagaacggaaagaaagugauccaacucagccgcaagacguucgacaccgaauaccagaaaacacggcugaaugauugggacuuugucguuaccacagauauuuccgagaugggcgccaacuucaaggcugacagagugaucgauccccggcgcugccugaaaccugugauccucaccgacgggcccgagagagucauucuugccggaccuaugccggugacagcggccucugcugcccagcggcgcggcagaguugggcggaauccccagaaggaaaacgaucaauacaucuucaccggacagccucugaauaacgacgaggaccaugcucacuggacggaagccaagaugcugcucgauaauauuaacacacccgagggcaucauuccugcucuguuugaacccgagagagagaaaagcgccgcgaucgacggggaauaucgccuuaagggcgagucccggaaaaccuucguggaacugaugagacgcggagaucucccggucuggcuggcccacaagguggcuagcgagggcaucaaauacaccgaccggaaguggugcuuugauggggaaagaaauaaccagauucuggaggagaauauggacguugaaaucuggacaaaagagggagaacgcaagaagcuccggccuagauggcuugaugcccgcaccuauucugacccccuggcucugaaagaguucaaggauuuugccgccggcagaaaauccauugcucucgaccuggugacagaaaucgggcgggucccuagccaucuugcguaccgcacgagaaacgcccuggauaaucucgugaugcugcacaccucugagcauggaggccgggcuuaucgccacgccgucgaggaacugcccgagacaauggaaacccuccuucugcugggccucaugauucugcuuacagggggagccaugcuguuccucaucuccggcaaggggaucggaaaaaccagcauuggccugaucugugugauuguuuccucugggaugcuguggauggcugacgugccucuccaguggaucgccagcgcgauugugcuugaguuuuucaugaugguccugcugauccccgagccggaaaagcaaagaacgccucaggauaaccagcucgccuacguugugauuggaauccugacccuugcugccaucguggcugccaaugagaugggccugcucgaaacaaccaagcgggaccugggcauguccaaagagcccggggucgugagccccacaucuuaucuggacguugaucuccacccugcguccgccuggacccuuuacgcuguggccacgacagucauuaccccgaugcugagacauacaaucgaaaacagcaccgcuaaugugucucuggccgcuauugccaaccaagcggucgugcucaugggacuggacaagggcuggcccaucagcaaaauggaucuugggguuccucugcucgcccugggaugcuacucccaggugaacccccugacccucacagcugccguccuucugcuggugacgcacuaugcuauuaucggcccugggcuccaggccaaggccacccgcgaggcgcagaaacggacagcugccggaaucaugaagaaucccaccguugacggcauuaugacaaucgaucuggacccugugauuuacgauucuaaguuugagaaacaacuuggccaggucaugcugcucgugcugugugcugugcagcugcuccuuaugagaaccagcugggcccugugcgaagcccugacgcucgcuacagggccgaucaccacccugugggagggaucccccggcaaguucuggaacacaaccauugccguuucuauggcgaauaucuuucgcgggagcuaucuugccggagcuggccuggccuucuccaucaugaaaagcgucgggacaggacggagaggcacgggcucucagggggaaacccucggagagaaguggaaaaagaagcugaaccaacugucccggaaagaauuugaccucuacaagaaaagcggcauuacagagguggaucgcaccgaggcuaaggaagggcuuaaaagaggagagacaacccaucacgccgugucccggggcucugcgaagcugcagugguucgucgaccgcaauaugguuaucccugaagggagagugauugaucugggauguggccggggcggguggagcuauuacugcgccggacucaaaaaggugacggagguccgcggcuauaccaaaggcgggcccgggcaugaagaaccugugcccauguccacauacggguggaaccugguuaaacuuaugucuggaaaggacguguucuaccugccgccugagaaaugugauacccuccugugcgacaucggcgaaagcucccccagccccacagucgaggaaucuagaaccauucgggugcugaagaugguugagccuuggcucaaaaauaaccaguuuuguaucaaggugcuuaaucccuauaugccuacagucauugagcaccuggaacgccugcagagaaaguacggcgggaugcucgugcggaacccgcuguccagaaauagcacccacgagauguauuggaucucuaacggaacgggcaauaucguguccagcgucaacaugguuucucgccuucugcucaaucgguucacaaugacccauagacgccccaccauugaaaaagacguggaucugggggcuggaacacggcacgugaacgccgagccugaaacgcccaacauggacgucaucggcgagagaauuaagcgcaucaaagaggaacauagcuccaccuggcacuacgaugacgagaauccuuauaagacaugggcuuaccacgggucuuaugaagugaaagccaccggaagcgcuuccagcaugauuaacggcguugugaagcugcucacaaagcccugggaugucgugccgaugguuacccaaauggccaugacagacaccacgccuuuuggccagcagcggguguucaaagagaaggucgauaccagaacaccccgcccuaugcccgggacccggaaagugauggaaaucacagcggaguggcuguggagaacccuuggacgcaauaagaaaccucggcugugcacgagagaggaauuuacaaagaagguucgcaccaacgccgcuaugggcgccguguucacagaggaaaaucaaugggacuccgcuagagccgccgucgaggaugaagaguuuuggaaacucguggaccgggagcgcgaacugcauaaacuugggaaauguggaucuugcgucuacaacaugaugggcaagagagagaaaaagcugggggaguucggcaaagcgaagggaagccgggcuaucugguacauguggcucggcgccagauaucuggaguuugaggcccugggguuccucaaugaagaucacugguuuucccgggagaacucuuacagcggaguggaaggcgaggggcugcauaaacuuggauauauucugcgcgacaucuccaaaauucccggcggggcuauguacgccgacgauaccgcuggcugggacacgagaaucaccgaagaugaccuccacaaugaggagaagauuacacagcagauggauccggaacaucggcagcuggccaacgcgaucuucaaacuuaccuaucaaaauaagguugugaaaguccagcgcccuacacccaagggaaccgugauggacaucauuucuagaaaggaucagcggggcagcggacaggugggaacauacggccugaacaccuuuacgaauauggaggcccaacucguucgccagauggaaggggagggagugcuguccaaagcugaccuggaaaacccccaccuccuggagaagaaaaucacacaguggcuugagaccaagggcgucgaaagacugaaacggauggccauuagcggggaugacugcgugguuaagccuaucgaugaccgcuucgcuaaugcccuccuggcgcuuaacgauaugggcaaggugagaaaagacauuccgcaguggcaacccucuaagggauggcacgacuggcagcaggucccuuucuguucccaucacuuucaugagcugaucaugaaagauggccggaagcucgugguccccugccgcccucaggacgaacugaucgggagagcccggauuagccaaggagcuggcuggucucugaaagagaccgccugucucgggaaggcuuaugcccagauguggucccugauguacuuccaccgcagagaucuucggcuggcuagcaacgccaucugcucugcggugcccguucacuggauuccuacauccagaaccacauggagcauccaugcccaccaucaguggaugacgaccgaagacaugcucacaguguggaaucgcgucuggauugaggauaaccccuggauggaggacaagaccccggugacaaccugggaagauguuccuuaccugggaaaacgggaggaccaaugguguggcucccuuaucgggcugacgagcagagcuaccugggcccagaauauucucacagccauccaacaggugcgcucucugaucggcgaugaagaguuucuggacuauaugcccagcaugaagcgguucagaaaagaggaagaguccgaaggagcuauuugguga

SEQ ID NO: 20851 - RNA, 9873 nt, Artificial Sequence
  derived and/or modified CDS sequence (opt5) from DENV-3__FJ562100__SS-prME
accagccugugccucaugaugaugcugcccgccacccuugcuuuccaccugacgucccgggacggcgaaccucggaugaucguggggaagaacgaacgcggaaagucucuccuguuuaagaccgccagcggcauuaauauguguacacuuaucgcgauggaucugggggaaaugugcgacgauaccgucacauacaaguguccgcucauugcugaaguugagcccgaagacaucgauugcugguguaaccugaccuccacaugggugaccuauggaacgugcaaucaggccggcgagcaucggcgggacaagcgcucuguggcccuggcuccucacgucgggaugggacucgauaccagaacacagaccuggaugagcgccgagggcgcuuggagacagguggaaaagguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaaacccacgcucgacaucgagcugcagaagaccgaagcuacacagcuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggucacaugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccauccugcccgaguauggcacacucgggcuggaaugcuccccucgcaccggacuugauuucaaugagaugauucugcucacgaugaaaaacaaggcuuggauggugcacagacagugguuuuucgaccugccccuuccguggaccagcggcgccacaaccgagacaccuaccuggaaucggaaagaacugcucgucacguuuaagaacgcccaugcuaaaaagcaagaggugguugugcuggggucucaggaaggagcgaugcacacagcccugaccggcgcuacagagauccaaaauuccgggggcaccagcauuuucgccggacaccucaagugucgccugaaaauggauaaacuugaacugaaaggcaugucuuacgccaugugccucaacaccuuuguccugaagaaagagguguccgagacacagcaugggacgauccugaucaagguugaauacaagggagaggacgcucccuguaaaauuccuuucagcaccgaagauggccaagggaaggcccacaacggaagacuuaucacagcgaaucccguggucaccaaaaaggaggagcccgugaacauugaagcugagccuccguucggcgaauccaauaucgugauugggaucggcgacaaagcccucaagaucaacugguauaagaaaggaucuagcauuggcaagauguuugaggccacagcuagaggggccagacgcauggcuauccugggagauaccgccugggacuucggcuccguugggggaguccugaauagccucggcaaaauggugcaucagauuuuugggucugcguacacggcccuguucuccggcgugagcuggaucaugaagauuggaaucggcguccuucugacauggauugggcucaacucuaaaaauaccagcauguccuuuucuugcaucgugaucggaauuaucacccuguaucugggcgcuguugugcaggccgauauggggugugcuauuaacuggaagggaaaggaacuuaaaugcggcagcgggaucuucgucacaaaugaggugcacaccuggacagagcaguacaaguuucaagccgacucccccaaacggcucgcgacggccauugcuggcgccugggaaaacggaguuuguggcaucagaagcaccacacgcauggagaaucugcuguggaagcagaucgcuaacgaacucaauuauauucugugggagaacaauaucaaacuuaccguggucgugggggauauuaucggaguucuggaacagggcaagcggacacucaccccucagcccauggagcugaaauacucuuggaagacgugggggaaggccaaaauugugaccgccgagacacaaaacuccagcuucaucaucgacggaccuaacacccccgaaugcccgucugcuuccagagcguggaaugucugggagguggaagacuauggcuuuggcguguucacaaccaacauuuggcugaaacuucgcgaggucuacacacagagcugugaucaucggcucauguccgccgcuaucaaagacgaaagagccguucacgccgauaugggguacuggauugagucucagaagaauggaagcuggaaacuggagaaggcuuccuuuaucgaagugaagaccugcacguggccuaaaucucacacacuguggagcaacggcgugcucgaguccgacaugauuauccccaagagccuggccgggccuaucucucagcauaaucaccgccccggauaucauacccaaaccgcgggcccuuggcaccuugggaaacuggaacucgauuucaacuacugcgagggaacaaccgucgugauuacggagaauuguggcacacggggccccucccugagaaccacaaccguuagcgggaagcugauccacgaauggugcugucgcucuugcacacuuccgccucuccgguauaugggagaggacggcuguugguacgggauggaaauuagacccaucaacgagaaagaagagaauauggugaagucccuggucagcgcuggaucuggcaagguggauaacuuuaccauggggguucugugccucgccauucuguucgaggaagugaugcggggaaaauucggcaagaaacauaugaucgccggcguccuuuuuacguucgugcugcuccugagcgggcagauuaccuggcgcgacauggcucacacacugaucaugaucggauccaaugccagcgauagaaugggcauggggguuaccuaucuugcgcugauugcuacauuuaagauccagcccuuccucgcccugggauuuuuccuccggaaacugaccucuagagagaaccuucugcucggcguggggcuggccauggcuacgacacugcaacuuccugaagacauugagcagauggccaauggaaucgcucugggccucaugacccugaagcucauuacacaguuugaaaccuaccagcuguggaccgcccuugucucccugacauguagcaacacgaucuucacccucacaguggcguggcgcaccgccacacugauccuggcuggcgugucccuucugccgcucugccaaucuagcuccaugcggaagaccgauuggcugcccaugacggucgccgcuauggggguuccuccccucccucuguuuauuuucucucuuaaagacacacccaagagacgcagcuggccucugaaugagggagugauggccgugggccuggucuccauccucgccucuagccugcuuagaaacgaugugcccauggcugggccgcugguugcgggaggccuccugauugccuguuaugugaucaccgggaccuccgcugaccucacagucgagaaagccgccgacgugaccugggaagaggaagcugagcagacaggaguuagccauaaccugaugauuacgguggaugacgauggcaccaugcggaucaaggacgaugaaacagagaauauccuuaccguccugcugaaaacagcccuccugauugugucuggcaucuuuccuuacuccauucccgcgacccuucuggucuggcacacguggcagaagcagacccaacgcagcggggugcucugggacguuccuucucccccggagacacagaaagcugaacuggaggaaggaguguacagaaucaagcagcagggcauuuucgggaagacccaagucggagugggcguucagaaagaggggguguuucauacaauguggcacgucacccggggagccgugcucacacacaacggcaagcgccuggagccuaauugggccuccgugaaaaaggaucuuaucagcuauggcgggggauggagacugucugcucaguggcaaaaaggcgaagagguucaggucauugccguggaacccgggaagaacccuaagaauuuccagacgaugcccggaaucuuccagaccacaaccggcgagaucggggcgauugcucuggacuuuaaacccggaaccuccggcagcccuaucauuaaccgggaaggcaagguggucgggcucuacggaaauggcgugguuaccaagaacgggggauauguguccggcaucgcccaaacgaaugccgagccggaugggcccaccccugagcuggaagaggaaauguucaagaaacgcaaccuuacaauuauggaccugcaucccggcagcggaaagaccagaaaguaccucccugcuaucguccgggaggccaucaaacgcagacugcggacacucauucuggcucccaccagagugguugccgcggaaauggaggaggcccuuaagggccugccuauccgcuaucagacgacagcuaccaaaucugaacacaccgggcgggagauuguggaucugaugugccaugccacauuuaccaugagacuccugagcccgguccgcgugcccaauuacaaccuuaucauuauggacgaagcucacuucacagauccugccuccaucgccgcucggggauauaucucuaccagaguuggcaugggggaggcggccgcuauuuuuaugacggccacacccccuggaaccgccgaggcuuucccccagagcaaugccccgauccaggacgaggagcgcgacauuccugaacgguccuggaacucuggcaaugaguggaucacagauuuuguggggaagaccgucugguucgugcccagcauuaaagcgggcaacgacaucgcuaacugucugagaaagaauggaaagaaagugauucaacucucccgcaagacguuugauaccgaauaccagaaaacacggcugaacgacugggauuucgucguuaccacagacaucucugagaugggcgccaauuuuaaggccgauagagugaucgacccccggcgcugccugaaaccugugauucucaccgaugggcccgagagagucauccuugcuggaccuaugccggugacagccgcgagcgccgcucagcggcgcggcagaguugggcggaacccccagaaggaaaaugaccaauacauuuucaccggacagccucugaacaaugaugaggaccaugcccacuggacggaagcuaagaugcugcucgacaacaucaauacacccgagggcauuaucccugcccuguucgaacccgagagagagaaauccgcugccaucgauggggaauaucgccuuaagggcgagagccggaaaaccuuuguggaacugaugagacgcggagaccucccggucuggcuggcgcacaagguggccucugagggcauuaaauacaccgaucggaaguggugcuucgacggggaaagaaacaaucagauccuggaggagaacauggauguugaaauuuggacaaaagagggagaacgcaagaagcuccggccuagauggcuugacgcucgcaccuauuccgauccccuggcccugaaagaguuuaaggacuucgcugccggcagaaaaagcaucgcccucgaucuggugacagaaauugggcgggucccuucucaucuugcuuaccgcacgagaaaugcgcuggacaaccucgugaugcugcacaccuccgagcauggaggccgggccuaucgccacgcugucgaggaacugcccgagacaauggaaacccuccuucugcugggccucaugauccugcuuacagggggagccaugcuguuucucaucagcggcaaggggauuggaaaaaccuccaucggccugauuugugugacgguuucuagcgggaugcuguggauggccgaugugccucuccaguggaucgcuuccgccauugugcuugaguucuuuaugaugguccugcugauccccgagccggaaaagcaaagaaccccucaggacaaucagcucgcguacguugugauuggaauccugacacuugccgcuaucguggccgcuaacgagaugggccugcucgaaaccacaaagcgggaucugggcaugagcaaagagcccggggucgugucucccaccuccuaucuggacguugaccuccacccugccagcgcguggacgcuuuacgccguggcuacaaccgucauuacaccgaugcugagacauaccaucgaaaauucuaccgccaacgugagccuggcugccauugcuaaccaagccgucgugcucaugggacuggauaagggcuggcccaucuccaaaauggaccuugggguuccucugcucgcgcugggaugcuacucucaggugaauccccugacacucacggccgcuguccuucugcuggugacccacuaugccauuaucggcccugggcuccaggcuaaggccacacgcgaggcccagaaacggaccgcggcuggaaucaugaagaaccccacaguugauggcauuaugaccaucgaccuggauccugugauuuacgacagcaaguucgagaaacaacuuggccaggucaugcugcucgugcugugugccgugcagcugcuccuuaugagaacguccugggcucugugcgaagcccugacacucgccaccgggccgaucaccacacugugggagggaucucccggcaaguuuuggaauaccacaauugcuguuagcauggccaacaucuuccgcggguccuaucuugcgggagccggccuggcuuuuagcaucaugaaaucugucgggacgggacggagaggcaccggcucccagggggaaacacucggagagaaguggaaaaagaagcugaaucaacugagccggaaagaguucgaucucuacaagaaauccggcauuaccgagguggaccgcacagaggccaaggaagggcuuaaaagaggagagaccacgcaucacgcugugucucggggcagcgccaagcugcagugguuugucgaacgcaacaugguuaucccugaggggagagugauugaucugggauguggccggggcgggugguccuauuacugcgcgggacucaaaaaggugaccgaaguccgcggcuauacaaaaggcgggcccgggcaugaggagccugugcccaugucuaccuacggguggaaucugguuaaacuuaugagcggaaaggacguguucuaccugccgccugaaaaaugugauacacuccugugcgacaucggcgaguccagccccucucccaccgucgaagaguccagaacaauucgggugcugaagaugguugagccuuggcucaaaaacaaucaguucuguaucaaggugcuuaaccccuauaugccuaccgucauugaacaccuggagcgccugcagagaaaguacggcgggaugcucgugcggaauccgcugagcagaaacucuacgcacgaaauguauuggaucuccaauggaacaggcaacaucgugagcucugucaauaugguuagccgccuucugcucaaccgguuuaccaugacccauagacgccccacaauugagaaagauguggaccugggggccggaacgcggcacgugaacgcugaaccugagacccccaauauggacgucaucggcgagagaauuaagcgcaucaaagaagaacauuccucuacauggcacuacgaugacgaaaacccuuauaagaccugggccuaccacgggagcuaugaggugaaagcuacaggauccgccagcuccaugauuaauggcguugugaagcugcucaccaagcccugggaugucgugccgaugguuacacaaauggcuaugaccgacacgaccccuuucggccagcagcggguguuuaaagaaaaggucgauacaagaacaccccgcccuaugcccgggacacggaaagugauggagaucaccgccgaguggcuguggagaacgcuuggacgcaacaagaaaccucggcugugcacaagagaagaguucaccaagaagguucgcacaaaugcggccaugggcgcuguguuuaccgaagagaaccaaugggacucugccagagcugccgucgaagaugaggaguucuggaaacucguggaccgggaacgcgagcugcauaaacuugggaaauguggaagcugcgucuacaauaugaugggcaagagagagaagaagcugggggaguuuggcaaagccaagggaucccgggcgaucugguacauguggcucggcgcuagauaucuggaguucgaagcccugggguuucucaacgaggaucacugguucucucgggaaaauagcuacuccggaguggagggcgaagggcugcauaaacuuggauauauucugcgcgacaucucuaaaauucccggcggggccauguacgcugaugacacggccggcugggacaccagaaucacagaggaugaccuccacaacgaggaaaagauuacccagcagauggauccggagcaucggcagcuggcuaaugccaucuuuaaacuuacauaucaaaacaagguugugaaaguccagcgcccuacccccaagggaacagugauggacaucauuagcagaaaggaucagcggggcuccggacaggugggaaccuacggccugaauacguucacaaacauggaagcgcaacucguucgccagauggagggggaaggagugcugagcaaagccgaccuggagaauccccaccuccuggagaagaaaaucacccaguggcuugaaaccaagggcgucgagagacugaaacggauggcuauuucuggggaugacugcgugguuaagccuaucgaugaccgcuuugccaacgcucuccuggcccuuaacgauaugggcaaggugagaaaagacauuccgcaguggcaacccuccaagggauggcacgauuggcagcaggucccuuucuguagccaucacuuccaugaacugaucaugaaagacggccggaagcucgugguccccugccgcccucaggacgagcugaucgggagagcgcggauuucucaaggagccggcuggucccugaaagaaacagcuugucucgggaaggccuaugcucagauguggagccugauguacuuucaccgcagagaucuucggcuggccucuaaugcuaucugcuccgccgugcccguucacuggauuccuaccagcagaacaacgugguccauccaugcgcaccaucaguggaugaccacagaggacaugcucaccguguggaaccgcgucuggauugaggauaaucccuggauggaagacaagacaccggugaccacgugggaggauguuccuuaccugggaaaacgggaagaccaaugguguggcagccuuaucgggcugaccucuagagccacaugggcucagaacauucucaccgccauccaacaggugcgcagccugaucggcgaugaggaguuccuggacuauaugcccuccaugaagcgguuuagaaaagaagaggaaucugagggagccauuugguga

SEQ ID NO: 20852 - RNA, 9873 nt, Artificial Sequence
  derived and/or modified CDS sequence (opt5) from DENV-3__FJ547062__SS-prME
accucccugugccugaugaugaugcugcccgccacacuugcuuuccaccugacgucccgggacggcgaaccucggaugaucguggggaagaacgaacgcggaaagucucuccuguuuaagaccgccagcggcauuaauauguguacacuuaucgcgauggaucugggggaaaugugcgacgauaccgucacauacaaguguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucuccacgucucugacacagaagguggucaucuucauucuucugaugcucgugaccccuagcaugacaaugagauguguuggggugggaaaccgggacuuugucgaaggccuguccggggcuaccuggguggaugugguccuggagcauggaggcugcguuaccacaauggccaagaauaaacccacgcucgacaucgagcugcagaagaccgaagcuacacaacuugccacccugcgcaaacucuguauugaggggaagaucacaaacauuaccacggauagcagaugcccuacacagggagaagcgauccugccggaggaacaggaccagaauuauguguguaaacacaccuacguggaucggggcuggggcaacgggugcggacuuuucggcaaggggucucuggucacaugcgccaaguuucaaugucucgagcccauugagggaaaagugguucaguaugaaaaucugaaguacacagugaucaucaccguccacacaggcgaccagcaucagguggggaacgacacgcaaggaguuaccguggagauuacaccucaggcuuccaccgucgaagccauccugcccgaguauggcacacucggccuggaaugcagcccucgcaccgggcuugauuucaaugagaugauucugcucacgaugaaaaacaaggcuuggauggugcacagacagugguuuuucgaccugccccuuccguggaccucuggagccacaaccgagacaccuaccuggaaucggaaagaacugcucgucacguuuaagaacgcccaugcuaaaaagcaagaggugguugugcugggcucccaggaaggggcgaugcacacagcccugaccggagcuacagagauccagaauagcggcgggaccucuauuuucgccggccaccucaagugucgccugaaaauggauaaacuugaacugaaaggaauguccuacgccaugugccucaacaccuuuguccugaagaaagaggugagcgagacacagcauggcacgauccugaucaagguugaauacaagggggaggacgcucccuguaaaauuccuuucuccaccgaagauggacaaggcaaggcccacaacgggagacuuaucacagcgaaucccguggucaccaaaaaggaggagcccgugaacauugaagcugagccuccguucggagaaucuaauaucgugauuggcaucggggacaaagcccucaagaucaacugguauaagaaaggcagcuccauuggaaagauguuugaggccacagcucggggcgccagacgcauggcuauccugggggauaccgccugggacuucggaagcguuggcgggguccucaauucucucggaaaaauggugcaucagauuuuuggcuccgcguacacggcccuguucagcggggugucuuggaucaugaagauuggcaucggaguccuucugacauggauuggccucaacagcaaaaauaccuccaugucuuuuagcugcaucgugaucgggauuaucacccuguaucugggagcuguugugcaggccgauaugggcugugcuauuaacuggaaggggaaggaacuuaaaugcggauccggcaucuucgucacaaaugaggugcacaccuggacagagcaguacaaguuucaagccgacagccccaaacggcucgcgacggccauugcuggggccugggaaaacggcguuuguggaaucagaucuaccacacgcauggagaaucugcuguggaagcagaucgcuaacgaacucaauuauauucugugggagaacaauaucaaacuuaccguggucgugggcgauauuaucgggguucuggaacagggaaagcggacacucaccccucagcccauggagcugaaauacuccuggaagacguggggcaaggccaaaauugugaccgccgagacacaaaacagcucuuucaucaucgacgggccuaacacccccgaaugcccguccgcuagcagagcguggaaugucugggagguggaagacuauggauuuggcguguucacaaccaacauuuggcugaaacuucgcgaggucuacacacaguccugugaucaucggcucaugucugccgcuaucaaagacgaaagagccguucacgccgauaugggcuacuggauugagagccagaagaauggguccuggaaacuggagaaggcuucuuuuaucgaagugaagaccugcacguggccuaaaagccacacacugugguccaacggagugcucgagagcgacaugauuauccccaagucucuggccggcccuaucucccagcauaaucaccgccccggguaucauacccaaaccgcgggaccuuggcaccuuggcaaacuggaacucgauuucaacuacugcgaggggacaaccgucgugauuacggagaauuguggaacacggggccccagccugagaaccacaaccguuucuggcaagcugauccacgaauggugcugucgcuccugcacacuuccgccucuccgguauaugggggaggacggauguugguacggcauggaaauuagacccaucaacgagaaagaagagaauauggucaagagccuggugucugcugggagcggaaagguggauaacuuuaccaugggcguucugugccucgccauucuguucgaggaagugaugcgggggaaauucggaaagaaacauaugaucgccggcguccuuuuuacguucgugcugcuccuguccggccagauuaccuggcgcgacauggcucacacacugaucaugaucgggagcaaugccucugauagaaugggaaugggcguuaccuaucuugcgcugauugcuacauuuaagauccagcccuuccucgcccugggguuuuuccuccggaaacugaccuccagagagaaccuucugcucggagugggccuggccauggcuacgacacugcaacuuccugaagacauugagcagauggccaaugggaucgcucugggacucaugacccugaagcucauuacacaguuugaaaccuaccagcuguggaccgcccuugucagccugacauguuccaacacgaucuucacccucacaguggcguggcgcaccgccacacugauccuggcuggcgugucucuucugccgcucugccaaagcuccucuaugcggaagaccgauuggcugcccaugacggucgccgcuaugggcguuccuccccucccucuguuuauuuucagccuuaaagacacacccaagagacgcuccuggccucugaaugagggggugauggccgugggacuggucucuauccucgccagcucccugcuuagaaacgaugugcccauggcuggcccgcugguugccgggggacuccugauugccuguuaugugaucaccggcaccagcgcugaccucacagucgagaaagccgccgacgugaccugggaagaggaagcugagcagacagggguuucucauaaccugaugauuacgguggaugacgauggaaccaugcggaucaaggacgaugaaacagagaauauccuuaccguccugcugaaaacagcccuccugauuguguccggcaucuuuccuuacagcauucccgcgacccuucuggucuggcacacguggcagaagcagacccaacgcucuggcgugcucugggacguuccuucucccccggagacacagaaagcugaacuggaggaagggguguacagaaucaagcagcagggaauuuucggcaagacccaagucggggugggaguucagaaagagggcguguuucauacaauguggcacgucacccgcggggcggugcucacacacaacggaaagcggcuggagccuaauugggccagcgugaaaaaggaucuuaucagcuauggcggcggguggagacuguccgcucaguggcaaaaaggagaagagguucaggucauugccguggaacccggcaagaacccuaagaauuuccagacgaugcccgggaucuuccagaccacaaccggagagaucggcgcgauugcucuggacuuuaaacccgggaccagcggauccccuaucauuaaccgggaaggcaagguggucggccucuacgggaauggagugguuaccaagaacggcggguaugugagcggaaucgcccaaacgaaugccgagccggauggccccaccccugagcuggaagaggaaauguucaagaaacgcaaccuuacaauuauggaccugcaucccgggucuggcaagaccagaaaguaccucccugcuaucguccgggaggccaucaaacgcagacugcggacacucauucuggcucccaccagagugguugccgcggaaauggaggaggcccuuaagggacugccuauccgcuaucagacgacagcuaccaaaagcgaacacaccggccgggagauuguggaucugaugugccaugccacauuuaccaugagacuccuguccccgguccgcgugcccaauuacaaccuuaucauuauggacgaagcucacuucacagauccugccucuaucgccgcucggggguauaucagcaccagaguuggaaugggcgaggcggccgcuauuuuuaugacggccacacccccugggaccgccgaggcuuucccccaguccaaugccccgauccaggacgaggagcgcgacauuccugaacggucuuggaacagcggaaaugaguggaucacagauuuugugggcaagaccgucugguucgugcccuccauuaaagcggggaacgacaucgcuaacugucugagaaagaauggcaagaaagugauucaacucucucgcaagacguuugauaccgaauaccagaaaacacggcugaacgacugggauuucgucguuaccacagacaucagcgagaugggagccaauuuuaaggccgauagagugaucgacccccggcgcugccugaaaccugugauucucaccgauggccccgagagagucauccuugcugggccuaugccggugacagccgcguccgccgcucagcggcgcggaagaguuggccggaacccccagaaggaaaaugaccaauacauuuucaccgggcagccucugaacaaugaugaggaccaugcccacuggacggaagcuaagaugcugcucgacaacaucaauacacccgagggaauuaucccugcccuguucgaacccgagagagagaaaagcgcugccaucgauggcgaauaucgccuuaagggggagucucggaaaaccuuuguggaacugaugagacgcggcgaccucccggucuggcuggcgcacaagguggccuccgagggaauuaaauacaccgaucggaaguggugcuucgacggcgaaagaaacaaucagauccuggaggagaacauggauguugaaauuuggacaaaagagggggaacgcaagaagcuccggccuagauggcuugacgcucgcaccuauagcgauccccuggcccugaaagaguuuaaggacuucgcugccggaagaaaaucuaucgcccucgaucuggugacagaaauuggccgggucccuucccaucuugcuuaccgcacgagaaaugcgcuggacaaccucgugaugcugcacaccagcgagcaugggggacgggccuaucgccacgcugucgaggaacugcccgagacaauggaaacccuccuucugcugggccucaugauccugcuuacaggcggggccaugcuguuucucaucuccggaaagggcauugggaaaaccucuaucggacugauuugugugaucguuagcuccggcaugcuguggauggccgaugugccucuccaguggauugcuagcgccaucgugcuugaguucuuuaugaugguccugcugauucccgagccggaaaagcaaagaacgccucaggacaaucagcucgcguacguugugaucgggauccugacccuugccgcuauuguggccgcuaacgagaugggacugcucgaaacaaccaagcgggaucugggcaugucuaaagagcccggcgucgugucccccacaagcuaucuggacguugaccuccacccugccucugcguggacccuuuacgccguggcuacgacagucaucaccccgaugcugagacauacaauugaaaauagcaccgccaacgugucccuggcugccaucgcuaaccaagccgucgugcucauggggcuggauaagggauggcccauuucuaaaauggaccuuggcguuccucugcucgcgcuggggugcuacagccaggugaauccccugacccucacagccgcuguccuucugcuggugacgcacuaugccaucaucggaccuggccuccaggcuaaggccacccgcgaggcccagaaacggacagcggcugggauuaugaagaaccccaccguugauggaaucaugacaauugaccuggauccugugaucuacgacuccaaguucgagaaacaacuuggccaggucaugcugcucgugcugugugccgugcagcugcuccuuaugagaaccucuugggcucugugcgaagcccugacgcucgccacaggcccgauuaccacccugugggaggggagccccggaaaguuuuggaauacaaccaucgcuguuuccauggccaacaucuuccgcggcagcuaucuugcgggggccggacuggcuuuuucuauuaugaaauccgucggcacagggcggagaggaacgggcagccagggcgaaacccucggggagaaguggaaaaagaagcugaaucaacugucccggaaagaguucgaucucuacaagaaaucuggaaucacagagguggaccgcaccgaggccaaggaaggccuuaaaagaggggagacaacccaucacgcugugagccggggauccgccaagcugcagugguuugucgaacgcaacaugguuauuccugagggcagagugaucgaucugggguguggacggggcggcuggucuuauuacugcgcggggcucaaaaaggugacggaaguccgcggauauaccaagggcgggcccggacaugaggagccugugcccaugagcacauacggcuggaaucugguuaaacuuauguccgggaaggacguguucuaccugccgccugaaaaaugugauacccuccugugcgacauuggagagagcucucccucccccacagucgaagagagcagaaccauccgggugcugaagaugguugagccuuggcucaaaaacaaucaguucuguauuaaggugcuuaaccccuauaugccuacagucaucgaacaccuggagcgccugcagagaaaguacggcggcaugcucgugcggaauccgcugucuagaaacuccacccacgaaauguauuggaucagcaaugggacgggaaacauugugucuagcgucaauaugguuucccgccuucugcucaaccgguuuacaaugacccauagacgccccaccaucgagaaagauguggaccugggcgccgggacacggcacgugaacgcugaaccugagacgcccaauauggacgucauuggagagagaaucaagcgcauuaaagaagaacauucuagcaccuggcacuacgaugacgaaaacccuuauaagacaugggccuaccacggcuccuaugaggugaaagcuaccgggagcgccuccucuaugaucaauggaguugugaagcugcucacaaagcccugggaugucgugccgaugguuacccaaauggcuaugacagacaccacgccuuucggccagcagcggguguuuaaagaaaaggucgauaccagaacaccccgcccuaugcccggcacccggaaagugauggagaucacagccgaguggcuguggagaacccuugggcgcaacaagaaaccucggcugugcacgagagaagaguucacaaagaagguucgcaccaaugcggccaugggagcuguguuuacagaagagaaccaaugggacagcgccagagcugccgucgaagaugaggaguucuggaaacucguggaccgggaacgcgagcugcauaaacuuggcaaauguggguccugcgucuacaauaugaugggaaagagagagaagaagcugggcgaguuugggaaagccaagggcucucgggcgauuugguacauguggcucggagcuagauaucuggaguucgaagcccugggcuuucucaacgaggaucacugguucagccgggaaaauuccuacucugggguggagggagaaggccugcauaaacuuggguauauccugcgcgacauuagcaaaauccccggaggcgccauguacgcugaugacaccgccgggugggacacgagaauuaccgaggaugaccuccacaacgaggaaaagaucacacagcagauggauccggagcaucggcagcuggcuaaugccaucuuuaaacuuaccuaucaaaacaagguugugaaaguccagcgcccuacacccaagggcaccgugauggacauuaucuccagaaaggaucagcggggaagcggccagguggggacauacggacugaauaccuucacgaacauggaagcgcaacucguucgccagauggagggcgaaggggugcugucuaaagccgaccuggagaauccccaccuccuggagaagaaaauuacacaguggcuugaaaccaagggagucgagagacugaaacggauggcuaucuccggcgaugacugcgugguuaagccuauugaugaccgcuuugccaacgcucuccuggcccuuaacgauauggggaaggugagaaaagacaucccgcaguggcaacccagcaagggcuggcacgauuggcagcaggucccuuucuguucucaucacuuccaugaacugaucaugaaagacggacggaagcucgugguccccugccgcccucaggacgagcugauuggcagagcgcggaucucccaaggggccggauggagccugaaagaaaccgcuugucucggcaaggccuaugcucagauguggucucugauguacuuucaccgcagagaucuucggcuggccuccaaugcuauuugcagcgccgugcccguucacuggaucccuacauccagaaccacauggagcauucaugcgcaccaucaguggaugacgaccgaggacaugcucacaguguggaaccgcgucuggaucgaggauaaucccuggauggaagacaagaccccggugacaaccugggaggauguuccuuaccuggggaaacgggaagaccaaugguguggaucucuuauuggccugacgagcagagccaccugggcucagaacauccucacagccauccaacaggugcgcucccugauuggggaugaggaguuccuggacuauaugcccucuaugaagcgguuuagaaaagaagaggaaagcgagggcgccaucugguga

SEQ ID NO: 20853 - RNA, 9873 nt, Artificial Sequence
  derived and/or modified CDS sequence (opt5) from DENV-3__FJ461322__SS-prME
accagccugugccucaugaugaugcugcccgccacacuugcuuuccaccugacgucccgggacggcgaaccucggaugaucguggggaagaacgaacgcggaaagucucuccuguuuaagaccgccagcggcauuaauauguguacacuuaucgcgauggaucugggggaaaugugcgacgauaccgucacauacaaguguccgcucauugcugaaguugaacccgaagacaucgauugcugguguaaccugaccuccacaugggugaccuauggaacgugcaaucaggccggcgaacaccggcgggacaagcgcucuguggcccuggcuccucacgucgggaugggacucgauaccagaacacagaccuggaugagcgccgagggcgcuuggagacagguggaaaagguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaaacccacgcucgacaucgagcugcagaagaccgaagcuacacagcuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggucacaugcgccaaguuucagugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccucgcaccggacuugauuucaaugagaugauccugcucacgaugaaaaacaaggcuuggaugguccacagacagugguuuuucgaccugccccuuccguggaccagcggcgccacaaccgagacaccuaccuggaaucggaaagaacugcucgugacguuuaagaacgcccaugcuaaaaagcaagagguugugguccuggggucucaggaaggagcgaugcacacagcccugaccggcgcuacagagauucaaaauuccgggggcaccagcaucuucgccggacaccucaagugucgccugaaaauggauaaacuugaacugaaaggcaugucuuacgccaugugccucaacaccuuugugcugaagaaagagguuuccgagacacagcaugggacgauucugaucaagguggaauacaagggagaggacgcucccuguaaaaucccuuucagcaccgaagauggccaagggaaggcccacaacggaagacuuauuacagcgaaucccgucgugaccaaaaaggaggagcccgugaacaucgaagcugagccuccguucggcgaauccaauauuguuaucgggauuggcgacaaagcccucaagaucaacugguauaagaaaggaucuagcaucggcaagauguuugaggccacagcuagaggggccagacgcauggcuauucugggagauaccgccugggacuucggcuccgucgggggagugcugaauagccucggcaaaauggugcaucagaucuuugggucugcguacacggcccuguucuccggcgucagcuggauuaugaagaucggaauuggcgugcuucugacauggaucgggcucaacucuaaaaauaccagcauguccuuuucuugcauuguuaucggaaucauuacccuguaucugggcgcugugguccaggccgauauggggugugcuaucaacuggaagggaaaggaacuuaaaugcggcagcgggauuuucgugacaaaugagguucacaccuggacagagcaguacaaguuucaagccgacucccccaaacggcucgcgacggccaucgcuggcgccugggaaaacggaguguguggcauuagaagcaccacacgcauggagaaucugcuguggaagcagaucgcuaacgaacucaauuauauccugugggagaacaauauuaaacuuaccgucgugguuggggauaucauuggagugcuggaacagggcaagcggacacucaccccucagcccauggagcugaaauacucuuggaagacgugggggaaggccaaaaucgucaccgccgagacacaaaacuccagcuucauuaucgacggaccuaacacccccgaaugcccgucugcuuccagagcguggaaugugugggagguggaagacuauggcuuuggcgucuucacaaccaacaucuggcugaaacuucgcgagguuuacacacagagcugugaucaucggcucauguccgccgcuauuaaagacgaaagagccgugcacgccgauaugggguacuggaucgagucucagaagaauggaagcuggaaacuggagaaggcuuccuuuauugaagugaagaccugcacguggccuaaaucucacacacuguggagcaacggcguccucgaguccgacaugaucauucccaagagccuggccgggccuaucucucagcauaaucaccgccccggauaucauacccaaaccgcgggcccuuggcaccuugggaaacuggaacucgauuucaacuacugcgagggaacaaccgugguuaucacggagaauuguggcacacggggccccucccugagaaccacaaccgugagcgggaagcugauucacgaauggugcugucgcucuugcacacuuccgccucuccgguauaugggagaggacggcuguugguacgggauggaaaucagacccauuaacgagaaagaagagaauauggucaagucccuggugagcgcuggaucuggcaagguugauaacuuuaccaugggggugcugugccucgccauccuguucgaggaagucaugcggggaaaauucggcaagaaacauaugauugccggcgugcuuuuuacguucguucugcuccugagcgggcagaucaccuggcgcgacauggcucacacacugauuaugaucggauccaaugccagcgauagaaugggcaugggggugaccuaucuugcgcugaucgcuacauuuaagauucagcccuuccucgcccugggauuuuuccuccggaaacugaccucuagagagaaccuucugcucggcgucgggcuggccauggcuacgacacugcaacuuccugaagacaucgagcagauggccaauggaauugcucugggccucaugacccugaagcucaucacacaguuugaaaccuaccagcuguggaccgcccuugugucccugacauguagcaacacgauuuucacccucacaguggcguggcgcaccgccacacugauccuggcuggcgucucccuucugccgcucugccaaucuagcuccaugcggaagaccgauuggcugcccaugacgguugccgcuaugggggugccuccccucccucuguuuaucuucucucuuaaagacacacccaagagacgcagcuggccucugaaugagggagugauggccgucggccugguguccauucucgccucuagccugcuuagaaacgauguucccauggcugggccgcugguggcgggaggccuccugaucgccuguuaugucauuaccgggaccuccgcugaccucacaguggagaaagccgccgacguuaccugggaagaggaagcugagcagacaggagugagccauaaccugaugaucacggucgaugacgauggcaccaugcggauuaaggacgaugaaacagagaauauccuuaccgugcugcugaaaacagcccuccugaucgucucuggcauuuuuccuuacuccauccccgcgacccuucugguguggcacacguggcagaagcagacccaacgcagcgggguucucugggacgugccuucucccccggagacacagaaagcugaacuggaggaaggagucuacagaauuaagcagcagggcaucuucgggaagacccaagugggaguuggcgugcagaaagagggggucuuucauacaauguggcacgugacccggggagccgugcucacacacaacggcaagcgccuggagccuaauugggccuccguuaaaaaggaucuuauuagcuauggcgggggauggagacugucugcucaguggcaaaaaggcgaagagguccaggugaucgccguggaacccgggaagaacccuaagaauuuccagacgaugcccggaauuuuccagaccacaaccggcgagaucggggcgaucgcucuggacuuuaaacccggaaccuccggcagcccuauuaucaaccgggaaggcaaggucguggggcucuacggaaauggcguugugaccaagaacgggggauaugucuccggcauugcccaaacgaaugccgagccggaugggcccaccccugagcuggaagaggaaauguucaagaaacgcaaccuuacaaucauggaccugcaucccggcagcggaaagaccagaaaguaccucccugcuauugugcgggaggccaucaaacgcagacugcggacacucauccuggcucccaccagaguuguggccgcggaaauggaggaggcccuuaagggccugccuauucgcuaucagacgacagcuaccaaaucugaacacaccgggcgggagaucgucgaucugaugugccaugccacauuuaccaugagacuccugagcccggugcgcguucccaauuacaaccuuauuaucauggacgaagcucacuucacagauccugccuccauugccgcucggggauauaucucuaccagagugggcaugggggaggcggccgcuaucuuuaugacggccacacccccuggaaccgccgaggcuuucccccagagcaaugccccgauucaggacgaggagcgcgacaucccugaacgguccuggaacucuggcaaugaguggauuacagauuuugucgggaagaccgugugguucgugcccagcaucaaagcgggcaacgacauugcuaacugucugagaaagaauggaaagaaagucauccaacucucccgcaagacguuugauaccgaauaccagaaaacacggcugaacgacugggauuucguugugaccacagacauuucugagaugggcgccaauuuuaaggccgauagagugaucgacccccggcgcugccugaaaccugucauccucaccgaugggcccgagagagugauucuugcuggaccuaugccgguuacagccgcgagcgccgcucagcggcgcggcagaguggggcggaacccccagaaggaaaaugaccaauacaucuucaccggacagccucugaacaaugaugaggaccaugcccacuggacggaagcuaagaugcugcucgacaacauuaauacacccgagggcaucauuccugcccuguucgaacccgagagagagaaauccgcugccaucgauggggaauaucgccuuaagggcgagagccggaaaaccuuugucgaacugaugagacgcggagaccucccgguguggcuggcgcacaagguugccucugagggcaucaaauacaccgaucggaaguggugcuucgacggggaaagaaacaaucagauucuggaggagaacauggauguggaaaucuggacaaaagagggagaacgcaagaagcuccggccuagauggcuugacgcucgcaccuauuccgauccccuggcccugaaagaguuuaaggacuucgcugccggcagaaaaagcauugcccucgaucuggucacagaaaucgggcgggugccuucucaucuugcuuaccgcacgagaaaugcgcuggacaaccucgucaugcugcacaccuccgagcauggaggccgggccuaucgccacgcuguggaggaacugcccgagacaauggaaacccuccuucugcugggccucaugauucugcuuacagggggagccaugcuguuucucaucagcggcaaggggaucggaaaaaccuccauuggccugaucuguguuauugugucuagcgggaugcuguggauggccgaggugccucuccaguggaucgcuuccgccauuguccuugaguucuuuaugaugguucugcugauccccgaaccggagaagcaaagaacgccucaggauaaucagcucgcguacguggugauuggaauccugacccuugccgcuaucgucgccgcuaacgaaaugggccugcucgagacaaccaagcgggaccugggcaugagcaaagaacccggggugguuucucccacauccuaucuggauguggaccuccacccugccagcgcguggacccuuuacgccgucgcuacgacagugauuaccccgaugcugagacauacaaucgaaaauucuaccgccaacgucagccuggcugccauugcuaaccaagccgugguucucaugggacuggacaagggcuggcccaucuccaaaauggaucuuggggugccucugcucgcgcugggaugcuacucucaggucaauccccugacccucacagccgcugugcuucugcugguuacgcacuaugccauuaucggcccugggcuccaggcuaaggccacccgcgaggcccagaaacggacagcggcuggaaucaugaagaaccccaccguggacggcauuaugacaaucgaucuggacccugucauuuacgauagcaaguucgaaaaacaacuuggccaggugaugcugcucgugcugugugccguucagcugcuccuuaugagaaccuccugggcucugugcgaggcccugacgcucgccacagggccgaucaccacccugugggaaggaucucccggcaaguuuuggaauacaaccauugcugucagcauggccaacaucuuccgcggguccuaucuugcgggagccggccuggcuuuuagcaucaugaaaucuguggggacaggacggagaggcacgggcucccagggggagacccucggagaaaaguggaaaaagaagcugaaucaacugagccggaaagaguucgaccucuacaagaaauccggcauuacagagguggaucgcaccgaagccaaggaggggcuuaaaagaggagaaacaacccaucacgcugucucucggggcagcgccaagcugcagugguuuguugagcgcaacauggugaucccugaagggagagugauugaccugggauguggccggggcgggugguccuauuacugcgcgggacucaaaaaggucacggaggugcgcggcuauaccaaagggggacccggccaugaggaaccuguucccaugucuacauacggguggaauaucgugaaacugaugagcggaaaggaugucuucuaccuuccgccugagaaaugugacacccugcucugcgauauuggcgaauccagccccucucccacaguggaggaguccagaaccauccggguucugaagaugguggaaccuuggcugaaaaacaaucaguucuguauuaagguccucaaccccuauaugccuacagugaucgagcaccuugaacgccugcagagaaaguacggcgggaugcuggugcggaauccgcucagcagaaacucuacccacgagauguauuggaucuccaauggaacgggcaacauugucagcucuguuaauauggugagccgccugcuucugaaccgguuuacaaugacccauagacgccccaccaucgaaaaagacguggaucucggggccggaacacggcacgucaacgcugagccugagacgcccaauauggacgugauuggcgaaagaaucaagcgcauuaaagaggaacauuccucuaccuggcacuacgacgaugagaacccuuauaagacaugggccuaccacgggagcuaugaaguuaaagcuaccggauccgccagcuccaugaucaauggcguggucaagcugcugacaaagcccugggacgugguuccgauggugacccaaauggcuaugacagauaccacgccuuucggccagcagcgggucuuuaaagagaagguggacaccagaacaccccgcccuaugcccgggacccggaaaguuauggagaucacagccgaauggcucuggagaacccugggacgcaacaagaaaccucggcuuugcacgagagaggaguucacaaagaaggugcgcaccaaugcggccaugggcgcugucuuuacagaggaaaaccaaugggauucugccagagcugccguggaggacgaggaguucuggaaacuggucgaucgggagcgcgaacuccauaagcuggggaaauguggaagcugcguguacaauaugaugggcaagagagagaagaaacuuggggaguuuggcaaagccaaaggaucccgggcgauuugguacauguggcugggcgcuagauaucucgaguucgaggcccugggguuucugaacgaagaccacugguucucucgggagaauagcuacuccggaguugaaggcgaggggcuccauaagcugggauauauccuucgcgauauuucuaaaauccccggcggggccauguacgcugacgauaccgccggcugggacacgagaauuaccgaggacgaucugcacaacgaagagaagaucacacagcagauggacccggaacaucggcagcucgcuaaugccaucuuuaaacugaccuaucaaaacaagguggucaaagugcagcgcccuacacccaagggaaccgugauggauauuaucagcagaaaggaccagcggggcuccgggcagguuggaacauacggccuuaauaccuucacgaacauggaggcgcaacuggugcgccagauggaaggggagggaguccucagcaaagccgaucuggagaauccccaucugcucgaaaagaaaauuacacaguggcuggagaccaagggcguggaaagacuuaaacggauggcuaucucuggggacgauugcguugugaagccuauugacgaucgcuuugccaacgcucugcucgcccugaacgacaugggcaaggucagaaaagauaucccgcaguggcaacccuccaagggauggcacgacuggcaacaggugccuuucuguagccaucacuuccaugagcuuaucaugaaagauggccggaagcuggucgugcccugccgcccucaggacgaacucauugggagagcgcggaucucucaaggagccggcuggucccugaaagagaccgcuugucuggggaaggccuaugcucagauguggagccucauguacuuucaccgcagagaccugcggcuugccucuaaugcuauuugcuccgccguucccgugcacuggaucccuacaagcagaaccacaugguccauucaugcgcaccaucaguggaugacgaccgaggauaugcugacagucuggaaccgcguguggaucgaagacaaucccuggauggaggauaagaccccgguuacaaccugggaagacauuccuuaccucggaaaacgggaggaucaaugguguggcagccugaucgggcuuacgucuagagccaccugggcucagaacauccugacagccauucaacaggugcgcagccucaucggcgacgaggaguuccuggauuauaugcccuccaugaagcgguuuagaaaagaggaagagucugaaggagccauuugguga

SEQ ID NO: 20854 - RNA, 9873 nt, Artificial Sequence
  derived and/or modified CDS sequence (opt5) from DENV-3__KF955458__SS-prME
accagccugugccucaugaugaugcugcccgccacacuugcuuuccaccugacgucccgggacggcgaaccucggaugaucguggggaagaaugaacgcggaaagucucuccuguuuaagaccgccagcggcauuaauauguguacacuuaucgcgauggaucugggggaaaugugcgacgauaccgucacauacaaguguccgcucauugcugaaguugagcccgaagacaucgauugcugguguaaccugaccuccacaugggugaccuauggaacgugcaaucaggccggcgagcaucggcgggacaagcgcucuguggcccuggcuccucacgucgggaugggacucgauaccagaacacagaccuggaugagcgccgagggcgcuuggagacagguggaaaagguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaaacccacgcucgacaucgagcugcagaagaccgaagcuacacagcuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggucacaugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccucgcaccggacuugauuucaaugagaugauccugcucacgaugaaaaacaaggcuuggaugguccacagacagugguuuuucgaccugccccuuccguggaccagcggcgccacaaccgagacaccuaccuggaaucggaaagaacugcucgugacguuuaagaacgcccaugcuaaaaagcaagagguugugguccuggggucucaggaaggagcgaugcacacagcccugaccggcgcuacagagauucaaaauuccgggggcaccagcaucuucgccggacaccucaagugucgccugaaaauggauaaacuugaacugaaaggcaugucuuacgccaugugccucaacaccuuugugcugaagaaagagguuuccgagacacagcaugggacgauucugaucaagguggaauacaagggagaggacgcucccuguaaaaucccuuucagcaccgaagauggccaagggaaggcccacaacggaagacuuauuacagcgaaucccgucgugaccaaaaaggaggagcccgugaacaucgaagcugagccuccguucggcgaauccaauauuguuaucgggauuggcgacaaagcccucaagaucaacugguauaagaaaggaucuagcaucggcaagauguuugaggccacagcuagaggggccagacgcauggcuauucugggagauaccgccugggacuucggcuccgucgggggagugcugaauagccucggcaaaauggugcaucagaucuuugggucugcguacacggcccuguucuccggcgucagcuggauuaugaagaucggaauuggcgugcuucugacauggaucgggcucaacucuaaaaauaccagcauguccuuuucuugcauuguuaucggaaucauuacccuguaucugggcgcugugguccaggccgauauggggugugcuaucaacuggaagggaaaggaacuuaaaugcggcagcgggauuuucgugacaaaugagguucacaccuggacagagcaguacaaguuucaagccgacucccccaaacggcucgcgacggccaucgcuggcgccugggaaaacggaguguguggcauuagaagcaccacacgcauggagaaucugcuguggaagcagaucgcuaacgaacucaauuauauccugugggagaacaauauuaaacuuaccgucgugguuggggauaucauuggagugcuggaacagggcaagcggacacucaccccucagcccauggagcugaaauacucuuggaagacgugggggaaggccaaaaucgucaccgccgagacacaaaacuccagcuucauuaucgacggaccuaacacccccgaaugcccgucugcuuccagagcguggaaugugugggagguggaagacuauggcuuuggcgucuucacaaccaacaucuggcugaaacuucgcgagguuaauacacagagcugugaucaucggcucauguccgccgcuauuaaagacgaaagagccgugcacgccgauaugggguacuggaucgagucucagaagaacggaagcuggaaacuggagaaggcuuccuuuauugaagugaagaccugcacguggccuaaaucucacacacuguggagcaauggcguccucgaguccgacaugaucauucccaagagccuggccgggccuaucucucagcauaaccaccgccccggauaccauacccaaaccgcgggcccuuggcaccuugggaaacuggaacucgauuucaauuauugcgagggaacaaccgugguuaucacggagaacuguggcacacggggccccucccugagaaccacaaccgugagcgggaagcugauucacgaauggugcugucgcucuugcacacuuccgccucuccgguacaugggagaggacggcuguugguaugggauggaaaucagacccauuaaugagaaagaagagaacauggucaagucccuggugagcgcuggaucuggcaagguugauaauuuuaccaugggggugcugugccucgccauccuguucgaggaagucaugcggggaaaauucggcaagaaacauaugauugccggcgugcuuuuuacguucguucugcuccugagcgggcagaucaccuggcgcgacauggcucacacacugauuaugaucggauccaacgccagcgauagaaugggcaugggggugaccuaccuugcgcugaucgcuacauuuaagauucagcccuuccucgcccugggauuuuuccuccggaaacugaccucuagagagaaucuucugcucggcgucgggcuggccauggcuacgacacugcaacuuccugaagacaucgagcagauggccaacggaauugcucugggccucaugacccugaagcucaucacacaguuugaaaccuaucagcuguggaccgcccuugugucccugacauguagcaauacgauuuucacccucacaguggcguggcgcaccgccacacugauccuggcuggcgucucccuucugccgcucugccaaucuagcuccaugcggaagaccgauuggcugcccaugacgguugccgcuaugggggugccuccccucccucuguuuaucuucucucuuaaagacacacccaagagacgcagcuggccucugaacgagggagugauggccgucggccugguguccauucucgccucuagccugcuuagaaacgauguucccauggcugggccgcugguggcgggaggccuccugaucgccuguuacgucauuaccgggaccuccgcugaccucacaguggagaaagccgccgacguuaccugggaagaggaagcugagcagacaggagugagccauaaucugaugaucacggucgaugacgauggcaccaugcggauuaaggacgaugaaacagagaacauccuuaccgugcugcugaaaacagcccuccugaucgucucuggcauuuuuccuuauuccauccccgcgacccuucugguguggcacacguggcagaagcagacccaacgcagcgggguucucugggacgugccuucucccccggagacacagaaagcugaacuggaggaaggagucuacagaauuaagcagcagggcaucuucgggaagacccaagugggaguuggcgugcagaaagagggggucuuucauacaauguggcacgugacccggggagccgugcucacacacaauggcaagcgccuggagccuaacugggccuccguuaaaaaggaucuuauuagcuacggcgggggauggagacugucugcucaguggcaaaaaggcgaagagguccaggugaucgccguggaacccgggaagaauccuaagaacuuccagacgaugcccggaauuuuccagaccacaaccggcgagaucggggcgaucgcucuggacuuuaaacccggaaccuccggcagcccuauuaucaaucgggaaggcaaggucguggggcucuauggaaacggcguugugaccaagaaugggggauacgucuccggcauugcccaaacgaacgccgagccggaugggcccaccccugagcuggaagaggaaauguucaagaaacgcaaucuuacaaucauggaccugcaucccggcagcggaaagaccagaaaguaucucccugcuauugugcgggaggccaucaaacgcagacugcggacacucauccuggcucccaccagaguuguggccgcggaaauggaggaggcccuuaagggccugccuauucgcuaccagacgacagcuaccaaaucugaacacaccgggcgggagaucgucgaucugaugugccaugccacauuuaccaugagacuccugagcccggugcgcguucccaacuauaaucuuauuaucauggacgaagcucacuucacagauccugccuccauugccgcucggggauacaucucuaccagagugggcaugggggaggcggccgcuaucuuuaugacggccacacccccuggaaccgccgaggcuuucccccagagcaacgccccgauucaggacgaggagcgcgacaucccugaacgguccuggaacucuggcaacgaguggauuacagauuuugucgggaagaccgugugguucgugcccagcaucaaagcgggcaacgacauugcuaauugucugagaaagaacggaaagaaagucauccaacucucccgcaagacguuugauaccgaauaucagaaaacacggcugaaugacugggauuucguugugaccacagacauuucugagaugggcgccaacuuuaaggccgauagagugaucgacccccggcgcugccugaaaccugucauccucaccgaugggcccgagagagugauucuugcuggaccuaugccgguuacagccgcgagcgccgcucagcggcgcggcagaguggggcggaauccccagaaggaaaacgaccaauacaucuucaccggacagccucugaauaacgaugaggaccaugcccacuggacggaagcuaagaugcugcucgacaauauuaacacacccgagggcaucauuccugcccuguucgaacccgagagagagaaauccgcugccaucgauggggaauaccgccuuaagggcgagagccggaaaaccuuugucgaacugaugagacgcggagaccucccgguguggcuggcgcacaagguugccucugagggcaucaaauauaccgaucggaaguggugcuucgacggggaaagaaauaaccagauucuggaggagaauauggauguggaaaucuggacaaaagagggagaacgcaagaagcuccggccuagauggcuugacgcucgcaccuacuccgauccccuggcccugaaagaguuuaaggacuucgcugccggcagaaaaagcauugcccucgaucuggucacagaaaucgggcgggugccuucucaucuugcuuaucgcacgagaaacgcgcuggacaaucucaugaugcugcacaccuccgagcauggaggccgggccuaccgccacgcugucgaggaacugcccgagacaauggaaacccuccuucugcugggccucaugauucugcuuacagggggagccaugcuguuucucaucagcggcaaggggaucggaaaaaccuccauuggccugaucugugugauuguuucuagcgggaugcuguggauggccgaugugccucuccaguggaucgcuuccgccauugugcuugaguucuuuaugaugguccugcugauccccgagccggaaaagcaaagaacgccucaggacaaccagcucgcguauguugugauuggaauccugacccuugccgcuaucguggccgcuaaugagaugggccugcucgaaacaaccaagcgggaucugggcaugagcaaagagcccggggucgugucucccacauccuaccuggacguugaccuccacccugccagcgcguggacccuuuaugccguggcuacgacagucauuaccccgaugcugagacauacaaucgaaaacucuaccgccaacgugagccuggcugccauugcuaaucaagccgucgugcucaugggacuggauaagggcuggcccaucuccaaaauggaccuugggguuccucugcucgcgcugggaugcuacucucaggugaacccccugacccucacagccgcuguccuucugcuggugacgcacuacgccauuaucggcccugggcuccaggcuaaggccacccgcgaggcccagaaacggacagcggcuggaaucaugaagaaucccaccguugauggcauuaugacaaucgaccuggauccugugauuuaugacagcaaguucgagaaacaacuuggccaggucaugcugcucgugcugugugccgugcagcugcuccuuaugagaaccuccugggcucugugcgaagcccugacgcucgccacagggccgaucaccacccugugggagggaucucccggcaaguuuuggaacacaaccauugcuguuagcauggccaauaucuuccgcggguccuaccuugcgggagccggccuggcuuuuagcaucaugaaaucugucgggacaggacggagaggcacgggcucccagggggaaacccucggagagaaguggaaaaagaagcugaaccaacugagccggaaagaguucgaucucuauaagaaauccggcauuacagagguggaccgcaccgaggccaaggaagggcuuaaaagaggagagacaacccaucacgcugugucucggggcagcgccaagcugcagugguuugucgaacgcaauaugguuaucccugaggggagagugauugaucugggauguggccggggcgggugguccuacuauugcgcgggacucaaaaaggugacggaaguccgcggcuacaccaaaggcgggcccgggcaugaggagccugugcccaugucuacauauggguggaaccugguuaaacuuaugagcggaaaggacguguucuaccugccgccugaaaaaugugauacccuccugugcgacaucggcgaguccagccccucucccacagucgaagaguccagaaccauucgggugcugaagaugguugagccuuggcucaaaaauaaccaguucuguaucaaggugcuuaaucccuacaugccuacagucauugaacaccuggagcgccugcagagaaaguauggcgggaugcucgugcggaacccgcugagcagaaauucuacccacgaaauguacuggaucuccaacggaacgggcaauaucgugagcucugucaacaugguuagccgccuucugcucaaccgguuuacaaugacccauagacgccccaccauugagaaagauguggaccugggggccggaacacggcacgugaaugcugaaccugagacgcccaacauggacgucaucggcgagagaauuaagcgcaucaaagaagaacauuccucuaccuggcacuaugaugacgaaaauccuuacaagacaugggccuaucacgggagcuacgaggugaaagcuaccggauccgccagcuccaugauuaacggcguugugaagcugcucacaaagcccugggaugucgugccgaugguuacccaaauggcuaugacagacaccacgccuuucggccagcagcggguguuuaaagaaaaggucgauaccagaacaccccgcccuaugcccgggacccggaaagugauggagaucacagccgaguggcuguggagaacccuuggacgcaauaagaaaccucggcugugcacgagagaagaguucacaaagaagguucgcaccaacgcggccaugggcgcuguguuuacagaagagaaucaaugggacucugccagagcugccgucgaagaugaggaguucuggaaacucguggaccgggaacgcgagcugcauaaacuugggaaauguggaagcugcgucuauaacaugaugggcaagagagagaagaagcugggggaguuuggcaaagccaagggaucccgggcgaucugguacauguggcucggcgcuagauaccuggaguucgaagcccugggguuucucaaugaggaucacugguucucucgggaaaacagcuauuccggaguggagggcgaagggcugcauaaacuuggauacauucugcgcgacaucucuaaaauucccggcggggccauguaugcugaugacaccgccggcugggacacgagaaucaccgaggaugaccuccacaaugaggaaaagauuacacagcagauggauccggagcaucggcagcuggcuaacgccaucuuuaaacuuaccuaccaaaauaagguugugaaaguccagcgcccuacacccaagggaaccgugauggacaucauuagcagaaaggaucagcggggcuccggacaggugggaacauauggccugaacaccuucacgaauauggaagcgcaacucguucgccagauggagggggaaggagugcugagcaaagccgaccuggagaacccccaccuccuggagaagaaaaucacacaguggcuugaaaccaagggcgucgagagacugaaacggauggcuauuucuggggaugacugcgugguuaagccuaucgaugaccgcuuugccaacgcucuccuggcccuuaaugauaugggcaaggugagaaaagacauuccgcaguggcaacccuccaagggauggcacgauuggcagcaggucccuuucuguagccaucacuuccaugaacugaucaugaaagacggccggaagcucgugguccccugccgcccucaggacgagcugaucgggagagcgcggauuucucaaggagccggcuggucccugaaagaaaccgcuugucucgggaaggccuacgcucagauguggagccugauguauuuucaccgcagagaucuucggcuggccucuaacgcuaucugcuccgccgugcccguucacuggauuccuacaagcagaaccacaugguccauccaugcgcaccaucaguggaugacgaccgaggacaugcucacaguguggaaucgcgucuggauugaggauaaccccuggauggaagacaagaccccggugacaaccugggaggauguuccuuaccugggaaaacgggaagaccaaugguguggcagccuuaucgggcugacgucuagagccaccugggcucagaauauucucacagccauccaacaggugcgcagccugaucggcgaugaggaguuccuggacuacaugcccuccaugaagcgguuuagaaaagaagaggaaucugagggagccauuugguga

SEQ ID NO: 20855 - RNA, 9873 nt, Artificial Sequence
  derived and/or modified CDS sequence (opt5) from DENV-3__FJ562102__SS-prME
accagccugugccucaugaugaugcugcccgccacacuugcuuuccaccugacgucccgggacggcgaaccucggaugaucguggggaagaacgaacgcggaaagucucuccuguuuaagaccgccagcggcauuaauauguguacacuuaucgcgauggaucugggggagaugugcgacgauaccgucacauacaaguguccgcucauugcugaaguugagcccgaagacaucgauugcugguguaaccugaccuccacaugggugaccuauggaacgugcaaucaggccggcgagcaucggcgggacaagcgcucuguggcccuggcuccucacgucgggaugggacucgauaccagaacacagaccuggaugagcgccgagggcgcuuggagacagguggaaaagguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaaacccacgcucgacaucgagcugcagaagaccgaagcuacacagcuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggucacaugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccucgcaccggacuugauuucaaugagaugauccugcucacgaugaaaaacaaggcuuggaugguccacagacagugguuuuucgaccugccccuuccguggaccagcggcgccacaaccgagacaccuaccuggaaucggaaagaacugcucgugacguuuaagaacgcccaugcuaaaaagcaagagguugugguccuggggucucaggaaggagcgaugcacacagcccugaccggcgcuacagagauucaaaauuccgggggcaccagcaucuucgccggacaccucaagugucgccugaaaauggauaaacuugaacugaaaggcaugucuuacgccaugugccucaacaccuuugugcugaagaaagagguuuccgagacacagcaugggacgauucugaucaagguggaauacaagggagaggacgcucccuguaaaaucccuuucagcaccgaagauggccaagggaaggcccacaacggaagacuuauuacagcgaaucccgucgugaccaaaaaggaggagcccgugaacaucgaagcugagccuccguucggcgaauccaauauuguuaucgggauuggcgacaaagcccucaagaucaacugguauaagaaaggaucuagcaucggcaagauguuugaggccacagcuagaggggccagacgcauggcuauucugggagauaccgccugggacuucggcuccgucgggggagugcugaauagccucggcaaaauggugcaucagaucuuugggucugcguacacggcccuguucuccggcgucagcuggauuaugaagaucggaauuggcgugcuucugacauggaucgggcucaacucuaaaaauaccagcauguccuuuucuugcauuguuaucggaaucauuacccuguaucugggcgcugugguccaggccgauauggggugugcuaucaacuggaagggaaaggaacuuaaaugcggcagcgggauuuucgugacaaaugagguucacaccuggacagagcaguacaaguuucaagccgacucccccaaacggcucgcgacggccaucgcuggcgccugggaaaacggaguguguggcauuagaagcaccacacgcauggagaaucugcuguggaagcagaucgcuaacgaacucaauuauauccugugggagaacaauauuaaacuuaccgucgugguuggggauaucauuggagugcuggaacagggcaagcggacacucaccccucagcccauggagcugaaauacucuuggaagacgugggggaaggccaaaaucgucaccgccgagacacaaaacuccagcuucauuaucgacggaccuaacacccccgaaugcccgucugcuuccagagcguggaaugugugggagguggaagacuauggcuuuggcgucuucacaaccaacaucuggcugaaacuucgcgagguuuacacacagagcugugaucaucggcucauguccgccgcuauuaaagacgaaagagccgugcacgccgauaugggguacuggaucgagucucagaagaauggaagcuggaaacuggagaaggcuuccuuuauugaagugaagaccugcacguggccuaaaucucacacacuguggagcaacggcguccucgaguccgacaugaucauucccaagagccuggccgggccuaucucucagcauaaucaccgccccggauaucauacccaaaccgcgggcccuuggcaccuugggaaacuggaacucgauuucaacuacugcgagggaacaaccgugguuaucacggagaauuguggcacacggggccccucccugagaaccacaaccgugagcgggaagcugauucacgaauggugcugucgcucuugcacacuuccgccucuccgguauaugggagaggacggcuguugguacgggauggaaaucagacccauuaacgagaaagaagagaauauggucaagucccuggugagcgcuggaucuggcaagguugauaacuuuaccaugggggugcugugccucgccauccuguucgaggaagucaugcggggaaaauucggcaagaaacauaugauugccggcgugcuuuuuacguucguucugcuccugagcgggcagaucaccuggcgcgacauggcucacacauuuauuaugaucggauccaaugccagcgauagaaugggcaugggggugaccuaucuggcgcuuaucgcuacauucaagauucagcccuuucuggcccucggauucuuucugcggaaacucaccucuagagagaaccugcuucugggcgucgggcucgccauggcuacgacacugcaacugccugaagacaucgagcagauggccaauggaauugcucuuggccugaugacccucaagcugaucacacaguucgaaaccuaccagcucuggaccgcccuggugucccuuacauguagcaacacgauuuuuacccugacaguggcguggcgcaccgccacacucauccuggcuggcgucucccugcuuccgcugugccaaucuagcuccaugcggaagaccgauuggcuccccaugacgguugccgcuaugggggugccuccccugccucucuucaucuuuucucugaaagacacacccaagagacgcagcuggccucuuaaugagggagugauggccgucggccugguguccauucuggccucuagccuccugagaaacgauguucccauggcugggccgcuuguggcgggaggccugcucaucgccuguuaugucauuaccgggaccuccgcugaccugacaguggagaaagccgccgacguuaccugggaagaggaagcugagcagacaggagugagccauaaccucaugaucacggucgaugacgauggcaccaugcggauuaaggacgaugaaacagagaauauccugaccgugcuucugaaaacagcccugcucaucgucucuggcauuuucccuuacuccauccccgcgacccugcuuguguggcacacguggcagaagcagacccaacgcagcgggguucugugggacgugccuucucccccggagacacagaaagcugaacucgaggaaggagucuacagaauuaagcagcagggcaucuuugggaagacccaagugggaguuggcgugcagaaagagggggucuuccauacaauguggcacgugacccggggagccgugcugacacacaacggcaagcgccucgagccuaauugggccuccguuaaaaaggaucugauuagcuauggcgggggauggagacuuucugcucaguggcaaaaaggcgaagagguccaggugaucgccguggaacccgggaagaacccuaagaauuuccagacgaugcccggaauuuuucagaccacaaccggcgagaucggggcgaucgcucuggacuucaaacccggaaccuccggcagcccuauuaucaaccgggaaggcaaggucguggggcuguacggaaauggcguugugaccaagaacgggggauaugucuccggcauugcccaaacgaaugccgagccggaugggcccaccccugagcucgaagaggaaauguuuaagaaacgcaaccugacaaucauggaccuucaucccggcagcggaaagaccagaaaguaccugccugcuauugugcgggaggccaucaaacgcagacuccggacacugauccucgcucccaccagaguuguggccgcggaaauggaggaggcccugaagggccuuccuauucgcuaucagacgacagcuaccaaaucugaacacaccgggcgggagaucgucgaucugaugugccaugccacauucaccaugagacugcucagcccggugcgcguucccaauuacaaccugauuaucauggacgaagcucacuuuacagauccugccuccauugccgcucggggauauaucucuaccagagugggcaugggggaggcggccgcuaucuucaugacggccacacccccuggaaccgccgaggcuuuuccccagagcaaugccccgauucaggacgaggagcgcgacaucccugaacgguccuggaacucuggcaaugaguggauuacagauuucgucgggaagaccgugugguuugugcccagcaucaaagcgggcaacgacauugcuaacugucuuagaaagaauggaaagaaagucauccaacugucccgcaagacguucgauaccgaauaccagaaaacacggcucaacgacugggauuuuguugugaccacagacauuucugagaugggcgccaauuucaaggccgauagagugaucgacccccggcgcugccugaaaccugucauccugaccgaugggcccgagagagugauucucgcuggaccuaugccgguuacagccgcgagcgccgcucagcggcgcggcagaguggggcggaacccccagaaggaaaaugaccaauacaucuucaccggacagccucuuaacaaugaugaggaccaugcccacuggacggaagcuaagaugcugcuggacaacauuaauacacccgagggcaucauuccugcccucuuugaacccgagagagagaaauccgcugccaucgauggggaauaucgccugaagggcgagagccggaaaaccuucgucgaacuuaugagacgcggagaccugccgguguggcucgcgcacaagguugccucugagggcaucaaauacaccgaucggaaguggugcuuugacggggaaagaaacaaucagauucuggaggagaacauggauguggaaaucuggacaaaagagggagaacgcaagaagcugcggccuagauggcucgacgcucgcaccuauuccgauccccuugcccugaaagaguucaaggacuuugcugccggcagaaaaagcauugcccuggaucucgucacagaaaucgggcgggugccuucucaucuggcuuaccgcacgagaaaugcgcuugacaaccuggucaugcuccacaccuccgagcauggaggccgggccuaucgccacgcuguggaggaacugcccgagacaauggaaacccugcuccuucugggccugaugauucuccugacagggggagccaugcuuuuccugaucagcggcaaggggaucggaaaaaccuccauuggccucaucuguguuauugugucuagcgggaugcuguggauggccgaugugccucugcaguggaucgcuuccgccauuauccucgaguuuuucaugaugguccuucugauucccgagccggaaaagcaaagaacgccucaggacaaucagcuggcguacguugugaucggaauccucacccuggccgcuauuguggccgcuaacgagaugggccuucuggaaacaaccaagcgggaucucggcaugagcaaagagcccggggucgugucucccacauccuaucuggacguugaccugcacccugccagcgcguggacccucuacgccguggcuacgacagucaucaccccgaugcuuagacauacaauugaaaauucuaccgccaacgugagccuggcugccaucgcuaaccaagccgucgugcugaugggacucgauaagggcuggcccauuuccaaaauggaccuggggguuccucuucuggcgcucggaugcuacucucaggugaauccccugacccugacagccgcuguccuccuucuggugacgcacuaugccaucaucggcccugggcugcaggcuaaggccacccgcgaggcccagaaacggacagcggcuggaauuaugaagaaccccaccguugauggcaucaugacaauugaccucgauccugugaucuacgacagcaaguuugagaaacaacugggccaggucaugcuucuggugcucugugccgugcagcugcugcucaugagaaccuccugggcucuuugcgaagcccugacgcuggccacagggccgauuaccacccucugggagggaucucccggcaaguucuggaauacaaccaucgcuguuagcauggccaacaucuuucgcggguccuaucuggcgggagccggccuugcuuucagcauuaugaaaucugucgggacaggacggagaggcacgggcucccagggggaaacccugggagagaaguggaaaaagaagcucaaucaacugagccggaaagaauuugaucuguacaagaaauccggcaucacagagguggaccgcaccgaggccaaggaagggcucaaaagaggagagacaacccaucacgcugugucucggggcagcgccaaacuucagugguucgucgaacgcaacaugguuauuccugaggggagagugaucgaucugggauguggccggggcgggugguccuauuacugcgcgggacugaaaaaggugacggaaguccgcggcuauaccaaaggcgggcccgggcaugaggagccugugcccaugucuacauacggguggaaucucguuaaacugaugagcggaaaggacguguucuaccuuccgccugaaaaaugugauacccugcucugcgacauuggcgaguccagccccucucccacagucgaagaguccagaaccauccgggugcugaagaugguugagccuuggcugaaaaacaaucaguuuuguauuaaggugcucaaccccuauaugccuacagucaucgaacaccuugagcgccugcagagaaaguacggcgggaugcuggugcggaauccgcucagcagaaacucuacccacgaaauguauuggaucuccaauggaacgggcaacauugugagcucugucaauaugguuagccgccugcuucugaaccgguucacaaugacccauagacgccccaccaucgagaaagauguggaccucggggccggaacacggcacgugaacgcugaaccugagacgcccaauauggacgucauuggcgagagaaucaagcgcauuaaagaagaacacuccucuaccuggcacuacgaugacgaaaacccuuauaagacaugggccuaccacgggagcuaugaggugaaagcuaccggauccgccagcuccaugaucaauggcguugugaagcugcugacaaagcccugggaugucgugccgaugguuacccaaauggcuaugacagacaccacgccuuuuggccagcagcggguguucaaagaaaaggucgauaccagaacaccccgcccuaugcccgggacccggaaagugauggagaucacagccgaguggcucuggagaacccugggacgcaacaagaaaccucggcuuugcacgagagaagaguuuacaaagaagguucgcaccaaugcggccaugggcgcuguguucacagaagagaaccaaugggacucugccagagcugccgucgaagaugaggaguuuuggaaacugguggaccgggaacgcgagcuccauaagcuggggaaauguggaagcugcgucuacaauaugaugggcaagagagagaagaaacuuggggaguucggcaaagccaagggaucccgggcgauuugguacauguggcugggcgcuagauaucucgaguuugaagcccugggguuccugaacgaggaucacugguuuucucgggaaaauagcuacuccggaguggagggcgaagggcuccauaagcugggauauauccuucgcgacauuucuaaaauccccggcggggccauguacgcugaugacaccgccggcugggacacgagaauuaccgaggaugaccugcacaacgaggaaaagaucacacagcagauggauccggagcaucggcagcucgcuaaugccaucuucaaacugaccuaucaaaacaagguugugaaaguccagcgcccuacacccaagggaaccgugauggacauuaucagcagaaaggaucagcggggcuccggacaggugggaacauacggccuuaauaccuuuacgaacauggaagcgcaacugguucgccagauggagggggaaggagugcucagcaaagccgaccuggagaauccccaucugcucgagaagaaaauuacacaguggcuggaaaccaagggcgucgagagacuuaaacggauggcuaucucuggggaugacugcgugguuaagccuauugaugaccgcuucgccaacgcucugcucgcccugaacgauaugggcaaggugagaaaagacaucccgcaguggcaacccuccaagggauggcacgauuggcagcaggucccuuucuguagccaucacuuucaugaacuuaucaugaaagacggccggaagcuggugguccccugccgcccucaggacgagcucauugggagagcgcggaucucucaaggagccggcuggucccugaaagaaaccgcuugucuggggaaggccuaugcucagauguggagccucauguacuuccaccgcagagaucugcggcuugccucuaaugcuauuugcuccgccgugcccguucacuggaucccuacaagcagaaccacaugguccauucaugcgcaccaucaguggaugacgaccgaggacaugcugacaguguggaaccgcgucuggaucgaggauaaucccuggauggaagacaagaccccggugacaaccugggaggauguuccuuaccucggaaaacgggaagaccaaugguguggcagccugauugggcuuacgucuagagccaccugggcucagaacauccugacagccauccaacaggugcgcagccucauuggcgaugaggaguuucuggacuauaugcccuccaugaagcgguucagaaaagaagaggaaucugagggagccaucugguga

SEQ ID NO: 20856 - RNA, 9873 nt, Artificial Sequence
  derived and/or modified CDS sequence (opt5) from DENV-3__FJ410229__SS-prME
accagccugugccucaugaugaugcugcccgccacacuugcuuuccaccugacgucccgggacggcgaaccucggaugaucguggggaagaacgaacgcggaaagucucuccuguuuaagaccgccagcggcauuaauauguguacacuuaucgcgauggaucugggggaaaugugcgacgauaccgucacauacaaguguccgcucauugcugaaguugagcccgaagacaucgauugcugguguaaccugaccuccacaugggugaccuauggaacgugcaaucaggccggcgagcaucggcgggacaagcgcucuguggcccuggcuccucacgucgggaugggacucgauaccagaacacagaccuggaugagcgccgagggcgcuuggagacagguggaaaagguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaaacccacgcucgacaucgagcugcagaagaccgaagcuacacagcuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggucacaugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccucgcaccggacuugauuucaaugagaugauccugcucacgaugaaaaacaaggcuuggaugguccacagacagugguuuuucgaccugccccuuccguggaccagcggcgccacaaccgagacaccuaccuggaaucggaaagaacugcucgugacguuuaagaacgcccaugcuaaaaagcaagagguugugguccuggggucucaggaaggagcgaugcacacagcccugaccggcgcuacagagauucaaaauuccgggggcaccagcaucuucgccggacaccucaagugucgccugaaaauggauaaacuugaacugaaaggcaugucuuacgccaugugccucaacaccuuugugcugaagaaagagguuuccgagacacagcaugggacgauucugaucaagguggaauacaagggagaggacgcucccuguaaaaucccuuucagcaccgaagauggccaagggaaggcccacaacggaagacuuauuacagcgaaucccgucgugaccaaaaaggaggagcccgugaacaucgaagcugagccuccguucggcgaauccaauauuguuaucgggauuggcgacaaagcccucaagaucaacugguauaagaaaggaucuagcaucggcaagauguuugaggccacagcuagaggggccagacgcauggcuauucugggagauaccgccugggacuucggcuccgucgggggagugcugaauagccucggcaaaauggugcaucagaucuuugggucugcguacacggcccuguucuccggcgucagcuggauuaugaagaucggaauuggcgugcuucugacauggaucgggcucaacucuaaaaauaccagcauguccuuuucuugcauuguuaucggaaucauuacccuguaucugggcgcugugguccaggccgauauggggugugcuaucaacuggaagggaaaggaacuuaaaugcggcagcgggauuuucgugacaaaugagguucacaccuggacagagcaguacaaguuucaagccgacucccccaaacggcucgcgacggccaucgcuggcgccugggaaaacggaguguguggcauuagaagcaccacacgcauggagaaucugcuguggaagcagaucgcuaacgaacucaauuauauccugugggagaacaauauuaaacuuaccgucgugguuggggauaucauuggagugcuggaacagggcaagcggacacucaccccucagcccauggagcugaaauacucuuggaagacgugggggaaggccaaaaucgucaccgccgagacacaaaacuccagcuucauuaucgacggaccuaacacccccgaaugcccgucugcuuccagagcguggaaugugugggagguggaagacuauggcuuuggcgucuucacaaccaacaucuggcugaaacuucgcgagguuuacacacagagcugugaucaucggcucauguccgccgcuauuaaagacgaaagagccgugcacgccgauaugggguacuggaucgagucucagaagaauggaagcuggaaacuggagaaggcuuccuuuauugaagugaagaccugcacguggccuaaaucucacacacuguggagcaacggcguccucgaguccgacaugaucauucccaagagccuggccgggccuaucucucagcauaaucaccgccccggauaucauacccaaaccgcgggcccuuggcaccuugggaaacuggaacucgauuucaacuacugcgagggaacaaccgugguuaucacggagaauuguggcacacggggccccucccugagaaccacaaccgugagcgggaagcugauucacgaauggugcugucgcucuugcacacuuccgccucuccgguauaugggagaggacggcuguugguacgggauggaaaucagacccauuaacgagaaagaagagaauauggucaagucccuggugagcgcuggaucuggcaagguugauaacuuuaccaugggggugcugugccucgccauccuguucgaggaagucaugcggggaaaauucggcaagaaacauaugauugccggcgugcuuuuuacguucguucugcuccugagcgggcagaucaccuggcgcgacauggcucacacacugauuaugaucggauccaaugccagcgauagaaugggcaugggggugaccuaucuugcgcugaucgcuacauuuaagauucagcccuuccucgcccugggauuuuuccuccggaaacugaccucuagagagaaccuucugcucggcgucgggcuggccauggcuacgacacugcaacuuccugaagacaucgagcagauggccaauggaauugcucugggccucaugacccugaagcucaucacacaguuugaaaccuaccagcuguggaccgcccuugugucccugacauguagcaacacgauuuucacccucacaguggcguggcgcaccgccacacugauccuggcuggcgucucccuucugccgcucugccaaucuagcuccaugcggaagaccgauuggcugcccaugacgguugccgcuaugggggugccuccccucccucuguuuaucuucucucuuaaagacacacccaagagacgcagcuggccucugaaugagggagugauggccgucggccugguguccauucucgccucuagccugcuuagaaacgauguucccauggcugggccgcugguggcgggaggccuccugaucgccuguuaugucauuaccgggaccuccgcugaccucacaguggagaaagccgccgacguuaccugggaagaggaagcugagcagacaggagugagccauaaccugaugaucacggucgaugacgauggcaccaugcggauuaaggacgaugaaacagagaauauccuuaccgugcugcugaaaacagcccuccugaucgucucuggcauuuuuccuuacuccauccccgcgacccuucugguguggcacacguggcagaagcagacccaacgcagcgggguucucugggacgugccuucucccccggagacacagaaagcugaacuggaggaaggagucuacagaauuaagcagcagggcaucuucgggaagacccaagugggaguuggcgugcagaaagagggggucuuucauacaauguggcacgugacccggggagccgugcucacacacaacggcaagcgccuggagccuaauugggccuccguuaaaaaggaucuuauuagcuauggcgggggauggagacugucugcucaguggcaaaaaggcgaagagguccaggugaucgccguggaacccgggaagaacccuaagaauuuccagacgaugcccggaauuuuccagaccacaaccggcgagaucggggcgaucgcucuggacuuuaaacccggaaccuccggcagcccuauuaucaaccgggaaggcaaggucguggggcucuacggaaauggcguugugaccaagaacgggggauaugucuccggcauugcccaaacgaaugccgagccggaugggcccaccccugagcuggaagaggaaauguucaagaaacgcaaccuuacaaucauggaccugcaucccggcagcggaaagaccagaaaguaccucccugcuauugugcgggaggccaucaaacgcagacugcggacacucauccuggcucccaccagaguuguggccgcggaaauggaggaggcccuuaagggccugccuauucgcuaucagacgacagcuaccaaaucugaacacaccgggcgggagaucgucgaucugaugugccaugccacauuuaccaugagacuccugagcccggugcgcguucccaauuacaaccuuauuaucauggacgaagcucacuucacagauccugccuccauugccgcucggggauauaucucuaccagagugggcaugggggaggcggccgcuaucuuuaugacggccacacccccuggaaccgccgaggcuuucccccagagcaaugccccgauucaggacgaggagcgcgacaucccugaacgguccuggaacucuggcaaugaguggauuacagauuuugucgggaagaccgugugguucgugcccagcaucaaagcgggcaacgacauugcuaacugucugagaaagaauggaaagaaagucauccaacucucccgcaagacguuugauaccgaauaccagaaaacacggcugaacgacugggauuucguugugaccacagacauuucugagaugggcgccaauuuuaaggccgauagagugaucgacccccggcgcugccugaaaccugucauccucaccgaugggcccgagagagugauucuugcuggaccuaugccgguuacagccgcgagcgccgcucagcggcgcggcagaguggggcggaacccccagaaggaaaaugaccaauacaucuucaccggacagccucugaacaaugaugaggaccaugcccacuggacggaagcuaagaugcugcucgacaacauuaauacacccgagggcaucauuccugcccuguucgaacccgagagagagaaauccgcugccaucgauggggaauaucgccuuaagggcgagagccggaaaaccuuugucgaacugaugagacgcggagaccucccgguguggcuggcgcacaagguugccucugagggcaucaaauacaccgaucggaaguggugcuucgacggggaaagaaacaaucagauucuggaggagaacauggauguggaaaucuggacaaaagagggagaacgcaagaagcuccggccuagauggcuugacgcucgcaccuauuccgauccccuggcccugaaagaguuuaaggacuucgcugccggcagaaaaagcauugcccucgaucuggucacagaaaucgggcgggugccuucucaucuugcuuaccgcacgagaaaugcgcuggacaaccucgucaugcugcacaccuccgagcauggaggccgggccuaucgccacgcuguggaggaacugcccgagacaauggaaacccuccuucugcugggccucaugauucugcuuacagggggagccaugcuguuucucaucagcggcaaggggaucggaaaaaccuccauuggccugaucuguguuauugugucuagcgggaugcuguggauggccgaugugccucuccaguggaucgcuuccgccauuauccuugaguucuuuaugaugguccugcugauucccgagccggaaaagcaaagaacgccucaggacaaucagcucgcguacguugugaucggaauccugacccuugccgcuauuguggccgcuaacgagaugggccugcucgaaacaaccaagcgggaucugggcaugagcaaagagcccggggucgugucucccacauccuaucuggacguugaccuccacccugccagcgcguggacccuuuacgccguggcuacgacagucaucaccccgaugcugagacauacaauugaaaauucuaccgccaacgugagccuggcugccaucgcuaaccaagccgucgugcucaugggacuggauaagggcuggcccauuuccaaaauggaccuugggguuccucugcucgcgcugggaugcuacucucaggugaauccccugacccucacagccgcuguccuucugcuggugacgcacuaugccaucaucggcccugggcuccaggcuaaggccacccgcgaggcccagaaacggacagcggcuggaauuaugaagaaccccaccguugauggcaucaugacaauugaccuggauccugugaucuacgacagcaaguucgagaaacaacuuggccaggucaugcugcucgugcugugugccgugcagcugcuccuuaugagaaccuccugggcucugugcgaagcccugacgcucgccacagggccgauuaccacccugugggagggaucucccggcaaguuuuggaauacaaccaucgcuguuagcauggccaacaucuuccgcggguccuaucuugcgggagccggccuggcuuuuagcauuaugaaaucugucgggacaggacggagaggcacgggcucccagggggaaacccucggagagaaguggaaaaagaagcugaaucaacugagccggaaagaguucgaucucuacaagaaauccggcaucacagagguggaccgcaccgaggccaaggaagggcuuaaaagaggagagacaacccaucacgcugugucucggggcagcgccaagcugcagugguuugucgaacgcaacaugguuauuccugaggggagagugaucgaucugggauguggccggggcgggugguccuauuacugcgcgggacucaaaaaggugacggaaguccgcggcuauaccaaaggcgggcccgggcaugaggagccugugcccaugucuacauacggguggaaucugguuaaacuuaugagcggaaaggacguguucuaccugccgccugaaaaaugugauacccuccugugcgacauuggcgaguccagccccucucccacagucgaagaguccagaaccauccgggugcugaagaugguugagccuuggcucaaaaacaaucaguucuguauuaaggugcuuaaccccuauaugccuacagucaucgaacaccuggagcgccugcagagaaaguacggcgggaugcucgugcggaauccgcugagcagaaacucuacccacgaaauguauuggaucuccaauggaacgggcaacauugugagcucugucaauaugguuagccgccuucugcucaaccgguuuacaaugacccauagacgccccaccaucgagaaagauguggaccugggggccggaacacggcacgugaacgcugaaccugagacgcccaauauggacgucauuggcgagagaaucaagcgcauuaaagaagaacauuccucuaccuggcacuacgaugacgaaaacccuuauaagacaugggccuaccacgggagcuaugaggugaaagcuaccggauccgccagcuccaugaucaauggcguugugaagcugcucacaaagcccugggaugucgugccgaugguuacccaaauggcuaugacagacaccacgccuuucggccagcagcggguguuuaaagaaaaggucgauaccagaacaccccgcccuaugcccgggacccggaaagugauggagaucacagccgaguggcuguggagaacccuuggacgcaacaagaaaccucggcugugcacgagagaagaguucacaaagaagguucgcaccaaugcggccaugggcgcuguguuuacagaagagaaccaaugggacucugccagagcugccgucgaagaugaggaguucuggaaacucguggaccgggaacgcgagcugcauaaacuugggaaauguggaagcugcgucuacaauaugaugggcaagagagagaagaagcugggggaguuuggcaaagccaagggaucccgggcgauuugguacauguggcucggcgcuagauaucuggaguucgaagcccugggguuucucaacgaggaucacugguucucucgggaaaauagcuacuccggaguggagggcgaagggcugcauaaacuuggauauauccugcgcgacauuucuaaaauccccggcggggccauguacgcugaugacaccgccggcugggacacgagaauuaccgaggaugaccuccacaacgaggaaaagaucacacagcagauggauccggagcaucggcagcuggcuaaugccaucuuuaaacuuaccuaucaaaacaagguugugaaaguccagcgcccuacacccaagggaaccgugauggacauuaucagcagaaaggaucagcggggcuccggacaggugggaacauacggccugaauaccuucacgaacauggaagcgcaacucguucgccagauggagggggaaggagugcugagcaaagccgaccuggagaauccccaccuccuggagaagaaaauuacacaguggcuugaaaccaagggcgucgagagacugaaacggauggcuaucucuggggaugacugcgugguuaagccuauugaugaccgcuuugccaacgcucuccuggcccuuaacgauaugggcaaggugagaaaagacaucccgcaguggcaacccuccaagggauggcacgauuggcagcaggucccuuucuguagccaucacuuccaugaacugaucaugaaagacggccggaagcucgugguccccugccgcccucaggacgagcugauugggagagcgcggaucucucaaggagccggcuggucccugaaagaaaccgcuugucucgggaaggccuaugcucagauguggagccugauguacuuucaccgcagagaucuucggcuggccucuaaugcuauuugcuccgccgugcccguucacuggaucccuacaagcagaaccacaugguccauucaugcgcaccaucaguggaugacgaccgaggacaugcucacaguguggaaccgcgucuggaucgaggauaaucccuggauggaagacaagaccccggugacaaccugggaggauguuccuuaccugggaaaacgggaagaccaaugguguggcagccuuauugggcugacgucuagagccaccugggcucagaacauccucacagccauccaacaggugcgcagccugauuggcgaugaggaguuccuggacuauaugcccuccaugaagcgguuuagaaaagaagaggaaucugagggagccaucugguga

SEQ ID NO: 20857 - RNA, 9873 nt, Artificial Sequence
  derived and/or modified CDS sequence (opt5) from DENV-3__FJ461326__SS-prME
accucccugugccugaugaugaugcugcccgcgacacuugcuuuccaccugacgucccgggacggagagccucggaugaucguggggaagaacgaacgcggaaaaucucuccuguuuaagaccgccagcggaauuaauauguguacacuuaucgcgauggaucugggggagaugugcgacgauaccgucacauacaaauguccgcucauugcugaaguugagcccgaagacaucgauugcugguguaaccugaccuccacaugggugaccuauggaacgugcaaucaggccggcgagcaucggcgggacaagcgcucuguggcccuggcuccucacgucgggaugggacucgauaccagaacacaaaccuggaugagcgccgagggcgcuuggagacagguggaaaaaguugagacaugggcccugcgccaucccggcuucaccauucuugcgcuguuucucgcccacuacaucuccacgucucugacacagaagguggucaucuucauucuucugaugcucgugaccccuagcaugacaaugagauguguuggggugggaaaccgggacuuugucgaaggccuguccggggcuaccuggguggaugugguccuggagcauggaggcugcguuaccacaauggcccgcaauaagcccacgcucgacaucgagcugcagaaaaccgaagcuacacaacuugccacccugagaaagcucuguauugaggggaaaaucacaaacauuaccacggauagccggugcccuacacagggagaagcgauccugccggaggaacaggaccagaauuauguguguaagcacaccuacguggaucgcggcuggggcaacgggugcggacuuuucggcaaagggucucuggucacaugcgccaaguuucaaugucucgagcccauugagggaaaggugguucaguaugaaaaucugaaauacacagugaucaucaccguccacacaggcgaccagcaucagguggggaacgacacgcaaggaguuaccguggagauuacaccucaggcuuccaccgucgaagccgugcugcccgaguauggcacacucggccuggaaugcagcccuagaaccgggcuugauuucaaugagaugauccugcucacgaugaagaacaaggcuuggaugguccaccggcagugguuuuucgaccugccccuuccguggaccucuggagccacaaccgagacaccuaccuggaaucgcaaggaacugcucgugacguuuaaaaacgcccaugcuaagaaacaagagguugugguccugggcucccaggaaggggcgaugcacacagcccugaccggagcuacagagauucagaauagcggcgggaccucuaucuucgccggccaccucaaguguagacugaagauggauaaacuugaacugaagggaauguccuacgccaugugccucaacaccuuugugcugaaaaaggagguuagcgagacacagcauggcacgauucugaucaaaguggaauacaagggggaggacgcucccuguaagaucccuuucuccaccgaagauggacaaggcaaagcccacaacgggcggcuuauuacagcgaaucccgucgugaccaagaaagaggagcccgugaacaucgaagcugagccuccguucggagaaucuaauauuguuaucggcauuggggacaaggcccucaaaaucaacugguauaagaagggcagcuccaucggaaaaauguuugaggccacagcuagaggcgcccgccggauggcuauucugggggauaccgccugggacuucggaagcgucggcggggugcucaauucucucggaaagauggugcaucagaucuuuggcuccgcguacacggcccuguucagcggggucucuuggauuaugaaaaucggcauuggagugcuucugacauggaucggccucaacagcaagaauaccuccaugucuuuuagcugcauuguuaucgggaucauuacccuguaucugggagcugugguccaggccgauaugggcugugcuaucaacuggaaagggaaggaacuuaagugcggauccggcauuuucgugacaaaugagguucacaccuggacagagcaguacaaauuucaagccgacagccccaagagacucgcgacggccaucgcuggggccugggaaaacggcguguguggcauucgcucuaccacacggauggagaaucugcuguggaaacagaucgcuaacgaacucaauuauauccugugggagaacaauauuaaacuuaccgucgugguuggcgauaucauuggggugcuggaacagggaaaaagaacacucaccccucagcccauggagcugaaguacuccuggaaaacguggggcaaggccaagaucgucaccgccgagacacaaaacagcucuuucauuaucgacgggccuaacacccccgaaugcccguccgcuagccgcgcguggaaugugugggagguggaagacuauggauuuggcgucuucacaaccaacaucuggcugaaacuucgggagguuuacacacaguccugugaucauagacucaugucugccgcuauuaaggacgaacgcgccgugcacgccgauaugggcuacuggaucgagagccagaaaaauggguccuggaagcuggagaaagcuagcuuuauugaagugaagaccugcacguggccuaagagccacacacugugguccaacggaguccucgagagcgacaugaucauucccaaaucucuggccggcccuaucucccagcauaaucaccggcccggguaucauacccaaaccgcgggaccuuggcaccuuggcaagcuggaacucgauuucaacuacugcgaggggacaaccgugguuaucacggagaauuguggaacaagaggccccagccugcgcaccacaaccgugucuggcaaacugauucacgaauggugcugucgguccugcacacuuccgccucucagauauaugggggaggacggauguugguacggcauggaaauccggcccauuaacgagaaggaagagaauauggucaaaagccuggugucugcugggagcggaaagguugauaacuuuaccaugggcgugcugugccucgccauccuguucgaggaagucaugcgcgggaaguucggcaagaagcauaugauugccggcgugcuuuuuacguucguucugcuccuguccggccagaucaccuggagagacauggcucacacacugauuaugaucgggagcaaugccucugaucggaugggaaugggcgugaccuaucuugcgcugaucgcuacauuuaaaauucagcccuuccucgcccugggguuuuuccucagaaagcugaccucccgcgagaaccuucugcucggagucggccuggccauggcuacgacacugcaacuuccugaagacaucgagcagauggccaaugggauugcucugggacucaugacccugaaacucaucacacaguuugaaaccuaccagcuguggaccgcccuugugagccugacauguuccaacacgauuuucacccucacaguggcguggcggaccgccacacugauccuggcuggcgucucucuucugccgcucugccaaagcuccucuaugagaaagaccgauuggcugcccaugacgguugccgcuaugggcgugccuccccucccucuguuuaucuucagccuuaaggacacacccaaacgcagauccuggccucugaaugagggggugauggccgucggacuggugucuauucucgccagcucccugcuucggaacgauguucccauggcuggcccgcugguggccgggggacuccugaucgccuguuaugucauuaccggcaccagcgcugaccucacaguggagaaggccgccgacguuaccugggaagaggaagcugagcagacaggggugucucauaaccugaugaucacggucgaugacgauggaaccaugcgcauuaaagacgaugaaacagagaauauccuuaccgugcugcugaagacagcccuccugaucgucuccggcauuuuuccuuacagcauccccgcgacccuucugguguggcacacguggcagaaacagacccaaagaucuggcguucucugggacgugccuucucccccggagacacagaaggcugaacuggaggaaggggucuaccggauuaaacagcagggaaucuucggcaagacccaaguggggguuggagugcagaaggagggcgucuuucauacaauguggcacgugacccgcggggccgugcucacacacaacggaaaaagacuggagccuaauugggccagcguuaagaaagaucuuauuagcuauggcggcggguggcggcuguccgcucaguggcaaaagggagaagagguccaggugaucgccguggaacccggcaaaaacccuaagaauuuccagacgaugcccgggauuuuccagaccacaaccggagagaucggcgcgaucgcucuggacuuuaagcccgggaccagcggauccccuauuaucaaccgcgaaggcaaagucgugggccucuacgggaauggaguugugacaaagaacggcggguaugucagcggaauugcccaaacgaaugccgagccggauggccccaccccugagcuggaagaggaaauguucaaaaagagaaaccuuacaaucauggaccugcaucccgggucuggcaaaacccggaaguaccucccugcuauugugcgcgaggccaucaagagacggcugagaacacucauccuggcucccacccgcguuguggccgcggaaauggaggaggcccuuaaaggacugccuauucgguaucagacgacagcuaccaagagcgaacacaccggcagagagaucgucgaucugaugugccaugccacauuuaccaugcgccuccuguccccggugcggguucccaauuacaaccuuauuaucauggacgaagcucacuucacagauccugccucuauugccgcuagaggguauaucagcacccgcgugggaaugggcgaggcggccgcuaucuuuaugacggccacacccccugggaccgccgaggcuuucccccaguccaaugccccgauucaggacgaggagcgggacaucccugaaagaucuuggaacagcggaaaugaguggauuacagauuuugucggcaaaaccgugugguucgugcccuccaucaaggcggggaacgacauugcuaacugucugcgcaaaaauggcaagaaggucauccaacucucucggaaaacguuugauaccgaauaccagaagacaagacugaacgacugggauuucguugugaccacagacauuagcgagaugggagccaauuuuaaagccgaucgggugaucgacccccgcagaugccugaagccugucauccucaccgauggccccgagcgggugauucuugcugggccuaugccgguuacagccgcguccgccgcucagcgcagaggacgggugggcagaaacccccagaaagaaaaugaccaauacaucuucaccgggcagccucugaacaaugaugaggaccaugcccacuggacggaagcuaagaugcugcucgacaacauuaauacacccgagggaaucauuccugcccuguucgaacccgagcgcgaaaagucugcugccaucgauggcgaauaucggcuuaaaggggagucuagaaagaccuuugucgaacugaugcgccggggcgaccucccgguguggcuggcgcacaaaguugccuccgagggaaucaaguacaccgauagaaaauggugcuucgacggcgaacgcaacaaucagauucuggaggagaacauggauguggaaaucuggacaaaggagggggaacggaaaaagcucagaccucgcuggcuugacgcuagaaccuauagcgauccccuggcccugaaggaguuuaaagacuucgcugccggacggaagucuauugcccucgaucuggucacagaaaucggccgcgugccuucccaucuugcuuacagaacgcggaaugcgcuggacaaccucgucaugcugcacaccagcgagcaugggggacgcgccuauagacacgcuguggaggaacugcccgagacaauggaaacccuccuucugcugggccucaugauucugcuuacaggcggggccaugcuguuucucaucuccggaaaaggcaucgggaagaccucuauuggacugaucuguguuauugccagcuccggcaugcuguggauggcugaugugccucuccaguggaucgccagcgcgauuauccuugaguucuuuaugauggugcugcugauucccgagccggaaaaacaacggacgccucaggacaaucagcucgccuacgucguuaucgggauccugacccuugcugccauuguggcugccaacgagaugggacugcucgaaacaaccaagagagaucugggcaugucuaaggagcccggcguggucucccccacaagcuaucuggacguggaccuccacccugcgucugccuggacccuuuacgcuguugccacgacagugaucaccccgaugcugcgccauacaauugaaaauagcaccgcuaacgucucccuggccgcuaucgccaaccaagcggugguccucauggggcuggauaaaggauggcccauuucuaagauggaccuuggcgugccucugcucgcccuggggugcuacagccagguuaauccccugacccucacagcugccgugcuucugcuggucacgcacuaugcuaucaucggaccuggccuccaggccaaagccacccgggaggcgcagaagagaacagcugccgggauuaugaaaaaccccaccguggauggaaucaugacaauugaccuggauccuguuaucuacgacuccaaguucgagaagcaacuuggccaggugaugcugcucguccugugugcugugcagcugcuccuuaugcgcaccucuugggcccugugcgaagcccugacgcucgcuacaggcccgauuaccacccugugggaggggagccccggaaaauuuuggaauacaaccaucgccguguccauggcgaacaucuuccggggcagcuaucuugccggggcuggacuggccuuuucuauuaugaaguccguuggcacagggagacggggaacgggcagccagggcgaaacccucggggagaaauggaagaaaaagcugaaucaacugucccgcaaggaguucgaucucuacaaaaagucuggaaucacagaggucgacagaaccgaggcuaaagaaggccuuaagagaggggaaacaacccaucacgccgugagccgcggauccgcgaaacugcagugguuuguggaaagaaacauggucauuccugagggccggguuaucgaucugggguguggacgcggcggcuggucuuauuacugcgccgggcucaagaaagugacggaagugagaggauauaccaagggcgggcccggacaugaggagccuguccccaugagcacauacggcuggaaucuggugaaacuuauguccgggaaagacguuuucuaccugccgccugaaaagugugauacccuccugugcgacauuggagagagcucucccucccccacaguggaagagagccggaccauccgcguccugaaaaugguggagccuuggcucaagaacaaucaguucuguauuaaaguucuuaaccccuauaugccuacagugaucgaacaccuggagagacugcagcggaaguacggcggcaugcucgucagaaauccgcugucucgcaacuccacccacgaaauguauuggaucagcaaugggacgggaaacauugugucuagcgugaauauggucucccggcuucugcucaacagauuuacaaugacccaucgccggcccaccaucgagaaggauguugaccugggcgcugggacaagacacgugaacgccgaaccugagacgcccaauauggacgugauuggagagcgcaucaaacggauuaaggaagaacauucuagcaccuggcacuacgaugacgaaaacccuuauaaaacaugggcuuaccacggcuccuaugaggucaaggccaccgggagcgcuuccucuaugaucaauggagugguuaaacugcucacaaagcccugggauguggucccgauggugacccaaauggccaugacagacaccacgccuuucggccagcagagaguuuuuaaggaaaaaguggauacccgcacaccccggccuaugcccggcaccagaaaggucauggagaucacagcggaguggcuguggcgcacccuugggcggaacaaaaagccuagacugugcacgcgcgaagaguucaccaagaaggugagaaccaaugccgcuaugggagccguuuuuacagaagagaaccaaugggacagcgcucgggccgccguggaagaugaggaguucuggaagcucgucgaccgcgaaagagagcugcauaaacuuggcaaguguggguccugcguguacaauaugaugggaaaacgggaaaagaaacugggcgaguuugggaaggcgaaaggcucuagagcuauuugguacauguggcucggagcccgguaucuggaguucgaagcccugggcuuucucaacgaggaucacugguucagccgcgaaaauuccuacucuggggucgagggagaaggccugcauaaacuuggguauauccugagagacauuagcaagauccccggaggcgcuauguacgccgaugacaccgcugggugggacacgcggauuaccgaggaugaccuccacaacgaggagaaaaucacacagcagauggauccggagcaucgcaagcuggccaaugcgaucuuuaaacuuaccuaucagaacaaggugguuaaagugcaaagaccuacacccaagggcaccgucauggacauuaucucccggaaggaucagcgcggaagcggccagguggggacauacggacugaauaccuucacgaacauggaagcccagcucgugagacaaauggagggcgaagggguucugucuaaagcugaccuggagaauccccaccuccuggagaagaaaauuacacaguggcuugaaaccaagggaguggagcggcugaaacgcauggccaucuccggcgaugacugcgucgugaagccuauugaugacagauuugcuaacgcccuccuggcgcuuaacgauauggggaagguucggaaagacaucccgcaguggcagcccagcaagggcuggcacgauuggcaacaggugccuuucuguucucaucacuuccaugaacugaucaugaaagacggacgcaagcucgucgugcccugcagaccucaggacgagcugauuggccgggcccgcaucucccagggggcuggauggagccugaaagaaaccgccugucucggcaaggcuuaugcccaaauguggucucugauguacuuucacagacgggaucuuagacuggcuuccaaugccauuugcagcgcgguccccgugcacuggaucccuacaucccgcaccacauggagcauucaugcccaccaucaguggaugacgaccgaggacaugcucacaguuuggaaccggguguggaucgaggauaaucccuggauggaagacaagaccccggucacaaccugggaggaugugccuuaccuggggaaaagagaagaccagugguguggaucucuuauuggccugacgagccgcgcuaccugggcccaaaacauccucacagccauccagcagguucggucccugauuggggaugaggaguuccuggacuauaugcccucuaugaagagauuucgcaaagaagaggaaagcgagggcgcuaucugguga

SEQ ID NO: 20858 - RNA, 9873 nt, Artificial Sequence
  derived and/or modified CDS sequence (opt5) from DENV-3__FJ461329__SS-prME
accagccugugccucaugaugaugcugcccgccacacuugcuuuccaccugacgucccgggacggcgaaccucggaugaucguggggaagaaugaacgcggaaagucucuccuguuuaagaccgccagcggcauuaauauguguacacuuaucgcgauggaucugggggaaaugugcgacgauaccgucacauacaaguguccgcucauugcugaaguugagcccgaagacaucgauugcugguguaaccugaccuccacaugggugaccuauggaacgugcaaucaggccggcgagcaucggcgggacaagcgcucuguggcccuggcuccucacgucgggaugggacucgauaccagaacacagaccuggaugagcgccgagggcgcuuggagacagguggaaaagguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaaacccacgcucgacaucgagcugcagaagaccgaagcuacacagcuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggucacaugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccucgcaccggacuugauuucaaugagaugauccugcucacgaugaaaaacaaggcuuggaugguccacagacagugguuuuucgaccugccccuuccguggaccagcggcgccacaaccgagacaccuaccuggaaucggaaagaacugcucgugacguuuaagaacgcccaugcuaaaaagcaagagguugugguccuggggucucaggaaggagcgaugcacacagcccugaccggcgcuacagagauucaaaauuccgggggcaccagcaucuucgccggacaccucaagugucgccugaaaauggauaaacuugaacugaaaggcaugucuuacgccaugugccucaacaccuuugugcugaagaaagagguuuccgagacacagcaugggacgauucugaucaagguggaauacaagggagaggacgcucccuguaaaaucccuuucagcaccgaagauggccaagggaaggcccacaacggaagacuuauuacagcgaaucccgucgugaccaaaaaggaggagcccgugaacaucgaagcugagccuccguucggcgaauccaauauuguuaucgggauuggcgacaaagcccucaagaucaacugguauaagaaaggaucuagcaucggcaagauguuugaggccacagcuagaggggccagacgcauggcuauucugggagauaccgccugggacuucggcuccgucgggggagugcugaauagccucggcaaaauggugcaucagaucuuugggucugcguacacggcccuguucuccggcgucagcuggauuaugaagaucggaauuggcgugcuucugacauggaucgggcucaacucuaaaaauaccagcauguccuuuucuugcauuguuaucggaaucauuacccuguaucugggcgcugugguccaggccgauauggggugugcuaucaacuggaagggaaaggaacuuaaaugcggcagcgggauuuucgugacaaaugagguucacaccuggacagagcaguacaaguuucaagccgacucccccaaacggcucgcgacggccaucgcuggcgccugggaaaacggaguguguggcauuagaagcaccacacgcauggagaaucugcuguggaagcagaucgcuaacgaacucaauuauauccugugggagaacaauauuaaacuuaccgucgugguuggggauaucauuggagugcuggaacagggcaagcggacacucaccccucagcccauggagcugaaauacucuuggaagacgugggggaaggccaaaaucgucaccgccgagacacaaaacuccagcuucauuaucgacggaccuaacacccccgaaugcccgucugcuuccagagcguggaaugugugggagguggaagacuauggcuuuggcgucuucacaaccaacaucuggcugaaacuucgcgagguuuacacacagagcugugaucaucggcucauguccgccgcuauuaaagacgaaagagccgugcacgccgauaugggguacuggaucgagucucagaagaauggaagcuggaaacuggagaaggcuuccuuuauugaagugaagaccugcacguggccuaaaucucacacacuguggagcaacggcguccucgaguccgacaugaucauucccaagagccuggccgggccuaucucucagcauaaucaccgccccggauaucauacccaaaccgcgggcccuuggcaccuugggaaacuggaacucgauuucaacuacugcgagggaacaaccgugguuaucacggaggacuguggcacacggggccccucccugagaaccacaaccgugagcgggaagcugauucacgaauggugcugucgcucuugcacacuuccgccucuccgguauaugggagaggauggcuguugguacgggauggaaaucagacccauuaaugagaaagaagagaacauggucaagucccuggugagcgcuggaucuggcaagguugacaauuuuaccaugggggugcugugccucgccauccuguucgaggaagucaugcggggaaaauucggcaagaaacauaugauugccggcgugcuuuuuacguucguucugcuccugagcgggcagaucaccuggcgcgauauggcucacacacugauuaugaucggauccaacgccagcgacagaaugggcaugggggugaccuaucuugcgcugaucgcuacauuuaagauucagcccuuccucgcccugggauuuuuccuccggaaacugaccucuagagagaaucuucugcucggcgucgggcuggccauggcuacgacacugcaacuuccugaagauaucgagcagauggccaacggaauugcucugggccucaugacccugaagcucaucacacaguuugaaaccuaccagcuguggaccgcccuugugucccugacauguagcaauacgauuuucacccucacaguggcguggcgcaccgccacacugauccuggcuggcgucucccuucugccgcucugccaaucuagcuccaugcggaagaccgacuggcugcccaugacgguugccgcuaugggggugccuccccucccucuguuuaucuucucucuuaaagauacacccaagagacgcagcuggccucugaacgagggagugauggccgucggccugguguccauucucgccucuagccugcuuagaaaugacguucccauggcugggccgcugguggcgggaggccuccugaucgccuguuaugucauuaccgggaccuccgcugaccucacaguggagaaagccgccgauguuaccugggaagaggaagcugagcagacaggagugagccauaaccugaugaucacggucgacgaugacggcaccaugcggauuaaggaugacgaaacagagaacauccuuaccgugcugcugaaaacagcccuccugaucgucucuggcauuuuuccuuacuccauccccgcgacccuucugguguggcacacguggcagaagcagacccaacgcagcgggguucucugggaugugccuucucccccggagacacagaaagcugaacuggaggaaggagucuacagaauuaagcagcagggcaucuucgggaagacccaagugggaguuggcgugcagaaagagggggucuuucauacaauguggcacgugacccggggagccgugcucacacacaauggcaagcgccuggagccuaacugggccuccguuaaaaaggaccuuauuagcuauggcgggggauggagacugucugcucaguggcaaaaaggcgaagagguccaggugaucgccguggaacccgggaagaauccuaagaacuuccagacgaugcccggaauuuuccagaccacaaccggcgagaucggggcgaucgcucuggauuuuaaacccggaaccuccggcagcccuauuaucaaucgggaaggcaaggucguggggcucuacggaaacggcguugugaccaagaaugggggauaugucuccggcauugcccaaacgaacgccgagccggacgggcccaccccugagcuggaagaggaaauguucaagaaacgcaaucuuacaaucauggaucugcaucccggcagcggaaagaccagaaaguaccucccugcuauugugcgggaggccaucaaacgcagacugcggacacucauccuggcucccaccagaguuguggccgcggaaauggaggaggcccuuaagggccugccuauucgcuaucagacgacagcuaccaaaucugaacacaccgggcgggagaucgucgaccugaugugccaugccacauuuaccaugagacuccugagcccggugcgcguucccaacuacaaucuuauuaucauggaugaagcucacuucacagacccugccuccauugccgcucggggauauaucucuaccagagugggcaugggggaggcggccgcuaucuuuaugacggccacacccccuggaaccgccgaggcuuucccccagagcaacgccccgauucaggacgaggagcgcgauaucccugaacgguccuggaacucuggcaacgaguggauuacagacuuugucgggaagaccgugugguucgugcccagcaucaaagcgggcaaugauauugcuaacugucugagaaagaacggaaagaaagucauccaacucucccgcaagacguuugacaccgaauaccagaaaacacggcugaaugauugggacuucguugugaccacagauauuucugagaugggcgccaacuuuaaggccgacagagugaucgauccccggcgcugccugaaaccugucauccucaccgacgggcccgagagagugauucuugcuggaccuaugccgguuacagccgcgagcgccgcucagcggcgcggcagaguggggcggaauccccagaaggaaaacgaucaauacaucuucaccggacagccucugaauaacgacgaggaccaugcccacuggacggaagcuaagaugcugcucgauaauauuaacacacccgagggcaucauuccugcccuguucgaacccgagagagagaaauccgcugccaucgacggggaauaucgccuuaagggcgagagccggaaaaccuuugucgaacugaugagacgcggagaucucccgguguggcuggcgcacaagguugccucugagggcaucaaauacaccgaccggaaguggugcuucgauggggaaagaaauaaccagauucuggaggagaauauggacguggaaaucuggacaaaagagggagaacgcaagaagcuccggccuagauggcuugaugcucgcaccuauuccgacccccuggcccugaaagaguuuaaggauuucgcugccggcagaaaaagcauugcccucgaccuggucacagaaaucgggcgggugccuucucaucuugcuuaccgcacgagaaacgcgcuggauaaucucgucaugcugcacaccuccgagcauggaggccgggccuaucgccacgcuguggaggaacugcccgagacaauggaaacccuccuucugcugggccucaugauucugcuuacagggggagccaugcuguuucucaucagcggcaaggggaucggaaaaaccuccauuggccugaucuguguuauugugucuagcgggaugcuguggauggccgacaucccucuccaguggauugcuuccgccaucgugcuugaguucuuuaugaugguccugcugauucccgagccggaaaagcaaagaacgccucaggauaaccagcucgcguacguugugaucggaauccugacccuugccgcuauuguggccgcuaaugagaugggccugcucgaaacaaccaagcgggaccugggcaugagcaaagagcccggggucgugucucccacauccuaucuggacguugaucuccacccugccagcgcguggacccuuuacgccguggcuacgacagucaucaccccgaugcugagacauacaauugaaaacucuaccgccaaugugagccuggcugccaucgcuaaccaagccgucgugcucaugggacuggacaagggcuggcccauuuccaaaauggaucuugggguuccucugcucgcgcugggaugcuacucucaggugaacccccugacccucacagccgcuguccuucugcuggugacgcacuaugccaucaucggcccugggcuccaggcuaaggccacccgcgaggcccagaaacggacagcggcuggaauuaugaagaaucccaccguugacggcaucaugacaauugaucuggacccugugaucuacgauagcaaguucgagaaacaacuuggccaggucaugcugcucgugcugugugccgugcagcugcuccuuaugagaaccuccugggcucugugcgaagcccugacgcucgccacagggccgauuaccacccugugggagggaucucccggcaaguuuuggaacacaaccaucgcuguuagcauggccaauaucuuccgcggguccuaucuugcgggagccggccuggcuuuuagcauuaugaaaucugucgggacaggacggagaggcacgggcucccagggggaaacccucggagagaaguggaaaaagaagcugaaccaacugagccggaaagaguucgaccucuacaagaaauccggcaucacagagguggaucgcaccgaggccaaggaagggcuuaaaagaggagagacaacccaucacgcugugucucggggcagcgccaagcugcagugguuugucgaacgcaauaugguuauuccugaggggagagugaucgaccugggauguggccggggcgggugguccuauuacugcgcgggacucaaaaaggugacggaaguccgcggcuauaccaaaggcgggcccgggcaugaggagccugugcccaugucuacauacggguggaaccugguuaaacuuaugagcggaaaggauguguucuaccugccgccugaaaaaugugacacccuccugugcgauauuggcgaguccagccccucucccacagucgaagaguccagaaccauccgggugcugaagaugguugagccuuggcucaaaaauaaccaguucuguauuaaggugcuuaaucccuauaugccuacagucaucgaacaccuggagcgccugcagagaaaguacggcgggaugcucgugcggaacccgcugagcagaaauucuacccacgaaauguauuggaucuccaacggaacgggcaauauugugagcucugucaacaugguuagccgccuucugcucaaucgguuuacaaugacccauagacgccccaccaucgagaaagacguggaccugggggccggaacacggcacgugaacgcugaaccugagacgcccaacauggaugucauuggcgagagaaucaagcgcauuaaagaagaacauuccucuaccuggcacuacgacgaugaaaauccuuauaagacaugggccuaccacgggagcuaugaggugaaagcuaccggauccgccagcuccaugaucaacggcguugugaagcugcucacaaagcccugggacgucgugccgaugguuacccaaauggcuaugacagauaccacgccuuucggccagcagcggguguuuaaagaaaaggucgacaccagaacaccccgcccuaugcccgggacccggaaagugauggagaucacagccgaguggcuguggagaacccuuggacgcaauaagaaaccucggcugugcacgagagaagaguucacaaagaagguucgcaccaacgcggccaugggcgcuguguuuacagaagagaaucaaugggauucugccagagcugccgucgaagacgaggaguucuggaaacucguggaucgggaacgcgagcugcauaaacuugggaaauguggaagcugcgucuacaacaugaugggcaagagagagaagaagcugggggaguuuggcaaagccaagggaucccgggcgauuugguacauguggcucggcgcuagauaucuggaguucgaagcccugggguuucucaaugaggaccacugguucucucgggaaaacagcuacuccggaguggagggcgaagggcugcauaaacuuggauauauccugcgcgauauuucuaaaauccccggcggggccauguacgcugacgacaccgccggcugggauacgagaauuaccgaggacgaucuccacaaugaggaaaagaucacacagcagauggacccggagcaucggcagcuggcuaacgccaucuuuaaacuuaccuaucaaaauaagguugugaaaguccagcgcccuacacccaagggaaccgugauggauauuaucagcagaaaggaccagcggggcuccggacaggugggaacauacggccugaacaccuucacgaauauggaagcgcaacucguucgccagauggagggggaaggagugcugagcaaagccgaucuggagaacccccaccuccuggagaagaaaauuacacaguggcuugaaaccaagggcgucgagagacugaaacggauggcuaucucuggggacgauugcgugguuaagccuauugacgaucgcuuugccaaugcucuccuggcccuuaacgacaugggcaaggugagaaaagauaucccgcaguggcaacccuccaagggauggcacgacuggcagcaggucccuuucuguagccaucacuuccaugaacugaucaugaaagacggccggaagcucgugguccccugccgcccucaggaugagcugauugggagagcgcggaucucucaaggagccggcuggucccugaaagaaaccgcuugucucgggaaggccuaugcucagauguggagccugauguacuuucaccgcagagaccuucggcuggccucuaacgcuauuugcuccgccgugcccguucacuggaucccuacaagcagaaccacaugguccauucaugcgcaccaucaguggaugacgaccgaggauaugcucacaguguggaaucgcgucuggaucgaggacaaccccuggauggaagauaagaccccggugacaaccugggaggacguuccuuaccugggaaaacgggaagaucaaugguguggcagccuuauugggcugacgucuagagccaccugggcucagaauauccucacagccauccaacaggugcgcagccugauuggcaacgaggaguuccuggacuauaugcccuccaugaagcgguuuagaaaagaagaggaaucugagggagccaucugguga

SEQ ID NO: 20859 - RNA, 9873 nt, Artificial Sequence
  derived and/or modified CDS sequence (opt5) from DENV-3__KF955459__SS-prME
accagccugugccucaugaugaugcugcccgccacccuugcuuuccaccugacgucccgggacggcgaaccucggaugaucguggggaagaacgaacgcggaaagucucuccuguuuaagaccgccagcggcauuaauauguguacacuuaucgcgauggaucugggggagaugugcgacgauaccgucacauacaaguguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacagaccuggaugagcgccgagggcgcuuggcggcaggucgaaaagguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaagcccacgcucgacaucgagcugcagaagaccgaagcuacacagcuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggugaccugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccucgcaccggacuugauuucaaugagaugauccugcucacgaugaaaaacaaggcuuggaugguccacagacagugguuuuucgaccugccccuuccguggaccagcggcgccacaaccgagacaccuaccuggaaucggaaagaacugcucgugacguuuaagaacgcccaugcuaaaaagcaagagguugugguccuggggucucaggaaggagcgaugcacacagcccugaccggcgcuacagagauucaaaauuccgggggcaccagcaucuucgccggacaccucaagugucgccugaaaauggauaaacuugaacugaaaggcaugucuuacgccaugugccucaacaccuuugugcugaagaaagagguuuccgagacacagcaugggacgauucugaucaagguggaauacaagggagaggacgcucccuguaaaaucccuuucagcaccgaagauggccaagggaaggcccacaacggaagacuuauuacagcgaaucccgucgugaccaaaaaggaggagcccgugaacaucgaagcugagccuccguucggcgaauccaauauuguuaucgggauuggcgacaaagcccucaagaucaacugguauaagaaaggaucuagcaucggcaagauguuugaggccacagcuagaggggccagacgcauggcuauucugggagauaccgccugggacuucggcuccgucgggggagugcugaauagccucggcaaaauggugcaucagaucuuugggucugcguacacggcccuguucuccggcgucagcuggauuaugaagaucggaauuggcgugcuucugacauggaucgggcucaacucuaaaaauaccagcauguccuuuucuugcauuguuaucggaaucauuacccuguaucugggcgcugugguccaggccgauauggggugugcuaucaacuggaagggaaaggaacuuaaaugcggcagcgggauuuucgugacaaaugagguucacaccuggacagagcaguacaaguuucaagccgacucccccaaacggcucgcgacggccaucgcuggcgccugggaaaacggaguguguggcauuagaagcgcuacccgcauggagaaucugcuguggaagcagaucgccaacgaacucaauuauauccugugggagaacaauauuaaacuuacagucgugguuggggauaucauuggagugcuggaacagggcaagcggacccucacaccucagcccauggagcugaaauacucuuggaagaccugggggaaggccaaaaucgucacggcugagacccaaaacuccagcuucauuaucgacggaccuaacacacccgaaugcccgucugcguccagagccuggaaugugugggagguggaagacuauggcuuuggcgucuucaccacaaacaucuggcugaaacuucgcgagguuuacacccagagcugugaucaucggcucauguccgcugccauuaaagacgaaagagccgugcacgcugauaugggguacuggaucgagucucagaagaauggaagcuggaaacuggagaaggccuccuuuauugaagugaagacaugcaccuggccuaaaucucacacgcuguggagcaacggcguccucgaguccgacaugaucauucccaagagccuggcggggccuaucucucagcauaaucaccgccccggauaucauacacaaaccgcuggcccuuggcaccuugggaaacuggaacucgauuucaacuacugcgagggaaccacagugguuaucaccgagaauuguggcacgcggggccccucccugagaacaaccacagugagcgggaagcugauucacgaauggugcugucgcucuugcacccuuccgccucuccgguauaugggagaggacggcuguugguacgggauggaaaucagacccauuaacgagaaagaagagaauauggucaagucccuggugagcgccggaucuggcaagguugauaacuuuacaaugggggugcugugccucgccauccuguucgaggaagucaugcggggaaaauucggcaagaaacauaugauugcuggcgugcuuuuuaccuucguucugcuccugagcgggcagaucacguggcgcgacauggcccacacccugauuaugaucggauccaaugcgagcgauagaaugggcaugggggugacauaucuugcucugaucgccaccuuuaagauucagcccuuccucgcccugggauuuuuccuccggaaacugacaucuagagagaaccuucugcucggcgucgggcuggcuauggccaccacgcugcaacuuccugaagacaucgagcagauggcuaauggaauugcccugggccucaugacacugaagcucaucacccaguuugaaacauaccagcuguggaccgcgcuugugucccugaccuguagcaacacaauuuucacgcucaccguggccuggcgcacagcuacccugauccuggccggcgucucccuucugccgcucugccaaucuagcuccaugcggaagacagauuggcugcccaugaccguugcugccaugggggugccuccccucccucuguuuaucuucucucuuaaagacacgcccaagagacgcagcuggccucugaaugagggagugauggccgucggccugguguccauucucgcuucuagccugcuuagaaacgauguucccauggcggggccgcugguggccggaggccuccugaucgcuuguuaugucauuacagggaccuccgccgaccucaccguggagaaagccgcugacguuacaugggaagaggaagccgagcagaccggagugagccauaaccugaugaucacagucgaugacgauggcacgaugcggauuaaggacgaugaaaccgagaauauccuuacagugcugcugaaaaccgcgcuccugaucgucucuggcauuuuuccuuacuccauccccgcuacacuucugguguggcacaccuggcagaagcagacgcaacgcagcgggguucucugggacgugccuucucccccggagacccagaaagccgaacuggaggaaggagucuacagaauuaagcagcagggcaucuucgggaagacacaagugggaguuggcgugcagaaagagggggucuuucauaccauguggcacgugacacggggagccgugcucacccacaacggcaagcgccuggagccuaauugggcuuccguuaaaaaggaucuuauuagcuauggcgggggauggagacugucugcccaguggcaaaaaggcgaagagguccaggugaucgcgguggaacccgggaagaacccuaagaauuuccagacaaugcccggaauuuuccagacgaccacaggcgagaucggggcuaucgcccuggacuuuaaacccggaaccuccggcagcccuauuaucaaccgggaaggcaaggucguggggcucuacggaaauggcguugugaccaaaaacgggggauaugucuccggcauugcccaaacaaaugcugagccggaugggcccacgccugagcuggaagaggaaauguucaagaaacgcaaccuuaccaucauggaccugcaucccggcagcggaaagacaagaaaguaccucccugccauugugcgggaggcuaucaaacgcagacugcggacccucauccuggcccccacaagaguuguggcggccgaaauggaggaggcucuuaagggccugccuauucgcuaucagaccacggccacaaaaucugaacacaccgggcgggagaucgucgaucugaugugccaugcuaccuuuacaaugagacuccugagcccggugcgcguucccaauuacaaccuuauuaucauggacgaagcccacuucaccgauccugccuccauugcugcgcggggauauaucucuacaagagugggcaugggggaggccgcugccaucuuuaugaccgccacgcccccuggaacagcugaagccuucccccagagcaaugcgccgauucaggacgaggagcgcgacaucccugaacgguccuggaacucuggcaaugaguggauuaccgauuuugucgggaagacagugugguucgugcccagcaucaaagcuggcaacgacauugccaacugucugagaaagaauggaaagaaagucauccaacucucccgcaagaccuuugauacggaauaccagaaaacccggcugaacgacugggauuucguugugacaaccgacauuucugagaugggcgccaauuuuaaggcugauagagugaucgacccccggcgcugccugaaaccugucauccucacagaugggcccgagagagugauucuugccggaccuaugccgguuaccgcggccagcgcugcccagcggcgcggcagaguggggcggaacccccagaaggaaaaugaccaauacaucuucacaggacagccucugaacaaugaugaggaccaugcucacuggaccgaagccaagaugcugcucgacaacauuaauacgcccgagggcaucauuccugcucuguucgaacccgagagagagaaauccgccgcgaucgauggggaauaucgccuuaagggcgagagccggaaaacauuugucgaacugaugagacgcggagaccucccgguguggcuggcccacaagguugcuucugagggcaucaaauacaccgaucggaaguggugcuucgacggggaaagaaacaaucagauucuggaggagaacauggauguggaaaucuggaccaaagagggagaacgcaagaagcuccggccuagauggcuugacgcccgcacauauuccgauccccuggcucugaaagaguuuaaggacuucgccgccggcagaaaaagcauugcucucgaucuggucaccgaaaucgggcgggugccuucucaucuugcguaccgcacaagaaaugcccuggacaaccucgucaugcugcacacguccgagcauggaggccgggcuuaucgccacgccguggaggaacugcccgagaccauggaaacacuccuucugcugggccucaugauucugcuuaccgggggagccaugcuguuucucaucagcggcaaggggaucggaaaaacauccauuggccugaucuguguuauugugucuagcgggaugcuguggauggcugaugugccucuccaguggaucgccuccgcgauuauccuugaguucuuuaugaugguccugcugauucccgagccggaaaagcaaagaaccccucaggacaaucagcucgccuacguugugaucggaauccugacgcuugcugccauuguggcugccaacgagaugggccugcucgaaaccacaaagcgggaucugggcaugagcaaagagcccggggucgugucucccaccuccuaucuggacguugaccuccacccugcgagcgccuggacacuuuacgcuguggccaccacggucaucacaccgaugcugagacauaccauugaaaauucuacagcuaacgugagccuggccgcuaucgccaaccaagcggucgugcucaugggacuggauaagggcuggcccauuuccaaaauggaccuugggguuccucugcucgcccugggaugcuacucucaggugaauccccugacccucaccgcugccguccuucugcuggugacacacuaugcuaucaucggcccugggcuccaggccaaggccacgcgcgaggcgcagaaacggaccgcugccggaauuaugaagaaccccacaguugauggcaucaugaccauugaccuggauccugugaucuacgacagcaaguucgagaaacaacuuggccaggucaugcugcucgugcugugugcugugcagcugcuccuuaugagaacauccugggcccugugcgaagcccugacccucgcuacggggccgauuacaacccugugggagggaucucccggcaaguuuuggaauaccacaaucgccguuagcauggcgaacaucuuccgcggguccuaucuugccggagcuggccuggccuuuagcauuaugaaaucugucgggaccggacggagaggcacaggcucccagggggaaacgcucggagagaaguggaaaaagaagcugaaucaacugagccggaaagaguucgaucucuacaagaaauccggcaucaccgagguggaccgcacagaggcuaaggaagggcuuaaaagaggagagaccacacaucacgccgugucucggggcagcgcgaagcugcagugguuugucgaacgcaacaugguuauuccugaggggagagugaucgaucugggauguggccggggcgggugguccuauuacugcgccggacucaaaaaggugaccgaaguccgcggcuauacgaaaggcgggcccgggcaugaggagccugugcccaugucuaccuacggguggaaucugguuaaacuuaugagcggaaaggacguguucuaccugccgccugaaaaaugugauacacuccugugcgacauuggcgaguccagccccucucccaccgucgaagaguccagaacaauccgggugcugaagaugguugagccuuggcucaaaaacaaucaguucuguauuaaggugcuuaaccccuauaugccuaccgucaucgaacaccuggagcgccugcagagaaaguacggcgggaugcucgugcggaauccgcugagcagaaacucuacacacgaaauguauuggaucuccaauggaaccggcaacauugugagcucugucaauaugguuagccgccuucugcucaaccgguuuacgaugacacauagacgccccaccaucgagaaagauguggaccugggggcuggaacccggcacgugaacgccgaaccugagacacccaauauggacgucauuggcgagagaaucaagcgcauuaaagaagaacauuccucuacguggcacuacgaugacgaaaacccuuauaagaccugggcuuaccacgggagcuaugaggugaaagccacaggauccgcuagcuccaugaucaauggcguugugaagcugcucaccaagcccugggaugucgugccgaugguuacacaaauggccaugaccgacacaaccccuuucggccagcagcggguguuuaaagaaaaggucgauacgagaacaccccgcccuaugcccgggacacggaaagugauggagaucaccgcggaguggcuguggagaacacuuggacgcaacaagaaaccucggcugugcaccagagaagaguucacgaagaagguucgcacaaaugccgcuaugggcgccguguuuaccgaagagaaccaaugggacucugcuagagccgccgucgaagaugaggaguucuggaaacucguggaccgggaacgcgagcugcauaaacuugggaaauguggaagcugcgucuacaauaugaugggcaagagagagaagaagcugggggaguuuggcaaagcgaagggaucccgggcuauuugguacauguggcucggcgccagauaucuggaguucgaagcccugggguuucucaacgaggaucacugguucucucgggaaaauagcuacuccggaguggagggcgaagggcugcauaaacuuggauauauccugcgcgacauuucuaaaauccccggcggggcuauguacgccgaugacacagcuggcugggacaccagaauuacggaggaugaccuccacaacgaggaaaagaucacccagcagauggauccggagcaucggcagcuggccaaugcgaucuuuaaacuuacauaucaaaacaagguugugaaaguccagcgcccuacccccaagggaacagugauggacauuaucagcagaaaggaucagcggggcuccggacaggugggaaccuacggccugaauacauucaccaacauggaagcccaacucguucgccagauggagggggaaggagugcugagcaaagcugaccuggagaauccccaccuccuggagaagaaaauuacgcaguggcuugaaacaaagggcgucgagagacugaaacggauggccaucucuggggaugacugcgugguuaagccuauugaugaccgcuuugcuaacgcccuccuggcgcuuaacgauaugggcaaggugagaaaagacaucccgcaguggcaacccuccaagggauggcacgauuggcagcaggucccuuucuguagccaucacuuccaugaacugaucaugaaagacggccggaagcucgugguccccugccgcccucaggacgagcugauugggagagcccggaucucucaaggagcuggcuggucccugaaagaaaccgccugucucgggaaggcuuaugcccagauguggagccugauguacuuucaccgcagagaucuucggcuggcuucuaaugccauuugcuccgcggugcccguucacuggaucccuaccagcagaacaaccugguccauucaugcccaccaucaguggaugacaacggaggacaugcucaccguguggaaccgcgucuggaucgaggauaaucccuggauggaagacaagacaccggugaccacaugggaggauguuccuuaccugggaaaacgggaagaccaaugguguggcagccuuauugggcugaccucuagagcuacgugggcccagaacauccucaccgccauccaacaggugcgcagccugauuggcgaugaggaguuccuggacuauaugcccuccaugaagcgguuuagaaaagaagaggaaucugagggagcuaucugguga

SEQ ID NO: 20860 - RNA, 9873 nt, Artificial Sequence
  derived and/or modified CDS sequence (opt5) from DENV-3__FJ547066__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauugcugaaauggagcccgaagacaucgauugcugguguaaccugaccuccacauggguuaccuauggaacgugcaaucaggccggcgagcauagacgggacaagcgcucuguggcccuggcuccucacguggggaugggacucgauaccagaacacaaaccuggaugagcgccgagggcgcuuggcggcaggucgaaaaaguggagacaugggcccugcgccaucccggcuucaccauucuugcgcuguuucucgcccacuacaucgggacgucccugacacagaagguugugaucuucauucuucugaugcucgucaccccuucuaugacaaugagaugugugggaguuggcaaccgggacuuuguggaagggcugagcggagcuaccugggucgauguggugcuggagcauggcgggugcgucaccacaauggccaagaauaaacccacgcucgacaucgagcugcagaagaccgaagcuacacaacuugccacccugcgcaaacucuguauugagggaaagaucacaaacauuaccacggauuccagaugcccuacacagggcgaagcgauccugccggaggaacaggaccagaauuauguuuguaaacacaccuacguggaucggggcugggggaacggaugcggccuuuucgggaagggaagccuggugaccugcgccaaguuucaaugucucgagcccauugagggcaaagucgugcaguaugaaaaucugaaguacacaguuaucaucaccgugcacacaggggaccagcaucaggucggaaacgacacgcaaggcgugaccguugagauuacaccucaggcuucuaccguggaagccguccugcccgaguauggcacacucgggcuggaaugcuccccucgcaccggacuugauuucaaugagaugauccugcucacgaugaaaaacaaggcuuggauggugcacagacagugguuuuucgaccugccccuuccguggaccagcggcgccacaaccgagacaccuaccuggaaucggaaagaacugcucgucacguuuaagaacgcccaugcuaaaaagcaagaggugguugugcuggggucucaggaaggagcgaugcacacagcccugaccggcgcuacagagauucagaauuccgggggcaccagcaucuucgccggacaccucaagugucgccugaaaauggauaagcuugaacugaaaggcaugucuuacgccaugugccucaacaccuuuguccugaagaaagagguguccgagacacagcaugggacgauucugaucaagguugaauacaagggagaggacgcucccuguaaaaucccuuucagcaccgaagauggccaagggaaggcccacaacggaagacuuauuacagcgaaucccguggucaccaaaaaggaggagcccgugaacaucgaagcugagccuccguucggcgaauccaauauugugaucgggauuggcgacaaagcccucaagaucaacugguauaagaaaggaucuagcaucggcaagauguuugaggccacagcucggggggccagacgcauggcuauucugggagauaccgccugggacuucggcuccguugggggaguccugaauagccucggcaaaauggugcaucagaucuuugggucugcguacacggcccuguucuccggcgugagcuggauuaugaagaucggaauuggcguccuucugacauggaucgggcucaacucuaaaaauaccagcauguccuuuucuugcauugugaucggaaucauuacccuguaucugggcgcuguugugcaggccgauauggggugugcuaucaacuggaagggaaaggaacuuaaaugcggcagcgggauuuucgucacaaaugaggugcacaccuggacagagcaguacaaguuucaagccgacucccccaaacggcucgcgacggccaucgcuggcgccugggaaaacggaguuuguggcauuagaagcaccacacgcauggagaaucugcuguggaagcagaucgcuaacgaacucaauuauauccugugggagaacaauauuaaacuuaccguggucgugggggauaucauuggaguucuggaacagggcaagcggacacucaccccucagcccauggagcugaaauacucuuggaagacgugggggaaggccaaaaucgugaccgccgagacacaaaacuccagcuucauuaucgacggaccuaacacccccgaaugcccgucugcuuccagagcguggaaugucugggagguggaagacuauggcuuuggcguguucacaaccaacaucuggcugaagcuucgcgaggucuacacacagagcugugaucaucggcucauguccgccgcuauuaaagacgaaagagccguucacgccgauaugggguacuggaucgagucucagaagaauggaagcuggaaacuggagaaggcuuccuuuauugaagugaagaccugcacguggccuaaaucucacacacuguggagcaacggcgugcucgaguccgacaugaucauucccaagagccuggccgggccuaucucucagcauaaucaccgccccggauaucauacccaaaccgcgggcccuuggcaccuugggaaacuggaacucgauuucaacuacugcgagggaacaaccgucgugaucacggagaauuguggcacacggggccccucccugagaaccacaaccguuagcgggaagcugauucacgaauggugcugucgcucuugcacacuuccgccucuccgguauaugggagaggacggcuguugguacgggauggaaaucagacccauuaacgagaaagaagagaauauggugaagucccuggucagcgcuggaucuggcaagguggauaacuuuaccauggggguucugugccucgccauccuguucgaggaagugaugcggggaaaauucggcaagaaacauaugauugccggcguccuuuuuacguucgugcugcuccugagcgggcagaucaccuggcgcgacauggcucacacacugauuaugaucggauccaaugccagcgauagaaugggcauggggguuaccuaucuugcgcugaucgcuacauuuaagauucagcccuuccucgcccugggauuuuuccuccggaaacugaccucuagagagaaccuucugcucggcguggggcuggccauggcuacgacacugcaacuuccugaagacaucgagcagauggccaauggaauugcucugggccucaugacccugaagcucaucacacaguuugaaaccuaccagcuguggaccgcccuugucucccugacauguagcaacacgauuuucacccucacaguggcguggcgcaccgccacacugauccuggcuggcgugucccuucugccgcucugccaaucuagcuccaugcggaagaccgauuggcugcccaugacggucgccgcuauggggguuccuccccucccucuguuuaucuucucucuuaaagacacacccaagagacgcagcuggccucugaaugagggagugauggccgugggccuggucuccauucucgccucuagccugcuuagaaacgaugugcccauggcugggccgcugguugcgggaggccuccugaucgccuguuaugugauuaccgggaccuccgcugaccucacagucgagaaagccgccgacgugaccugggaagaggaagcugagcagacaggaguuagccauaaccugaugaucacgguggaugacgauggcaccaugcggauuaaggacgaugaaacagagaauauccuuaccguccugcugaaaacagcccuccugaucgugucuggcauuuuuccuuacuccauccccgcgacccuucuggucuggcacacguggcagaagcagacccaacgcagcggggugcucugggacguuccuucucccccggagacacagaaagcugaacuggaggaaggaguguacagaauuaagcagcagggcaucuucgggaagacccaagucggagugggcguucagaaagaggggguguuucauacaauguggcacgucacccggggagccgugcucacacacaacggcaagcgccuggagccuaauugggccuccgugaaaaaggaucuuauuagcuauggcgggggauggagacugucugcucaguggcaaaaaggcgaagagguucaggucaucgccguggaacccgggaagaacccuaagaauuuccagacgaugcccggaauuuuccagaccacaaccggcgagaucggggcgaucgcucuggacuuuaaacccggaaccuccggcagcccuauuaucaaccgggaaggcaagguggucgggcucuacggaaauggcgugguuacaaaaaacgggggauauguguccggcauugcccaaacgaaugccgagccggaugggcccaccccugagcuggaagaggaaauguucaagaaacgcaaccuuacaaucauggaccugcaucccggcagcggaaagaccagaaaguaccucccugcuauuguccgggaggccaucaaacgcagacugcggacacucauccuggcucccaccagagugguugccgcggaaauggaggaggcccuuaagggccugccuauucgcuaucagacgacagcuaccaaaucugaacacaccgggcgggagaucguggaucugaugugccaugccacauuuaccaugagacuccugagcccgguccgcgugcccaauuacaaccuuauuaucauggacgaagcucacuucacagauccugccuccauugccgcucggggauauaucucuaccagaguuggcaugggggaggcggccgcuaucuuuaugacggccacacccccuggaaccgccgaagcuuucccccagagcaaugccccgauucaggacgaggagcgcgacaucccugaacgguccuggaacucuggcaaugaguggauuacagauuuuguggggaagaccgucugguucgugcccagcaucaaagcgggcaacgacauugcuaacugucugagaaagaauggaaagaaagugauccaacucucccgcaagacguuugauaccgaauaccagaaaacacggcugaacgacugggauuucgucguuaccacagacauuucugagaugggcgccaauuuuaaggccgauagagugaucgacccccggcgcugccugaaaccugugauccucaccgaugggcccgagagagucauucuugcuggaccuaugccggugacagccgcgagcgccgcucagcggcgcggcagaguugggcggaacccccagaaggaaaaugaccaauacaucuucaccggacagccucugaacaaugaugaggaccaugcccacuggacggaagcuaagaugcugcucgacaacauuaauacacccgagggcaucauuccugcccuguucgaacccgagagagagaaauccgcugccaucgauggggaauaucgccuuaagggcgagagccggaaaaccuuuguggaacugaugagacgcggagaccucccggucuggcuggcgcacaagguggccucugagggcaucaaauacaccgaucggaaguggugcuucgacggggaaagaaacaaucagauucuggaggagaacauggauguugaaaucuggacaaaagagggagaacgcaagaagcuccggccuagauggcuugacgcucgcaccuauuccgauccccuggcccugaaagaguuuaaggacuucgcugccggcagaaaaagcauugcccucgaucuggugacagaaaucgggcgggucccuucucaucuugcuuaccgcacgagaaaugcgcuggacaaccucgugaugcugcacaccuccgagcauggaggccgggccuaucgccacgcugucgaggaacugcccgagacaauggaaacccuccuucugcugggccucaugauucugcuuacagggggagccaugcuguuucucaucagcggcaaggggaucggaaaaaccuccauuggccugaucugugugauuguuucuagcgggaugcuguggauggccgaugugccucuccaguggaucgcuuccgccauuauccuugaguucuuuaugauggugcugcugauucccgagccggaaaagcaaagaacgccucaggacaaucagcucgcguacgucguuaucggaauccugacccuugccgcuauuguggccgcuaacgagaugggccugcucgaaacaaccaagcgggaucugggcaugagcaaagagcccgggguggucucucccacauccuaucuggacguggaccuccacccugccagcgcguggacccuuuacgccguugcuacgacagugaucaccccgaugcugagacauacaauugaaaauucuaccgccaacgucagccuggcugccaucgcuaaccaagccgugguccucaugggacuggauaagggcuggcccauuuccaaaauggaccuuggggugccucugcucgcgcugggaugcuacucucagguuaauccccugacccucacagccgcugugcuucugcuggucacgcacuaugccaucaucggcccugggcuccaggcuaaggccacccgcgaggcccagaaacggacagcggcuggaauuaugaagaaccccaccguggauggcaucaugacaauugaccuggauccuguuaucuacgacagcaaguucgagaaacaacuuggccaggugaugcugcucguccugugugccgugcagcugcuccuuaugagaaccuccugggcucugugcgaagcccugacgcucgccacagggccgauuaccacccugugggagggaucucccggcaaguuuuggaauacaaccaucgcugugagcauggccaacaucuuccgcggguccuaucuugcgggagccggccuggcuuuuagcauuaugaaaucuguugggacaggacggagaggcacgggcucccagggggaaacccucggagagaaguggaaaaagaagcugaaucaacugagccggaaagaauucgaucucuacaagaaauccggcaucacagaggucgaccgcaccgaggccaaggaagggcuuaaaagaggagagacaacccaucacgcugugucucggggcagcgccaagcugcagugguuuguggaacgcaacauggucauuccugaggggagaguuaucgaucugggauguggccggggcgggugguccuauuacugcgcgggacucaaaaaggugacggaagugcgcggcuauaccaaggggggacccggccaugaggagccuguccccaugucuacauacggguggaaucuggugaaacuuaugagcggaaaggacguuuucuaccugccgccugaaaaaugugauacccuccugugcgacauuggcgaguccagccccucucccacaguggaagaguccagaaccauccggguccugaagaugguggagccuuggcucaaaaacaaucaguucuguauuaagguucuuaaccccuauaugccuacagugaucgaacaccuggagcgccugcagagaaaguacggcgggaugcucguccggaauccgcugagcagaaacucuacccacgaaauguauuggaucuccaauggaacgggcaacauugugagcucugugaauauggucagccgccuucugcucaaccgguuuacaaugacccauagacgccccaccaucgagaaagauguugaccugggggccggaacacggcacgugaacgcugaaccugagacgcccaauauggacgugauuggcgagagaaucaagcgcauuaaagaagagcauuccucuaccuggcacuacgaugacgaaaacccuuauaagacaugggccuaccacgggagcuaugaggucaaagcuaccggauccgccagcuccaugaucaauggcgugguuaagcugcucacaaagcccugggauguggucccgauggugacccaaauggcuaugacagacaccacgccuuucggccagcagcggguuuuuaaagaaaagguggauaccagaacaccccgcccuaugcccgggacccggaaagucauggagaucacagccgaguggcuguggagaacccuuggacgcaacaagaaaccucggcugugcacgagagaagaguucacaaagaaggugcgcaccaaugcggccaugggcgcuguuuuuacagaagagaaccaaugggacucugccagagcugccguggaagaugagggguucuggaaacucgucgaccgggagcgcgaacugcauaagcuuggaaaauguggcagcugcguguacaauaugauggggaagagagagaaaaagcugggcgaauuuggaaaagccaagggcucccgggcgauuugguacauguggcucggggcuagauaucuggaguucgaggcccugggauuucucaacgaagaucacugguucucucgggagaauagcuacuccggcgucgaaggggagggacugcauaagcuuggcuauauccugcgcgacauuucuaaaauccccgggggcgccauguacgcugaugacaccgccggaugggacacgagaauuaccgaagaugaccuccacaacgaggagaagaucacacagcagauggauccggaacaucggcagcuggcuaaugccaucuuuaaacuuaccuaucaaaacaaggugguuaaagugcagcgcccuacacccaagggcaccgucauggacauuaucagcagaaaggaucagcggggguccggacaggugggcacauacgggcugaauaccuucacgaacauggaggcgcaacucgugcgccagauggaaggagagggcguucugagcaaagccgaccuggaaaauccccaccuccuggagaagaaaauuacacaguggcuugagaccaaggggguggaaagacugaaacggauggcuaucucuggcgaugacugcgucgugaagccuauugaugaccgcuuugccaacgcucuccuggcccuuaacgauaugggaaagguuagaaaagacaucccgcaguggcaacccuccaagggcuggcacgauuggcagcaggugccuuucuguagccaucacuuccaugagcugaucaugaaagacgggcggaagcucgucgugcccugccgcccucaggacgaacugauuggaagagcgcggaucucucaaggcgccggguggucccugaaagagaccgcuugucucggaaaggccuaugcucagauguggagccugauguacuuucaccgcagagaucuucggcuggccucuaaugcuauuugcuccgccguccccgugcacuggaucccuacaagcagaaccacaugguccauucaugcgcaccaucaguggaugacgaccgaagacaugcucacaguuuggaaccgcguguggaucgaggauaaucccuggauggaggacaagaccccggucacaaccugggaagaugugccuuaccugggcaaacgggaggaccaauggugugggagccuuauuggccugacgucuagagccaccugggcucagaacauccucacagccauccagcagguucgcagccugauuggagaugaagaguuccuggacuauaugcccuccaugaagcgguuuagaaaagaggaagagucugaaggcgccaucugguga

SEQ ID NO: 20861 - RNA, 9873 nt, Artificial Sequence
  derived and/or modified CDS sequence (opt5) from DENV-3__KF955460__SS-prME
accagccugugccucaugaugaugcugcccgccacccuugcuuuccaccugacgucccgggacggagaaccucggaugaucguggggaagaaugaacgcggaaaaucucuccuguuuaagaccgccagcggcauuaauauguguacacuuaucgcgauggaucugggggaaaugugcgacgauaccgucacauacaaauguccgcucauugcugaaguugagcccgaagacaucgauugcugguguaaccugaccuccacaugggugaccuauggaacgugcaaucaggccggcgagcaucggcgggacaagcgcucuguggcccuggcuccucacgucgggaugggacucgauacccggacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucacccuucugaugcucgugacaccuucuaugaccaugagauguguuggagugggcaaccgggacuuugucgaagggcugagcggagcuaccuggguggaugugguccuggagcauggcgggugcguuacaacgauggccaagaauaaacccacccucgacauugagcugcagaagacagaagcuacccagcuugccacacugcgcaaacucuguaucgagggaaagauuaccaacaucacgacagauuccagaugcccuacccagggcgaagcgauucugccggaggaacaggaccagaauuauguguguaaacacaccuacguggaucggggcugggggaacggaugcggccuuuucgggaagggaagccuggucacaugcgccaaguuucagugucucgagcccaucgagggcaaagugguucaguaugaaaaucugaaguacaccgugauuaucacaguccacacgggggaccagcaucaggugggaaacgacacccaaggcguuacaguggagaucaccccucaggcuucuacagucgaagccgugcugcccgaguauggcacccucgggcuggaaugcuccccucgcacgggacuugauuucaaugagaugauucugcucaccaugaaaaacaaggcuuggaugguccacagacagugguuuuucgaccugccccuuccguggacaagcggcgccaccacagagaccccuacguggaaucggaaagaacugcucgugacauuuaagaacgcccaugcuaaaaagcaagagguugugguccuggggucucaggaaggagcgaugcacaccgcccugacaggcgcuaccgagauccaaaauuccgggggcaccagcauuuucgccggacaccucaagugucgccugaaaauggauaaacuugaacugaaaggcaugucuuacgccaugugccucaacacauuugugcugaagaaagagguuuccgagacgcagcaugggaccauccugauuaagguggaauacaagggagaggacgcucccuguaaaaucccuuucagcacagaagauggccaagggaaggcccacaacggaagacuuaucaccgcgaaucccgucgugaccaagaaggaggagcccgugaacauugaagcugagccuccguucggcgaauccaauaucguuauugggaucggcaacaaagcccucaagauuaauugguauaagaaaggaucuagcaucggcaagauguuugaggccaccgcuagaggggccagacgcauggcuauccugggagacacggccugggauuucggcuccgucgggggagugcugaacagccucggcaaaauggugcaucagauuuuugggucugcguacacagcccuguucuccggcgucagcuggaucaugaagauuggaaucggcgugcuucugaccuggauugggcucaauucuaaaaacaccagcauguccuuuucuugcaucguuauuggaaucaucacacuguaucugggcgcugugguccaggccgacauggggugugcuauuaauuggaagggaaaggaacuuaaaugcggcagcgggaucuucgugaccaacgagguucacacauggacggagcaguacaaguuucaagccgauucccccaaacggcucgcgaccgccauugcuggcgccugggaaaauggaguguguggcaucagaagcacaacccgcauggagaaccugcuguggaagcagauugcuaaugaacucaacuauauccugugggagaauaacaucaaacuuacagucgugguuggggacauuaucggagugcuggaacagggcaagcggacccucacgccucagcccauggagcugaaauacucuuggaagaccugggggaaggccaaaauugucacagccgagacccaaaacuccagcuucaucauugauggaccuaauacacccgaaugcccgucugcuuccagagcguggaacgugugggagguggaagacuauggcuuuggcgucuucaccacaaauaucuggcugaaacuucgcgagguuuacacccagagcugugaccaucggcucauguccgccgcuaucaaagaugaaagagccgugcacgccgacaugggguacuggauugagucucagaagaacggaagcuggaaacuggagaaggcuuccuuuaucgaagugaagacgugcacauggccuaaaucucacacccuguggagcaauggcguccucgaguccgauaugauuauccccaagagccuggccgggccuauuucucagcauaaccaccgccccggauaucauacccaaacagcgggcccuuggcaccuugggaaacuggaacucgacuucaauuacugcgagggaaccacggugguuaucacagagaacuguggcacccggggccccucccugagaacaaccacagugagcgggaagcugauccacgaauggugcugucgcucuugcacccuuccgccucuccgguauaugggagaggauggcuguugguacgggauggaaauuagacccaucaaugagaaagaagagaacauggucaagucccuggugagcgcuggaucuggcaagguugacaauuuuacgaugggggugcugugccucgccauucuguucgaggaagucaugcggggaaaauucggcaagaaacauaugaucgccggcgugcuuuuuaccuucguucugcuccugagcgggcagauuacauggcgcgauauggcucacacccugaucaugauuggauccaacgccagcgacagaaugggcaugggggugacauaucuugcgcugaucgcuaccuuuaagauccagcccuuccucgcccugggauuuuuccuccggaaacugacgucuagagagaaucuucugcucggcgucgggcuggccauggcuacaacccugcaacuuccugaagauauugagcagauggccaacggaaucgcucugggccucaugacacugaagcucauuacccaguuugaaaccuaccagcuguggacagcccuugugucccugacguguagcaauaccaucuucacacucaccguggcguggcgcacagccacccugauucuggcuggcgucucccuucugccgcucugccaaucuagcuccaugcggaagacggacuggcugcccaugacaguugccgcuaugggggugccuccccucccucuguuuaucuucucucuuaaagauacccccaagagacgcagcuggccucugaacgagggagugauggccgucggccugguguccauccucgccucuagccugcuuagaaacgacguucccauggcugggccgcugguggcgggaggccuccugauugccuguuaugucaucaccgggacauccgcugaucucaccguggagaaagccgccgacguuacaugggaagaggaagcugagcagacgggagugagccauaaucugaugauuaccgucgacgaugacggcacaaugcggaucaaggaugacgaaaccgagaacauucuuacagugcugcugaaaaccgcccuccugaucgucucuggcaucuuuccuuacuccauucccgcgacgcuucugguguggcacaccuggcagaagcagacacaacgcagcgggguucucugggaugugccuucucccccggagacccagaaagcugaacuggaggaaggagucuacagaaucaagcagcagggcauuuucgggaagacacaagugggaguuggcgugcagaaagagggggucuuucauaccauguggcacgugacacggggagccgugcucacgcacaauggcaagcgccuggagccuaacugggccuccguuaaaaaggaccuuaucagcuauggcgggggauggagacugucugcucaguggcaaaaaggcgaagagguccaggugauugccguggaacccgggaagaauccuaagaacuuccagaccaugcccggaaucuuccagacaaccaccggcgagauuggggcgaucgcucuggauuuuaaacccggaacauccggcagcccuaucauuaaucgggaaggcaaggucguggggcucuacggaaacggcguugugacgaaaaaugggggauaugucuccggcaucgcccaaaccaacgccgagccggacgggcccacaccugagcuggaagaggaaauguucaagaaacgcaaucuuaccauuauggaucugcaucccggcagcggaaagacaagaaaguaccucccugcuaucgugcgggaggccauuaaacgcagacugcggacccucauccuggcucccacgagaguuguggccgcggaaauggaggaggcccuuaagggccugccuauccgcuaucagacaaccgcuaccaaaucugaacacacagggcgggagauugucgaccugaugugccaugccaccuuuacaaugagacuccugagcccggugcgcguucccaacuacaaucuuaucauuauggaugaagcucacuucaccgacccugccuccaucgccgcucggggauauauuucuacgagagugggcaugggggaggcggccgcuaucuuuaugacagccacacccccuggaacagccgaggcuuucccccagagcaacgccccgauccaggaugaggagaaggacauuccugaacgcuccuggaacucuggcaacgaguggaucaccgacuuugucgggaaaacggugugguucgugcccagcauuaaggcgggcaacgauaucgcuaauugucugcggaagaacggcaaaaaggucauucaacucuccagaaaaaccuuugacacagaauaccagaagacccgccugaaugauugggacuucguugugacaaccgauaucucugagaugggagccaacuuuaaagccgaccgggugauugaucccagacggugccugaagccugucauccucacagacgggcccgagcgcgugauccuugcuggaccuaugccgguuaccgccgcgagcgccgcucagagacggggccgcguggggagaaauccccagaaggaaaacgaucaauacauuuucacgggacagccucugaauaacgacgaggaucaugcccacuggacagaagcuaaaaugcugcucgacaauaucaacacccccgagggcauuaucccugcccuguucgaacccgagcgggagaaguccgcugccauugacggggaauauagacuuaaaggcgagagccgcaagaccuuugucgaacugaugcggagaggagaucucccgguguggcuggcgcacaaaguugccucugagggcaucaaguacacagaccgcaaauggugcuucgauggggaacggaauaaccagauccuggaggagaauauggacguggaaauuuggaccaaggagggagaaagaaagaaacuccgcccucgguggcuugaugcuagaacauauuccgacccccuggcccugaaggaguuuaaagauuucgcugccggccgcaagagcaucgcccucgaccuggucacggaaauugggagagugccuucucaucuugcuuaccggacccgcaacgcgcuggauaaucucgucaugcugcacacauccgagcauggaggcagagccuaucggcacgcuguggaggaacugcccgagaccauggaaacacuccuucugcugggccucaugauccugcuuaccgggggagccaugcuguuucucauuagcggcaaagggaucggaaagacguccaucggccugauuuguguuaucgugucuagcgggaugcuguggauggccgacgugccucuccaguggauugcuuccgccaucguccuugaguucuuuaugaugguucugcugauucccgagccggaaaagcaacgcaccccucaggauaaccagcucgcguacguggugaucggcauucugacacuugccgcuaucgucgccgcuaaugagaugggccugcucgaaaccacaaaaagagaccugggcaugagcaaggagcccggggugguuucucccaccuccuaucuggauguggaccuccacccugccagcgcguggacgcuuuacgccgucgcuacaaccgugaucacaccgaugcugcggcauaccauugaaaacucuaccgccaacgucagccuggcugccaucgcuaaucaagccgugguucucaugggacuggacaaaggcuggcccauuuccaagauggaucuuggggugccucugcucgcgcugggaugcuacucucaggucaacccccugacacucacggccgcugugcuucugcugguuacccacuaugccaucauuggcccugggcuccaggcuaaagccacaagagaggcccagaagcgcaccgcggcuggaaucaugaagaaucccacaguggacggcaucaugaccauugaucuggacccugucaucuacgauagcaaauucgagaagcaacuuggccaggugaugcugcucgugcugugugccguucagcugcuccuuaugcggacguccugggcucugugcgaagcccugacacucgccaccgggccgauuaccacacugugggagggaucucccggcaaauuuuggaacaccacaaucgcugucagcauggccaauauuuucagaggguccuaucuugcgggagccggccuggcuuuuagcaucaugaagucuguggggacgggacgccggggcaccggcucccagggggaaacacucggagagaaauggaagaagaaacugaaccaacugagcagaaaggaguucgaccucuacaaaaaguccggcaucaccgagguggaucggacagaggccaaagaagggcuuaagcgcggagagaccacgcaucacgcugucucuagaggcagcgccaaacugcagugguuuguugaacggaauauggugauuccugaggggcgcgugaucgaccugggauguggcagaggcgggugguccuauuacugcgcgggacucaagaaggucaccgaagugcggggcuauacaaaagggggacccggccaugaggagccuguucccaugucuaccuacggguggaacauugugaagcugaugagcggaaaagaugucuucuaccuuccgccugaaaagugugacacacugcucugcgauaucggcgaguccagccccucucccaccguggaagagucccgcacaauuagaguucugaaaaugguggagccuuggcugaagaauaaccaguucuguaucaagguccucaaucccuauaugccuaccgugauugaacaccuugagcggcugcagcgcaaauacggcgggaugcuggugagaaacccgcucagcagaaauucuacgcacgaaauguauuggaucuccaacggaacaggcaauaucgucagcucuguuaacauggugagcagacugcuucugaaccgcuuuaccaugacccaucggagacccacaauugagaaggacguggaucucggggccggaacgcgccacgucaaugcugaaccugagacccccaacauggacgugaucggcgagcggauuaaaagaaucaaggaagaacacuccucuacauggcacuacgacgaugaaaauccuuauaaaaccugggccuaccacgggagcuaugagguuaaggcuacaggauccgccagcuccaugauuaacggcguggucaagcugcugaccaaacccugggacgugguuccgauggugacacaaauggcuaugaccgauacgaccccuuucggccagcagcgcgucuuuaaggaaaaaguggacacacggacccccagaccuaugcccgggacacgcaagguuauggagaucaccgccgaguggcucuggcggacgcugggaagaaauaaaaagccucgccuuugcacacgggaagaguucaccaagaaagugagaacaaacgcggccaugggcgcugucuuuaccgaagagaaucaaugggauucugcccgcgcugccguggaagacgaggaguucuggaagcuggucgauagagaacgggagcuccauaaacuggggaaguguggaagcugcguguacaacaugaugggcaaacgcgaaaagaaacuuggggaguuuggcaaggccaagggauccagagcgaucugguacauguggcugggcgcucgguaucucgaguucgaagcccugggguuucugaaugaggaccacugguucucuagagaaaacagcuacuccggaguugagggcgaagggcuccauaaacugggauauauucuucgggauaucucuaagauucccggcggggccauguacgcugacgauacggccggcugggacacccgcaucacagaggacgaucugcacaaugaggagaagauuacccagcagauggacccggagcauagacagcucgcuaacgccaucuuuaagcugacauaucaaaauaaaguggucaaggugcagcggccuacccccaagggaacagugauggauaucauuagccgcaaagaccagagaggcuccgggcagguuggaaccuacggccuuaacacguucacaaauauggaagcgcaacuggugcggcagauggagggggaaggaguccucagcaaggccgaucuggagaacccccaucugcucgagaaaaagaucacccaguggcuggaaaccaaaggcguggagcgccuuaagagaauggcuauuucuggggacgauugcguugugaagccuaucgacgaucgguuugccaacgcucugcucgcccugaaugacaugggcaaaguccgcaaggauauuccgcaguggcaacccuccaaaggauggcacgacuggcaacaggugccuuucuguagccaucacuuccaugaacuuaucaugaaggauggcagaaaacuggucgugcccugccggccucaggacgagcucaucgggcgcgcgagaauuucucaaggagccggcuggucccugaaggaaacagcuugucuggggaaggccuaugcucagauguggagccucauguacuuucaccggcgcgaccugagacuugccucuaacgcuaucugcuccgccguucccgugcacuggauuccuaccagccggacaacgugguccauccaugcgcaccaucaguggaugaccacagaggauaugcugaccgucuggaauagaguguggauugaggacaaccccuggauggaagauaaaacaccgguuaccacgugggaggacaucccuuaccucggaaagcgcgaagaucaaugguguggcagccugauugggcuuaccucucgggccacaugggcucagaauauccugaccgccauccaacaggugagaagccucauuggcgacgaggaguuccuggauuauaugcccuccaugaaacgcuuucggaaggaagaggaaucugagggagccaucugguga

SEQ ID NO: 20862 - RNA, 9873 nt, Artificial Sequence
  derived and/or modified CDS sequence (opt5) from DENV-3__FJ461334__SS-prME
accagccugugccucaugaugaugcugcccgccacccuugcuuuccaccugacgucccgggacggcgaaccucggaugaucguggggaagaacgaacgcggaaagucucuccuguuuaagaccgccagcggcauuaauauguguacccuuaucgcgauggaucugggggagaugugcgacgauaccgucacauacaaguguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacagaccuggaugagcgccgagggcgcuuggcggcaggucgaaaagguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaagcccacgcucgacaucgagcugcagaagaccgaagcuacacagcuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggugaccugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccucgcaccggacuugauuucaaugagaugauccugcucacgaugaaaaacaaggcuuggaugguccacagacagugguuuuucgaccugccccuuccguggaccagcggcgccacaaccgagacaccuaccuggaaucggaaagaacugcucgugacguuuaagaacgcccaugcuaaaaagcaagagguugugguccuggggucucaggaaggagcgaugcacacagcccugaccggcgcuacagagauucaaaauuccgggggcaccagcaucuucgccggacaccucaagugucgccugaaaauggauaaacuugaacugaaaggcaugucuuacgccaugugccucaacaccuuugugcugaagaaagagguuuccgagacacagcaugggacgauucugaucaagguggaauacaagggagaggacgcucccuguaaaaucccuuucagcaccgaagauggccaagggaaggcccacaacggaagacuuauuacagcgaaucccgucgugaccaaaaaggaggagcccgugaacaucgaagcugagccuccguucggcgaauccaauauuguuaucgggauuggcgacaaagcccucaagaucaacugguauaagaaaggaucuagcaucggcaagauguuugaggccacagcuagaggggccagacgcauggcuauucugggagauaccgccugggacuucggcuccgucgggggagugcugaauagccucggcaaaauggugcaucagaucuuugggucugcguacacggcccuguucuccggcgucagcuggauuaugaagaucggaauuggcgugcuucugacauggaucgggcucaacucuaaaaauaccagcauguccuuuucuugcauuguuaucggaaucauuacccuguaucugggcgcugugguccaggccgauauggggugugcuaucaacuggaagggaaaggaacuuaaaugcggcagcgggauuuucgugacaaaugagguucacaccuggacagagcaguacaaguuucaagccgacucccccaaacggcucgcgacggccaucgcuggcgccugggaaaacggaguguguggcauuagaagcaccacacgcauggagaaucugcuguggaagcagaucgcuaacgaacucaauuauauccugugggagaacaauauuaaacuuaccgucgugguuggggauaucauuggagugcuggaacagggcaagcggacacucaccccucagcccauggagcugaaauacucuuggaagacgugggggaaggccaaaaucgucaccgccgagacacaaaacuccagcuucauuaucgacggaccuaacacccccgaaugcccgucugcuuccagagcguggaaugugugggagguggaagacuauggcuuuggcgucuucacaaccaacaucuggcugaaacuucgcgagguuuacacacagagcugugaucaucggcucauguccgccgcuauuaaagacgaaagagccgugcacgccgauaugggguacuggaucgagucucagaagaauggaagcuggaaacuggagaaggcuuccuuuauugaagugaagaccugcacguggccuaaaucucacacacuguggagcaacggcguccucgaguccgacaugaucauucccaagagccuggccgggccuaucucucagcauaaucaccgccccggauaucauacccaaaccgcgggcccuuggcaccuugggaaacuggaacucgauuucaacuacugcgagggaacaaccgugguuaucacggagaauuguggcacacggggccccucccugagaaccacaaccgugagcgggaagcugauucacgaauggugcugucgcucuugcacacuuccgccucuccgguauaugggagaggacggcuguugguacgggauggaaaucagacccauuaacgagaaagaagagaauauggucaagucccuggugagcgcuggaucuggcaagguugauaacuuuaccaugggggugcugugccucgccauccuguucgaggaagucaugcggggaaaauucggcaagaaacauaugauugccggcgugcuuuuuacguucguucugcuccugagcgggcagaucaccuggcgcgacauggcucacacacugauuaugaucggauccaaugccagcgauagaaugggcaugggggugaccuaucuugcgcugaucgcuacauuuaagauucagcccuuccucgcccugggauuuuuccuccggaaacugaccucuagagagaaccuucugcucggcgucgggcuggccauggcuacgacacugcaacuuccugaagacaucgagcagauggccaauggaauugcucugggccucaugacccugaagcucaucacacaguuugaaaccuaccagcuguggaccgcccuugugucccugacauguagcaacacgauuuucacccucacaguggcguggcgcaccgccacacugauccuggcuggcgucucccuucugccgcucugccaaucuagcuccaugcggaagaccgauuggcugcccaugacgguugccgcuaugggggugccuccccucccucuguuuaucuucucucuuaaagacacacccaagagacgcagcuggccucugaaugagggagugauggccgucggccugguguccauucucgccucuagccugcuuagaaacgauguucccauggcugggccgcugguggcgggaggccuccugaucgccuguuaugucauuaccgggaccuccgcugaccucacaguggagaaagccgccgacguuaccugggaagaggaagcugagcagacaggagugagccauaaccugaugaucacggucgaugacgauggcaccaugcggauuaaggacgaugaaacagagaauauccuuaccgugcugcugaaaacagcccuccugaucgucucuggcauuuuuccuuacuccauccccgcgacccuucugguguggcacacguggcagaagcagacccaacgcagcgggguucucugggacgugccuucucccccggagacacagaaagcugaacuggaggaaggagucuacagaauuaagcagcagggcaucuucgggaagacccaagugggaguuggcgugcagaaagagggggucuuucauacaauguggcacgugacccggggagccgugcucacacacaacggcaagcgccuggagccuaauugggccuccguuaaaaaggaucuuauuagcuauggcgggggauggagacugucuacgcaguggcaaaaaggcgaagagguccaggugaucgcuguggaacccgggaagaacccuaagaauuuccagaccaugcccggaauuuuccagacaaccaccggcgagaucggggccaucgcgcuggacuuuaaacccggaacauccggcagcccuauuaucaaccgggaaggcaaggucguggggcucuacggaaauggcguugugacgaaaaacgggggauaugucuccggcauugcucaaaccaaugccgagccggaugggcccacaccugagcuggaagaggaaauguucaagaaacgcaaccuuaccaucauggaccugcaucccggcagcggaaagacaagaaaguaccucccugccauugugcgggaggcuaucaaacgcagacugcggacccucauccuggcccccacgagaguuguggcugccgaaauggaggaggcgcuuaagggccugccuauucgcuaucagacaaccgccaccaaaucugaacacacagggcgggagaucgucgaucugaugugccaugcuaccuuuacaaugagacuccugagcccggugcgcguucccaauuacaaccuuauuaucauggacgaagcccacuucaccgauccugcuuccauugccgcccggggauauaucucuacgagagugggcaugggggaggcugcggccaucuuuaugacagcuacacccccuggaacagccgaagccuucccccagagcaaugcuccgauucaggacgaggagcgcgacaucccugaacgguccuggaacucuggcaaugaguggauuaccgauuuugucgggaagacggugugguucgugcccagcaucaaagccggcaacgacauugcgaacugucugagaaagaauggaaagaaagucauccaacucucccgcaagaccuuugauacagaauaccagaaaacccggcugaacgacugggauuucguugugacaaccgacauuucugagaugggcgcuaauuuuaaggccgauagagugaucgacccccggcgcugccugaaaccugucauccucacagaugggcccgagagagugauucuugccggaccuaugccgguuaccgcugccagcgcggcccagcggcgcggcagaguggggcggaacccccagaaggaaaaugaccaauacaucuucacgggacagccucugaacaaugaugaggaccaugcucacuggacagaagccaagaugcugcucgacaacauuaauacccccgagggcaucauuccugcucuguucgaacccgagagagagaaauccgccgcuaucgauggggaauaucgccuuaagggcgagagccggaaaaccuuugucgaacugaugagacgcggagaccucccgguguggcuggcccacaagguugcgucugagggcaucaaauacacagaucggaaguggugcuucgacggggaaagaaacaaucagauucuggaggagaacauggauguggaaaucuggaccaaagagggagaacgcaagaagcuccggccuagauggcuugacgcccgcacauauuccgauccccuggcucugaaagaguuuaaggacuucgccgcuggcagaaaaagcauugcccucgaucuggucacggaaaucgggcgggugccuucucaucuugccuaccgcaccagaaaugcucuggacaaccucgucaugcugcacacauccgagcauggaggccgggcguaucgccacgccguggaggaacugcccgagaccauggaaacacuccuucugcugggccucaugauucugcuuaccgggggagcuaugcuguuucucaucagcggcaaggggaucggaaaaacguccauuggccugaucuguguuauugugucuagcgggaugcuguggauggccgaugugccucuccaguggaucgccuccgcuauuauccuugaguucuuuaugaugguccugcugauucccgagccggaaaagcaaagaaccccucaggacaaucagcucgccuacguugugaucggaauccugacacuugcggccauuguggcugccaacgagaugggccugcucgaaaccacaaagcgggaucugggcaugagcaaagagcccggggucgugucucccaccuccuaucuggacguugaccuccacccugcuagcgccuggacgcuuuacgcgguggccacaaccgucaucacaccgaugcugagacauaccauugaaaauucuaccgcuaacgugagccuggccgcuaucgccaaccaagcugucgugcucaugggacuggauaagggcuggcccauuuccaaaauggaccuugggguuccucugcucgcccugggaugcuacucucaggugaauccccugacacucacggcggccguccuucugcuggugacccacuaugcuaucaucggcccugggcuccaggccaaggcuacacgcgaggcccagaaacggaccgccgcgggaauuaugaagaaccccacaguugauggcaucaugaccauugaccuggauccugugaucuacgacagcaaguucgagaaacaacuuggccaggucaugcugcucgugcugugugcugugcagcugcuccuuaugagaacguccugggcccugugcgaagcucugacacucgccaccgggccgauuaccacacugugggagggaucucccggcaaguuuuggaauaccacaaucgccguuagcauggcuaacaucuuccgcggguccuaucuugccggagcgggccuggccuuuagcauuaugaaaucugucgggacgggacggagaggcaccggcucccagggggaaacacucggagagaaguggaaaaagaagcugaaucaacugagccggaaagaguucgaucucuacaagaaauccggcaucaccgagguggaccgcacagaggcuaaggaagggcuuaaaagaggagagaccacgcaucacgccgugucucggggcagcgcuaagcugcagugguuugucgaacgcaacaugguuauuccugaggggagagugaucgaucugggauguggccggggcgggugguccuauuacugcgccggacucaaaaaggugaccgaaguccgcggcuauacaaaaggcgggcccgggcaugaggagccugugcccaugucuaccuacggguggaaucugguuaaacuuaugagcggaaaggacguguucuaccugccgccugaaaaaugugauacacuccugugcgacauuggcgaguccagccccucucccaccgucgaagaguccagaacaauccgggugcugaagaugguugagccuuggcucaaaaacaaucaguucuguauuaaggugcuuaaccccuauaugccuaccgucaucgaacaccuggagcgccugcagagaaaguacggcgggaugcucgugcggaauccgcugagcagaaacucuacgcacgaaauguauuggaucuccaauggaacaggcaacauugugagcucugucaauaugguuagccgccuucugcucaaccgguuuaccaugacccauagacgccccacaaucgagaaagauguggaccugggggcgggaacgcggcacgugaacgccgaaccugagacccccaauauggacgucauuggcgagagaaucaagcgcauuaaagaagaacauuccucuacauggcacuacgaugacgaaaacccuuauaagaccugggcuuaccacgggagcuaugaggugaaagccacaggauccgcuagcuccaugaucaauggcguugugaagcugcucaccaagcccugggaugucgugccgaugguuacacaaauggccaugaccgacacgaccccuuucggccagcagcggguguuuaaagaaaaggucgauacaagaacaccccgcccuaugcccgggacacggaaagugauggagaucaccgcugaguggcuguggagaacgcuuggacgcaacaagaaaccucggcugugcacaagagaagaguucaccaagaagguucgcacaaaugccgcgaugggcgccguguuuaccgaagagaaccaaugggacucugcuagagccgcugucgaagaugaggaguucuggaaacucguggaccgggaacgcgagcugcauaaacuugggaaauguggaagcugcgucuacaauaugaugggcaagagagagaagaagcugggggaguuuggcaaagccaagggaucccgggccauuugguacauguggcucggcgcgagauaucuggaguucgaagcucugggguuucucaacgaggaucacugguucucucgggaaaauagcuacuccggaguggagggcgaagggcugcauaaacuuggauauauccugcgcgacauuucuaaaauccccggcggggccauguacgccgaugacacggcuggcugggacaccagaauuacagaggaugaccuccacaacgaggaaaagaucacccagcagauggauccggagcaucggcagcuggccaaugcuaucuuuaaacuuacauaucaaaacaagguugugaaaguccagcgcccuacccccaagggaacagugauggacauuaucagcagaaaggaucagcggggcuccggacaggugggaaccuacggccugaauacguucacaaacauggaagcccaacucguucgccagauggagggggaaggagugcugagcaaagcggaccuggagaauccccaccuccuggagaagaaaauuacccaguggcuugaaaccaagggcgucgagagacugaaacggauggccaucucuggggaugacugcgugguuaagccuauugaugaccgcuuugcuaacgcccuccuggcucuuaacgauaugggcaaggugagaaaagacaucccgcaguggcaacccuccaagggauggcacgauuggcagcaggucccuuucuguagccaucacuuccaugaacugaucaugaaagacggccggaagcucgugguccccugccgcccucaggacgagcugauugggagagcccggaucucucaaggagcgggcuggucccugaaagaaacagccugucucgggaaggcuuaugcccagauguggagccugauguacuuucaccgcagagaucuucggcuggcuucuaaugccauuugcuccgcugugcccguucacuggaucccuaccagcagaacaacgugguccauucaugcccaccaucaguggaugaccacagaggacaugcucaccguguggaaccgcgucuggaucgaggauaaucccuggauggaagacaagacaccggugaccacgugggaggauguuccuuaccugggaaaacgggaagaccaaugguguggcagccuuauugggcugaccucuagagcgacaugggcccagaacauccucaccgcuauccaacaggugcgcagccugauuggcgaugaggaguuccuggacuauaugcccuccaugaagcgguuuagaaaagaagaggaaucugagggagccaucugguga

SEQ ID NO: 20863 - RNA, 9873 nt, Artificial Sequence
  derived and/or modified CDS sequence (opt5) from DENV-3__FJ461337__SS-prME
accagccugugccucaugaugaugcugcccgccacccuugcuuuccaccugacgucccgggacggcgaaccucggaugaucguggggaagaaugaacgcggaaagucucuccuguuuaagaccgccagcggcauuaauauguguacacuuaucgcgauggaucugggggagaugugcgacgauaccgucacauacaaguguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacagaccuggaugagcgccgagggcgcuuggcggcaggucgaaaagguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaagcccacgcucgacaucgagcugcagaagaccgaagcuacacagcuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggugaccugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccucgcaccggacuugauuucaaugagaugauccugcucacgaugaaaaacaaggcuuggaugguccacagacagugguuuuucgaccugccccuuccguggaccagcggcgccacaaccgagacaccuaccuggaaucggaaagaacugcucgugacguuuaagaacgcccaugcuaaaaagcaagagguugugguccuggggucucaggaaggagcgaugcacacagcccugaccggcgcuacagagauucaaaauuccgggggcaccagcaucuucgccggacaccucaagugucgccugaaaauggauaaacuugaacugaaaggcaugucuuacgccaugugccucaacaccuuugugcugaagaaagagguuuccgagacacagcaugggacgauucugaucaagguggaauacaagggagaggacgcucccuguaaaaucccuuucagcaccgaagauggccaagggaaggcccacaacggaagacuuauuacagcgaaucccgucgugaccaaaaaggaggagcccgugaacaucgaagcugagccuccguucggcgaauccaauauuguuaucgggauuggcgacaaagcccucaagaucaacugguauaagaaaggaucuagcaucggcaagauguuugaggccacagcuagaggggccagacgcauggcuauucugggagauaccgccugggacuucggcuccaugggagggguccugaauagccucggcaaaauggugcaucagaucuuugggucugcguacacggcccuguucuccggcgugagcuggauuaugaagaucggaauuggcguccuucugacauggaucgggcucaacucuaaaaauaccagcauguccuuuucuugcauugugaucggaaucauuacccuguaucugggcgcuguugugcaggccgauauggggugugcuaucaacuggaagggaaaggaacuuaaaugcggcagcgggauuuucgucacaaaugaggugcacaccuggacagagcaguacaaguuucaagccgacucccccaaacggcucgcgacggccaucgcuggcgccugggaaaacggaguuuguggcauuagaagcaccacacgcauggagaaucugcuguggaagcagaucgcuaacgaacucaauuauauccugugggagaacaauauuaaacuuaccguggucgugggggauaucauuggaguucuggaacagggcaagcggacacucaccccucagcccauggagcugaaauacucuuggaagacgugggggaaggccaaaaucgugaccgccgagacacaaaacuccagcuucauuaucgacggaccuaacacccccgaaugcccgucugcuuccagagcguggaaugucugggagguggaagacuauggcuuuggcguguucacaaccaacaucuggcugaaacuucgcgaggucuacacacagagcugugaucaucggcucauguccgccgcuauuaaagacgaaagagccguucacgccgauaugggguacuggaucgagucucagaagaauggaagcuggaaacuggagaaggcuuccuuuauugaagugaagaccugcacguggccuaaaucucacacacuguggagcaacggcgugcucgaguccgacaugaucauucccaagagccuggccgggccuaucucucagcauaaucaccgccccggauaucauacccaaaccgcgggcccuuggcaccuugggaaacuggaacucgauuucaacuacugcgagggaacaaccgucgugaucacggaggacuguggcacacggggccccucccugagaaccacaaccguuagcgggaagcugauucacgaauggugcugucgcucuugcacacuuccgccucuccgguauaugggagaggauggcuguugguacgggauggaaaucagacccauuaaugagaaagaagagaacauggugaagucccuggucagcgcuggaucuggcaagguggacaauuuuaccauggggguucugugccucgccauccuguucgaggaagugaugcggggaaaauucggcaagaaacauaugauugccggcguccuuuuuacguucgugcugcuccugagcgggcagaucaccuggcgcgauauggcucacacacugauuaugaucggauccaacgccagcgacagaaugggcauggggguuaccuaucuugcgcugaucgcuacauuuaagauucagcccuuccucgcccugggauuuuuccuccggaaacugaccucuagagagaaucuucugcucggcguggggcuggccauggcuacgacacugcaacuuccugaagauaucgagcagauggccaacggaauugcucugggccucaugacccugaagcucaucacacaguuugaaaccuaccagcuguggaccgcccuugucucccugacauguagcaauacgauuuucacccucacaguggcguggcgcaccgccacacugauccuggcuggcgugucccuucugccgcucugccaaucuagcuccaugcggaagaccgacuggcugcccaugacggucgccgcuauggggguuccuccccucccucuguuuaucuucucucuuaaagauacacccaagagacgcagcuggccucugaacgagggagugauggccgugggccuggucuccauucucgccucuagccugcuuagaaaugacgugcccauggcugggccgcugguugcgggaggccuccugaucgccuguuaugugauuaccgggaccuccgcugaccucacagucgagaaagccgccgaugugaccugggaagaggaagcugagcagacaggaguuagccauaaccugaugaucacgguggacgaugacggcaccaugcggauuaaggaugacgaaacagagaacauccuuaccguccugcugaaaacagcccuccugaucgugucuggcauuuuuccuuacuccauccccgcgacccuucuggucuggcacacguggcagaagcagacccaacgcagcggggugcucugggauguuccuucucccccggagacacagaaagcugaacuggaggaaggaguguacagaauuaagcagcagggcaucuucgggaagacccaagucggagugggcguucagaaagaggggguguuucauacaauguggcacgucacccggggagccgugcucacacacaauggcaagcgccuggagccuaacugggccuccgugaaaaaggaccuuauuagcuauggcgggggauggagacugucugcucaguggcaaaaaggcgaagagguucaggucaucgccguggaacccgggaagaauccuaagaacuuccagacgaugcccggaauuuuccagaccacagcgggcgagaucggggcuaucgcccuggauuuuaaacccggaaccuccggcagcccuauuaucaaucgggaaggcaagguggucgggcucuacggaaacggcgugguuaccaaaaaugggggauauguguccggcauugcccaaacaaacgcugagccggacgggcccacgccugagcuggaagaggaaauguucaagaaacgcaaucuuaccaucauggaucugcaucccggcagcggaaagacaagaaaguaccucccugccauuguccgggaggcuaucaaacgcagacugcggacccucauccuggcccccacaagagugguugcggccgaaauggaggaggcucuuaagggccugccuauucgcuaucagaccacggccacaaaaucugaacacaccgggcgggagaucguggaccugaugugccaugcuaccuuuacaaugagacuccugagcccgguccgcgugcccaacuacaaucuuauuaucauggaugaagcccacuucaccgacccugccuccauugcugcgcggggauauaucucuacaagaguuggcaugggggaggccgcugccaucuuuaugaccgccacgcccccuggaacagcugaagccuucccccagagcaacgcgccgauucaggacgaggagcgcgauaucccugaacgguccuggaacucuggcaacgaguggauuaccgacuuuguggggaagacagucugguucgugcccagcaucaaagcuggcaaugauauugccaacugucugagaaagaacggaaagaaagugauccaacucucccgcaagaccuuugacacggaauaccagaaaacccggcugaaugauugggacuucgucguuacaaccgauauuucugagaugggcgccaacuuuaaggcugacagagugaucgauccccggcgcugccugaaaccugugauccucacagacgggcccgagagagucauucuugccggaccuaugccggugaccgcggccagcgcugcccagcggcgcggcagaguugggcggaauccccagaaggaaaacgaucaauacaucuucacaggacagccucugaauaacgacgaggaccaugcucacuggaccgaagccaagaugcugcucgauaauauuaacacgcccgagggcaucauuccugcucuguucgaacccgagagagagaaauccgccgcgaucgacggggaauaucgccuuaagggcgagagccggaaaacauuuguggaacugaugagacgcggagaucucccggucuggcuggcccacaagguggcuucugagggcaucaaauacaccgaccggaaguggugcuucgauggggaaagaaauaaccagauucuggaggagaauauggacguugaaaucuggaccaaagagggagaacgcaagaagcuccggccuagauggcuugaugcccgcacauauuccgacccccuggcucugaaagaguuuaaggauuucgccgccggcagaaaaagcauugcucucgaccuggugaccgaaaucgggcgggucccuucucaucuugcguaccgcacaagaaacgcccuggauaaucucgugaugcugcacacguccgagcauggaggccgggcuuaucgccacgccgucgaggaacugcccgagaccauggaaacacuccuucugcugggccucaugauucugcuuaccgggggagccaugcuguuucucaucagcggcaaggggaucggaaaaacauccauuggccugaucugugugauuguuucuagcgggaugcuguggauggcugacgugccucuccaguggaucgccuccgcgauugugcuugaguucuuuaugaugguccugcugauccccgagccggaaaagcaaagaaccccucaggauaaccagcucgccuacguugugauuggaauccugacgcuugcugccaucguggcugccaaugagaugggccugcucgaaaccacaaagcgggaccugggcaugagcaaagagcccggggucgugucucccaccuccuaucuggacguugaucuccacccugcgagcgccuggacacuuuacgcuguggccaccacggucauuacaccgaugcugagacauaccaucgaaaacucuacagcuaaugugagccuggccgcuauugccaaccaagcggucgugcucaugggacuggacaagggcuggcccaucuccaaaauggaucuugggguuccucugcucgcccugggaugcuacucucaggugaacccccugacccucaccgcugccguccuucugcuggugacacacuaugcuauuaucggcccugggcuccaggccaaggccacgcgcgaggcgcagaaacggaccgcugccggaaucaugaagaaucccacaguugacggcauuaugaccaucgaucuggacccugugauuuacgauagcaaguucgagaaacaacuuggccaggucaugcugcucgugcugugugcugugcagcugcuccuuaugagaacauccugggcccugugcgaagcccugacccucgcuacggggccgaucacaacccugugggagggaucucccggcaaguuuuggaacaccacaauugccguuagcauggcgaauaucuuccgcggguccuaucuugccggagcuggccuggccuuuagcaucaugaaaucugucgggaccggacggagaggcacaggcucccagggggaaacgcucggagagaaguggaaaaagaagcugaaccaacugagccggaaagaguucgaccucuacaagaaauccggcauuaccgagguggaucgcacagaggcuaaggaagggcuuaaaagaggagagaccacacaucacgccgugucucggggcagcgcgaagcugcagugguuugucgaacgcaauaugguuaucccugaggggagagugauugaccugggauguggccggggcgggugguccuauuacugcgccggacucaaaaaggugaccgaaguccgcggcuauacgaaaggcgggcccgggcaugaggagccugugcccaugucuaccuacggguggaaccugguuaaacuuaugagcggaaaggauguguucuaccugccgccugaaaaaugugacacacuccugugcgauaucggcgaguccagccccucucccaccgucgaagaguccagaacaauucgggugcugaagaugguugagccuuggcucaaaaauaaccaguucuguaucaaggugcuuaaucccuauaugccuaccgucauugaacaccuggagcgccugcagagaaaguacggcgggaugcucgugcggaacccgcugagcagaaauucuacacacgaaauguauuggaucuccaacggaaccggcaauaucgugagcucugucaacaugguuagccgccuucugcucaaucgguuuacgaugacacauagacgccccaccauugagaaagacguggaccugggggcuggaacccggcacgugaacgccgaaccugagacacccaacauggaugucaucggcgagagaauuaagcgcaucaaagaagaacauuccucuacguggcacuacgacgaugaaaauccuuauaagaccugggcuuaccacgggagcuaugaggugaaagccacaggauccgcuagcuccaugauuaacggcguugugaagcugcucaccaagcccugggacgucgugccgaugguuacacaaauggccaugaccgauacaaccccuuucggccagcagcggguguuuaaagaaaaggucgacacgagaacaccccgcccuaugcccgggacacggaaagugauggagaucaccgcggaguggcuguggagaacacuuggacgcaauaagaaaccucggcugugcaccagagaagaguucacgaagaagguucgcacaaacgccgcuaugggcgccguguuuaccgaagagaaucaaugggauucugcuagagccgccgucgaagacgaggaguucuggaaacucguggaucgggaacgcgagcugcauaaacuugggaaauguggaagcugcgucuacaacaugaugggcaagagagagaagaagcugggggaguuuggcaaagcgaagggaucccgggcuaucugguacauguggcucggcgccagauaucuggaguucgaagcccugggguuucucaaugaggaccacugguucucucgggaaaacagcuacuccggaguggagggcgaagggcugcauaaacuuggauauauucugcgcgauaucucuaaaauucccggcggggcuauguacgccgacgacacagcuggcugggauaccagaaucacggaggacgaucuccacaaugaggaaaagauuacccagcagauggacccggagcaucggcagcuggccaacgcgaucuuuaaacuuacauaucaaaauaagguugugaaaguccagcgcccuacccccaagggaacagugauggauaucauuagcagaaaggaccagcggggcuccggacaggugggaaccuacggccugaacacauucaccaauauggaagcccaacucguucgccagauggagggggaaggagugcugagcaaagcugaucuggagaacccccaccuccuggagaagaaaaucacgcaguggcuugaaacaaagggcgucgagagacugaaacggauggccauuucuggggacgauugcgugguuaagccuaucgacgaucgcuuugcuaaugcccuccuggcgcuuaacgacaugggcaaggugagaaaagauauuccgcaguggcaacccuccaagggauggcacgacuggcagcaggucccuuucuguagccaucacuuccaugaacugaucaugaaagacggccggaagcucgugguccccugccgcccucaggaugagcugaucgggagagcccggauuucucaaggagcuggcuggucccugaaagaaaccgccugucucgggaaggcuuaugcccagauguggagccugauguacuuucaccgcagagaccuucggcuggcuucuaacgccaucugcuccgcggugcccguucacuggauuccuaccagcagaacaaccugguccauccaugcccaccaucaguggaugacaacggaggauaugcucaccguguggaaucgcgucuggauugaggacaaccccuggauggaagauaagacaccggugaccacaugggaggacguuccuuaccugggaaaacgggaagaucaaugguguggcagccuuaucgggcugaccucuagagcuacgugggcccagaauauucucaccgccauccaacaggugcgcagccugaucggcgacgaggaguuccuggauuauaugcccuccaugaagcgguuuagaaaagaagaggaaucugagggagcuauuugguga

SEQ ID NO: 20864 - RNA, 9873 nt, Artificial Sequence
  derived and/or modified CDS sequence (opt5) from DENV-3__FJ461338__SS-prME
accagccugugccucaugaugaugcugcccgccacacuugcuuuccaccugacguccagagacggagaaccucggaugaucguggggaagaacgaacgcggaaaaucucuccuguuuaagaccgccagcggaauuaauauguguacacuuaucgcgauggaucugggggaaaugugcgacgauaccgugacauacaaauguccgcucguugcugaaguggagcccgaagacauugauugcugguguaaccugaccuccacaugggugaccuauggaacgugcaaucaggccggcgagcauagacgggacaagcgcucuguggcccuggcuccucacguggggaugggacucgauaccagaacacagaccuggaugagcgccgagggcgcuuggcggcagguugaaaaaguggagacaugggcccugcgccaucccggcuucaccauccuugcgcuguuucucgcccacuacauugggacgucccugacacagaaggucgugaucuucauccuucugaugcucguuaccccuucuaugacaaugagaugugugggagucggcaaccgggacuuuguggaagggcugagcggagcuaccuggguggaugucguucuggagcauggcgggugcgugaccacaauggccaagaauaaacccacgcucgacauugagcugcagaagaccgaagcuacacagcuugccacccugcgcaaacucuguaucgagggaaagauuacaaacaucaccacggauuccagaugcccuacacagggcgaagcgauucugccggaggaacaggaccagaauuauguguguaaacacaccuacgucgaucggggcugggggaacggaugcggccuuuucgggaagggaagccuggugaccugcgccaaguuucaaugucucgagcccaucgagggcaaaguugugcaguaugaaaaucugaaguacacagucauuaucaccgugcacacaggggaccagcaucagguuggaaacgacacgcaaggcgugaccgucgagaucacaccucaggcuucuaccguggaagccguccugcccgaguauggcacacucgggcuggaaugcuccccucgcaccggacuugauuucaaugagaugauucugcucacgaugaaaaacaaggcuuggauggugcacagacagugguuuuucgaccugccccuuccguggaccagcggcgccacaaccgagacaccuaccuggaauaaaaaggaacugcucguuacguuuaaaaacgcccaugcuaagaagcaagagguggucgugcuggggucucaggaaggagcgaugcacacagcccugaccggcgcuacagagauccaaaauuccgggggcaccagcauuuucgccggacaccucaaaugucggcugaagauggauaaacuugaacugaagggcaugucuuacgccaugugccucaacaccuuuguucugaaaaaggagguguccgagacacagcaugggacgauccugauuaaggucgaauacaaaggagaggacgcucccuguaagaucccuuucagcaccgaagauggccaagggaaagcccacaacggacgccuuaucacagcgaaucccguggugaccaagaaagaggagcccguuaacauugaagcugagccuccguucggcgaauccaauaucgucauugggaucggcgacaaggcccucaagauuaacugguauaaaaagggaucuagcaucggcaaaauguuugaggccacagcuagaggggcccggagaauggcuauccugggagauaccgccugggacuucggcuccgucggcggggugcugaauagccucgggaagaugguccaucagauuuuugggucugcguacacggcccuguucuccggcgugagcuggaucaugaaaauuggaaucggcguucuucugacauggauugggcucaacucuaagaauaccagcauguccuuuucuugcaucgugauuggaaucaucacccuguaucugggcgcugucgugcaggccgauauggggugugcuauuaacuggaagggaaaagaacuuaagugcggcagcgggaucuucguuacaaaugaggugcacaccuggacagagcaguacaaauuucaagccgacucccccaagcgccucgcgacggccauugcuggcgccugggaaaacggagucuguggcauccggagcaccacaagaauggagaaucugcuguggaaacagauugcuaacgaacucaauuauauccugugggagaacaauaucaaacuuaccgugguugugggggauauuaucggaguccuggaacagggcaaacgcacacucaccccucagcccauggagcugaaguacucuuggaagacgugggggaaagccaagauugugaccgccgagacacaaaacuccagcuucaucauugacggaccuaacacccccgaaugcccgucugcuucccgggcguggaaugugugggaggucgaagacuauggcuuuggcguuuucacaaccaacaucuggcugaaacuuagagagguguacacacagagcugugaucaucgccucauguccgccgcuaucaaggacgaacgggccgugcacgccgauaugggguacuggauugagucucagaaaaauggaagcuggaagcuggagaaggcuuccuuuaucgaagucaaaaccugcacguggccuaagucucacacacuguggagcaacggcgugcucgaguccgacaugauuauccccaaaagccuggccgggccuauuucucagcauaaucacagacccggauaucauacccaaaccgcgggcccuuggcaccuugggaagcuggaacucgauuucaacuacugcgagggaacaaccguugugaucacggagaauuguggcacacgcggccccucccugcggaccacaaccgucagcgggaaacugauccacgaauggugcuguagaucuugcacacuuccgccucuccgcuauaugggagaggacggcuguugguacgggauggaaauucggcccaucaacgagaaggaagagaauauggugaagucccugguuagcgcuggaucuggcaaaguggauaacuuuaccauggggguccugugccucgccauucuguucgaggaagugaugagaggaaaguucggcaaaaagcauaugaucgccggcguucuuuuuacguucgugcugcuccugagcgggcagauuaccuggcgggacauggcucacacacugaucaugauuggauccaaugccagcgaucgcaugggcaugggggucaccuaucuugcgcugaucgcuacauuuaaaauccagcccuuccucgcccugggauuuuuccucagaaagcugaccucucgggagaaccuucugcucggcguggggcuggccauggcuacgacacugcaacuuccugaagacauugagcagauggccaauggaaucgcucugggccucaugacccugaagcucauuacacaguuugaaaccuaccagcuguggaccgcccuugugucccugacauguagcaacacgaucuucacccucacagucgcguggagaaccgccacacugauucuggcuggcguuucccuucugccgcucugccaaucuagcuccaugcgcaaaaccgauuggcugcccaugacgguggccgcuaugggggugccuccccucccucuguuuaucuucucucuuaaggacacacccaaacggagaagcuggccucugaaugagggagucauggccgugggccugguuuccauccucgccucuagccugcuucgcaacgaugugcccauggcugggccgcuggucgcgggaggccuccugauugccuguuaugugaucaccgggaccuccgcugaccucacaguugagaaggccgccgacgugaccugggaagaggaagcugagcagacaggagucagccauaaccugaugauuacgguggaugacgauggcaccaugagaaucaaagacgaugaaacagagaauauucuuaccguccugcugaagacagcccuccugaucgugucuggcaucuuuccuuacuccauucccgcgacccuucugguuuggcacacguggcagaaacagacccaacggagcggggugcucugggacgucccuucucccccggagacacagaaggcugaacuggaggaaggaguguaccgcaucaagcagcagggcauuuucgggaaaacccaaguuggagugggcguccagaaggaggggguguuucauacaauguggcacgugaccagaggagccguucucacacacaacggcaaacggcuggagccuaauugggccuccgucaagaaagaucuuaucagcuauggcgggggauggcgccugucugcucaguggcaaaagggcgaagagguccaggugauugccgucgaacccgggaagaacccuaaaaauuuccagacgaugcccggaaucuuccagaccacaaccggcgagauuggggcgaucgcucuggacuuuaagcccggaaccuccggcagcccuaucauuaacagagaaggcaaagugguugggcucuacggaaauggcguggucacaaagaacgggggauauguguccggcaucgcccaaacgaaugccgagccggaugggcccaccccugagcuggaagaggaaauguucaaaaagcggaaccuuacaauuauggaccugcaucccggcagcggaaagacccgcaaauaccucccugcuaucguuagagaggccauuaagcggcgccugagaacacucauccuggcucccacccggguggucgccgcggaaauggaggaggcccuuaaaggccugccuaucagauaucagacgacagcuaccaagucugaacacaccgggcgcgagauuguggaucugaugugccaugccacauuuaccaugcggcuccugagcccgguuagagugcccaauuacaaccuuaucauuauggacgaagcucacuucacagauccugccuccaucgccgcucgcggauauauuucuacccgggucggcaugggggaggcggccgcuaucuuuaugacggccacacccccuggaaccgccgaggcuuucccccagagcaaugccccgauccaggacgaggagagagacauuccugaacgcuccuggaacucuggcaaugaguggaucacagauuuuguggggaaaaccgugugguucguccccagcauuaaggcgggcaacgacaucgcuaacugucugcggaagaauggcaagaagguuauucaacucuccagaaaaacguuugauaccgaauaccagaagacacgccugaacgacugggauuucguggugaccacagacaucucugagaugggcgccaauuuuaaagccgaucgggucauugaccccagacggugccugaagccugugauccucaccgaugggcccgagcgcguuauccuugcuggaccuaugccggugacagccgcgagcgccgcucagagacggggccgcgucgggagaaacccccagaaggaaaaugaccaauacauuuucaccggacagccucugaacaaugaugaggaccaugcccacuggacggaagcuaaaaugcugcucgacaacaucaauacacccgagggcauuaucccugcccuguucgaacccgagcgggagaaguccgcugccauugauggggaauauagacuuaaaggcgagagccgcaagaccuuuguggaacugaugcggagaggagaccucccgguuuggcuggcgcacaaaguggccucugagggcaucaaguacaccgaucgcaaauggugcuucgacggggaacggaacaaucagauccuggaggagaacauggaugucgaaauuuggacaaaggagggagaaagaaagaaacuccgcccucgguggcuugacgcuagaaccuauuccgauccccuggcccugaaggaguuuaaagacuucgcugccggccgcaagagcaucgcccucgaucuggugacagaaauugggagagucccuucucaucuugcuuaccggacgcgcaaugcgcuggacaaccucgugaugcugcacaccuccgagcauggaggcagagccuaucggcacgcuguugaggaacugcccgagacaauggaaacccuccuucugcugggccucaugauccugcuuacagggggagccaugcuguuucucauuagcggcaaagggaucggaaagaccuccaucggccugauuugugugaucgugucuagcgggaugcuguggauggccgaugucccucuccaguggauugcuuccgccaucguucuugaguucuuuaugauggugcugcugauucccgagccggaaaagcaacgcacgccucaggacaaucagcucgcguacguggucaucggcauucugacccuugccgcuaucguggccgcuaacgagaugggccugcucgaaacaaccaaaagagaucugggcaugagcaaggagcccgggguugugucucccacauccuaucuggacgucgaccuccacccugccagcgcguggacccuuuacgccguggcuacgacagucaucaccccgaugcugcggcauacaauugaaaauucuaccgccaacgugagccuggcugccaucgcuaaccaagccguugugcucaugggacuggauaaaggcuggcccauuuccaagauggaccuuggggucccucugcucgcgcugggaugcuacucucaggugaauccccugacccucacagccgcuguucuucugcuggugacgcacuaugccaucauuggcccugggcuccaggcuaaagccaccagagaggcccagaagcgcacagcggcuggaaucaugaagaaccccaccgucgauggcaucaugacaauugaccuggauccugugaucuacgacagcaaauucgagaagcaacuuggccaggugaugcugcucguucugugugccguccagcugcuccuuaugcggaccuccugggcucugugcgaagcccugacgcucgccacagggccgauuaccacccugugggagggaucucccggcaaauuuuggaauacaaccaucgcugugagcauggccaacauuuucagaggguccuaucuugcgggagccggccuggcuuuuagcaucaugaagucuguggggacaggacgccggggcacgggcucccagggggaaacccucggagagaaauggaagaagaaacugaaucaacugagcagaaaggaguucgaucucuacaaaaaguccggcaucacagaggucgaccggaccgaggccaaagaagggcuuaagcgcggagagacaacccaucacgcuguuucuagaggcagcgccaaacugcagugguuuguggaacggaacauggugauuccugaggggcgcgucaucgaucugggauguggcagaggcgggugguccuauuacugcgcgggacucaagaaggugacggaaguucggggcuauaccaaagggggacccggccaugaggagccugugcccaugucuacauacggguggaauauugucaagcugaugagcggaaaagacguguucuaccuuccgccugaaaagugugauacccugcucugcgacaucggcgaguccagccccucucccacaguugaagagucccgcaccauuagagugcugaaaauggucgagccuuggcugaagaacaaucaguucuguaucaaggugcucaaccccuauaugccuacagugauugaacaccuugagcggcugcagcgcaaauacggcgggaugcuggucagaaauccgcucagccggaacucuacccacgaaauguauuggaucuccaauggaacgggcaacaucguuagcucugugaauauggugagcagacugcuucugaaccgcuuuacaaugacccaucggagacccaccauugagaaggaugucgaccucggggccggaacacgccacgugaacgcugaaccugagacgcccaauauggacguuaucggcgagcggauuaaaagaaucaaggaagaacacuccucuaccuggcacuacgaugacgaaaacccuuauaaaacaugggccuaccacgggagcuaugaggugaaggcuaccggauccgccagcuccaugauuaauggcgucgugaagcugcugacaaaacccugggauguugugccgauggucacccaaauggcuaugacagacaccacgccuuucggccagcagcgcguguuuaaggaaaaaguugauacccggacacccagaccuaugcccgggacccgcaaggugauggagaucacagccgaguggcucuggcggacccugggaagaaacaaaaagccucgccuuugcacgcgggaagaguucacaaagaaagucagaaccaaugcggccaugggcgcuguguuuacagaagagaaccaaugggacucugcccgcgcugccgucgaagaugaggaguucuggaagcugguggacagagaacgggagcuccauaaacuggggaaguguggaagcugcguuuacaauaugaugggcaaacgcgaaaagaaacuuggggaguuuggcaaggccaagggauccagagcgaucugguacauguggcugggcgcucgguaucucgaguucgaagcccugggguuucugaacgaggaucacugguucucuagagaaaauagcuacuccggaguggagggcgaagggcuccauaaacugggauauauucuucgggacaucucuaagauucccggcggggccauguacgcugaugacaccgccggcugggacacgcgcaucaccgaggaugaccugcacaacgaggagaaaauuacacagcagauggauccggagcauagacagcucgcuaaugccaucuuuaagcugaccuaucaaaacaaagucgugaaggugcagcggccuacacccaagggaaccguuauggacaucauuagccgcaaagaucagagaggcuccggacaggugggaacauacggccuuaauaccuucacgaacauggaagcgcaacugguccggcagauggagggggaaggagugcucagcaaggccgaccuggagaauccccaucugcucgagaaaaagaucacacaguggcuggaaaccaaaggcguugagcgccuuaagagaauggcuauuucuggggaugacugcguggucaagccuaucgaugaccgguuugccaacgcucugcucgcccugaacgauaugggcaaagugcgcaaggacauuccgcaguggcaacccuccaaaggauggcacgauuggcagcaggucccuuucuguagccaucacuuccaugaacuuaucaugaaggacggcagaaaacuggugguucccugccggccucaggacgagcucaucgggcgcgcgagaauuucucaaggagccggcuggucccugaaggaaaccgcuugucuggggaaggccuaugcucagauguggagccucauguacuuucaccggcgcgaucugagacuugccucuaaugcuaucugcuccgccgugcccguccacuggauuccuacaagccggaccacaugguccauccaugcgcaccaucaguggaugacgaccgaggacaugcugacaguguggaacagaguuuggauugaggauaaucccuggauggaagacaaaaccccggugacaaccugggaggaugucccuuaccucggaaagcgcgaagaccaaugguguggcagccugaucgggcuuacgucucgggccaccugggcucagaacauucugacagccauccaacaggugagaagccucaucggcgaugaggaguuccuggacuauaugcccuccaugaaacgcuuucggaaggaagaggaaucugagggagccauuugguga

SEQ ID NO: 20865 - RNA, 9873 nt, Artificial Sequence
  derived and/or modified CDS sequence (opt5) from DENV-3__FJ562103__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacagauguccgcucauugcugaaguugagcccgaagacaucgauugcugguguaaccugaccuccacaugggugaccuauggaacgugcaaucaggccggcgagcaucggcgcgacaaaagaucuguggcccuggcuccucacgucgggaugggacucgauacccggacacaaaccuggaugagcgccgagggcgcuuggcgccagguggaaaagguugagacaugggcccugagacaucccggcuucaccauucuugcgcuguuucucgcccacuacaucgggacgucccugacacagaaaguggucaucuucacccuucugaugcucgugacaccuucuaugaccaugcgguguguuggagugggcaaccgcgacuuugucgaagggcugagcggagcuaccuggguggaugugguccuggagcauggcgggugcguuacaacgauggccaagaauaagcccacccucgacauugagcugcagaaaacagaagcuacccaacuugccacacugagaaagcucuguaucgagggaaaaauuaccaacaucacgacagauucccggugcccuacccagggcgaagcgauucugccggaggaacaggaccagaauuauguguguaagcacaccuacguggaucgcggcugggggaacggaugcggccuuuucgggaaaggaagccuggucacaugcgccaaguuucaaugucucgagcccaucgagggcaaggugguucaguaugaaaaucugaaauacaccgugauuaucacaguccacacgggggaccagcaucaggugggaaacgacacccaaggcguuacaguggagaucaccccucaggcuucuacagucgaagccgugcugcccgaguauggcacccucgggcuggaaugcuccccuagaacgggacuugauuucaaugagaugauucugcucaccaugaagaacaaagcuuggaugguccaccggcagugguuuuucgaccugccccuuccguggacaagcggcgccaccacagagaccccuacguggaaucgcaaggaacugcucgugacauuuaaaaacgcccaugcuaagaaacaagagguugugguccuggggucucaggaaggagcgaugcacaccgcccugacaggcgcuaccgagauccagaauuccgggggcaccagcauuuucgccggacaccucaaguguagacugaagauggauaaacuugaacugaagggcaugucuuacgccaugugccucaacacauuugugcugaaaaaggagguuuccgagacgcagcaugggaccauccugauuaaaguggaauacaagggagaggacgcucccuguaagaucccuuucagcacagaagauggccaagggaaagcccacaacggacggcuuaucaccgcgaaucccgucgugacaaagaaagaggagcccgugaacauugaagcugagccuccguucggcgaauccaauaucguuauugggaucggcaacaaggcccucaaaauuaauugguauaagaagggaucuagcaucggcaaaauguuugaggccaccgcuagaggggcccgccggauggcuauccugggagacacggccugggauuucggcuccgucgggggagugcugaacagccucggcaagauggugcaucagauuuuugggucugcguacacagcccuguucuccggcgucagcuggaucaugaaaauuggaaucggcgugcuucugaccuggauugggcucaauucuaagaacaccagcauguccuuuucuugcaucguuauuggaaucaucacacuguaucugggcgcugugguccaggccgacauggggugugcuauuaauuggaaaggaaaggaacuuaagugcggcagcgggaucuucgugaccaacgagguucacacauggacggagcaguacaaauuucaagccgauucccccaagagacucgcgaccgccauugcuggcgccugggaaaauggaguguguggcauccgcagcacaacccggauggagaaccugcuguggaaacagauugcuaaugaacucaacuauauccugugggagaauaacaucaagcuuacagucgugguuggggacauuaucggagugcuggaacagggcaaaagaacccucacgccucagcccauggagcugaaguacucuuggaaaaccugggggaaggccaagauugucacagccgagacccaaaacuccagcuucaucauugauggaccuaauacacccgaaugcccgucugcuucccgcgcguggaacgugugggagguggaagacuauggcuuuggcgucuucaccacaaauaucuggcugaaacuucgggagguuuacacccagagcugugaccauagacucauguccgccgcuaucaaggaugaacgcgccgugcacgccgacaugggguacuggauugagucucagaaaaacggaagcuggaagcuggagaaagcuuccuuuaucgaagugaagacgugcacauggccuaagucucacacccuguggagcaauggcguccucgaguccgauaugauuauccccaaaagccuggccgggccuauuucucagcauaaccaccggcccggauaucauacccaaacagcgggcccuuggcaccuugggaagcuggaacucgacuucaauuacugcgagggaaccacggugguuaucacagagaacuguggcaccagaggccccucccugcgcacaaccacagugagcgggaaacugauccacgaauggugcugucggucuugcacccuuccgccucucagauauaugggagaggauggcuguugguacgggauggaaauucggcccaucaaugagaaggaagagaacauggucaaaucccuggugagcgcuggaucuggcaagguugacaauuuuacgaugggggugcugugccucgccauucuguucgaggaagucaugcgcggaaaguucggcaaaaagcauaugaucgccggcgugcuuuuuaccuucguucugcuccugagcgggcagauuacauggagagauauggcucacacccugaucaugauuggauccaacgccagcgaccggaugggcaugggggugacauaucuugcgcugaucgcuaccuuuaaaauccagcccuuccucgcccugggauuuuuccucagaaagcugacgucucgcgagaaucuucugcucggcgucgggcuggccauggcuacaacccugcaacuuccugaagauauugagcagauggccaacggaaucgcucugggccucaugacacugaaacucauuacccaguuugaaaccuaccagcuguggacagcccuugugucccugacguguagcaauaccaucuucacacucaccguggcguggcggacagccacccugauucuggcuggcgucucccuucugccgcucugccaaucuagcuccaugagaaagacggacuggcugcccaugacaguugccgcuaugggggugccuccccucccucuguuuaucuucucucuuaaggauacccccaaacgcagaagcuggccucugaacgagggagugauggccgucggccugguguccauccucgccucuagccugcuucggaacgacguucccauggcugggccgcugguggcgggaggccuccugauugccuguuaugucaucaccgggacauccgcugaucucaccguggagaaggccgccgacguuacaugggaagaggaagcugagcagacgggagugagccauaaucugaugauuaccgucgacgaugacggcacaaugcgcaucaaagaugacgaaaccgagaacauucuuacagugcugcugaagaccgcccuccugaucgucucuggcaucuuuccuuacuccauucccgcgacgcuucugguguggcacaccuggcagaaacagacacaaagaagcgggguucucugggaugugccuucucccccggagacccagaaggcugaacuggaggaaggagucuaccggaucaaacagcagggcauuuucgggaagacacaagugggaguuggcgugcagaaggagggggucuuucauaccauguggcacgugacacgcggagccgugcucacgcacaauggcaaaagacuggagccuaacugggccuccguuaagaaagaccuuaucagcuauggcgggggauggcggcugucugcucaguggcaaaagggcgaagagguccaggugauugccguggaacccgggaaaaauccuaagaacuuccagaccaugcccggaaucuuccagacaaccaccggcgagauuggggcgaucgcucuggauuuuaagcccggaacauccggcagcccuaucauuaaucgcgaaggcaaagucguggggcucuacggaaacggcguugugacgaagaaugggggauaugucuccggcaucgcccaaaccaacgccgagccggacgggcccacaccugagcuggaagaggaaauguucaaaaagagaaaucuuaccauuauggaucugcaucccggcagcggaaaaacacggaaguaccucccugcuaucgugcgcgaggccauuaagagacggcugagaacccucauccuggcucccacgcgcguuguggccgcggaaauggaggaggcccuuaaaggccugccuauccgguaucagacaaccgcuaccaagucugaacacacagggagagagauugucgaccugaugugccaugccaccuuuacaaugcgccuccugagcccggugcggguucccaacuacaaucuuaucauuauggaugaagcucacuucaccgacccugccuccaucgccgcuagaggauauauuucuacgcgcgugggcaugggggaggcggccgcuaucuuuaugacagccacccccccuggaacagccgaagcuuucccccagagcaacgccccgauccaggaugaggagaaagacauuccugaacgguccuggaauucuggcaacgaguggaucaccgacuuugucgggaagacggugugguucgugcccagcauuaaagcgggcaacgauaucgcuaauugucugagaaagaacggaaagaaagucauucaacucucccgcaagaccuuugacacagaauaccagaaaacccggcugaaugauugggacuucguugugacaaccgauaucucugagaugggcgccaacuuuaaggccgacagagugauugauccccggcgcugccugaaaccugucauccucacagacgggcccgagagagugauccuugcuggaccuaugccgguuaccgccgcgagcgccgcucagcggcgcggcagaguggggcggaauccccagaaggaaaacgaucaauacauuuucacgggacagccucugaauaacgacgaggaucaugcccacuggacagaagcuaagaugcugcucgacaauaucaacacccccgagggcauuaucccugcccuguucgaacccgagagagagaaauccgcugccauugacggggaauaucgccuuaagggcgagagccggaaaaccuuugucgaacugaugagacgcggagaucucccgguguggcuggcgcacaagguugccucugagggcaucaaauacacagaccggaaguggugcuucgauggggaaagaaauaaccagauccuggaggagaauauggacguggaaauuuggaccaaagagggagaacgcaagaagcuccggccuagauggcuugaugcucgcacauauuccgacccccuggcccugaaagaguuuaaggauuucgcugccggcagaaaaagcaucgcccucgaccuggucacggaaauugggcgggugccuucucaucuugcuuaccgcaccagaaacgcgcuggauaaucucgucaugcugcacacauccgagcauggaggccgggccuaucgccacgcuguggaggaacugcccgagaccauggaaacacuccuucugcugggccucaugauccugcuuaccgggggagccaugcuguuucucauuagcggcaaggggaucggaaaaacguccaucggccugauuuguguuaucgugucuagcgggaugcuguggauggccgacgugccucuccaguggauugcuuccgccaucguccuugaguucuuuaugaugguucugcugauucccgagccggaaaagcaaagaaccccucaggauaaccagcucgcguacguggugaucggaauucugacacuugccgcuaucgucgccgcuaaugagaugggccugcucgaaaccacaaagcgggaccugggcaugagcaaagagcccggggugguuucucccaccuccuaucuggauguggaccuccacccugccagcgcguggacgcuuuacgccgucgcuacaaccgugaucacaccgaugcugagacauaccauugaaaacucuaccgccaacgucagccuggcugccaucgcuaaucaagccgugguucucaugggacuggacaagggcuggcccauuuccaaaauggaucuuggggugccucugcucgcgcugggaugcuacucucaggucaacccccugacacucacggccgcugugcuucugcugguuacccacuaugccaucauuggcccugggcuccaggcuaaggccacacgcgaggcccagaaacggaccgcggcuggaaucaugaagaaucccacaguggacggcaucaugaccauugaucuggacccugucaucuacgauagcaaguucgagaaacaacuuggccaggugaugcugcucgugcugugugccguucagcugcuccuuaugagaacguccugggcucugugcgaagcccugacacucgccaccgggccgauuaccacacugugggagggaucucccggcaaguuuuggaacaccacaaucgcugucagcauggccaauauuuuccgcggguccuaucuugcgggagccggccuggcuuuuagcaucaugaaaucuguggggacgggacggagaggcaccggcucccagggggaaacacucggagagaaguggaaaaagaagcugaaccaacugagccggaaagaauucgaccucuacaagaaauccggcaucaccgagguggaucgcacagaggccaaggaagggcuuaaaagaggagagaccacgcaucacgcugucucucggggcagcgccaagcugcagugguuuguugaacgcaauauggugauuccugaggggagagugaucgaccugggauguggccggggcgggugguccuauuacugcgcgggacucaaaaaggucaccgaagugcgcggcuauacaaaggggggacccggccaugaggagccuguucccaugucuaccuacggguggaacauugugaaacugaugagcggaaaggaugucuucuaccuuccgccugaaaaaugugacacacugcucugcgauaucggcgaguccagccccucucccaccguggaagaguccagaacaauucggguucugaagaugguggagccuuggcugaaaaauaaccaguucuguaucaagguccucaaucccuauaugccuaccgugauugaacaccuugagcgccugcagagaaaguacggcgggaugcuggugcggaacccgcucagcagaaauucuacgcacgaaauguauuggaucuccaacggaacaggcaauaucgucagcucuguuaacauggugagccgccugcuucugaaccgguuuaccaugacccauagacgccccacaauugagaaagacguggaucucggggccggaacgcggcacgucaaugcugaaccugagacccccaacauggacgugaucggcgagagaauuaagcgcaucaaagaagagcauuccucuacauggcacuacgacgaugaaaauccuuauaagaccugggccuaccacgggagcuaugagguuaaagcuacaggauccgccagcuccaugauuaacggcguggucaagcugcugaccaagcccugggacgugguuccgauggugacacaaauggcuaugaccgauacgaccccuuucggccagcagcgggucuuuaaagaaaagguggacacaagaaccccccgcccuaugcccgggacacggaaaguuauggagaucaccgccgaguggcucuggagaacgcugggacgcaauaagaaaccucggcuuugcacaagagaagaguucaccaagaaggugcgcacaaacgcggccaugggcgcugucuuuaccgaagagaaucaaugggauucugccagagcugccguggaagacgaggaguucuggaaacuggucgaucgggaacgcgagcuccauaagcuggggaaauguggaagcugcguguacaacaugaugggcaagagagaaaaaaagcuuggggaguuuggcaaagccaagggaucccgggcgaucugguacauguggcugggcgcuagauaucucgaguucgaagcccugggguuucugaaugaggaccacugguucucucgggaaaacagcuacuccggaguugagggcgaagggcuccauaagcugggauauauucuucgcgauaucucuaaaauucccggcggggccauguacgcugacgauacggccggcugggacaccagaaucacagaggacgaucugcacaaugaggaaaagauuacccagcagauggacccggagcaucggcagcucgcuaacgccaucuuuaaacugacauaucaaaauaagguggucaaagugcagcgcccuacccccaagggaacagugauggauaucauuagcagaaaggaccagcggggcuccgggcagguuggaaccuacggccuuaacacguucacaaauauggaagcgcaacuggugcgccagauggagggggaaggaguccucagcaaagccgaucuggagaacccccaccugcucgagaagaaaaucacccaguggcuggaaaccaagggcguggagagacuuaaacggauggcuauuucuggggacgauugcguugugaagccuaucgacgaucgcuuugccaacgcucugcucgcccugaaugacaugggcaaggucagaaaagauauuccgcaguggcaacccuccaagggauggcacgacuggcagcaggugccuuucuguagccaucacuuccaugaacuuaucaugaaagauggccggaagcuggucgugcccugccgcccucaggacgagcucaucgggagagcgcggauuucucaaggagccggcuggucccugaaagaaacagcuugucuggggaaggccuaugcucagauguggagccucauguacuuucaccgcagagaccugcggcuugccucuaacgcuaucugcuccgccguucccgugcacuggauuccuaccagcagaacaacgugguccauccaugcgcaccaucaguggaugaccacagaggauaugcugaccgucuggaaucgcguguggauugaggacaaccccuggauggaagauaagacaccgguuaccacgugggaggacaucccuuaccucggaaaacgggaagaucaaugguguggcagccugauugggcuuaccucuagagccacaugggcucagaauauccugaccgccauccagcaggugcgcagccucauuggcgacgaggaguuccuggauuauaugcccuccaugaagcgguuuagaaaagaagaggaaucugagggagccaucugguga

SEQ ID NO: 20866 - RNA, 9873 nt, Artificial Sequence
  derived and/or modified CDS sequence (opt5) from DENV-3__FJ898456__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagaacccaaacauggaugagcgcugagggcgccuggcggcagguggaaaaaguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccaacuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaagccguucagcacgaaaaucucaaguauaccgugauuaucacaguccauacgggggaccagcaccaggugggaaacgagacccaaggcguuacagcugaaaucaccccccaggccuccacaguggaggcuauucugccugaauacggcacccuggggcucgagugcagcccccgcacgggacuggacuuuaaugagaugauccuucugaccaugaaaaacaaggccuggaugguccauagacagugguucuuugaucucccucugcccuggacaucuggcgccaccacagaaaccccgacguggaauaaaaaggagcuucuggugacauucaaaaacgcucacgcgaagaagcaagaagucgugguucucgggucccaggagggagccaugcacaccgcucugacaggcgccaccgaaauucagaccagcgggggcacaucuaucuuugccggacaucugaaaugucggcucaagauggacaaacuggagcuuaagggcauguccuaugcuaugugccugaaugccuucgugcucaaaaaggaggucagcgaaacgcagcacgggaccauucugaucaagguggaguacaaaggagaagaugcgccuuguaagauccccuucuccacagaggacggccaagggaaagcucauaacggacgccugauuaccgccaacccuaucguuacaaagaaagaggaacccgugaauauugaggccgaacccccuuuuggcgagucuaacaucgucauugggaucggcgauaaggcucuuaagaucaauugguacaaaaagggaagcuccauuggcaaaauguucgaagccaccgcuagaggggcccggagaauggcgauccucggagacacggccugggauuuuggcagcguggggggagugcugaacucucugggcaagaugguucaccagauuuucggguccgcuuauacagcccucuuuagcggcgucucuuggaucaugaaaauuggaaucggcgugcugcuuaccuggauugggcugaauagcaagaacaccuccaugucuuucagcugcaucgugaucggaauuaucacacucuaccugggcgcugucgugcaggccgacaugggguguguuauuaauuggaagggaaaagagcugaagugcggcuccgggaucuuugugaccaacgagguccauacauggacggaacaguauaaauuccaagcggauagcccgaagcgccuugccaccgcuauugccggcgcuugggagaauggaguguguggcauccggucuacaaccagaauggaaaaccuccuguggaaacagaucgccaaugagcugaacuacauucucugggaaaauaacaucaagcugacaauuguugugggggacgucaucggaauucuugagcagggcaaacgcacccugacgccccagccuauggagcucaaguauuccuggaagaccugggggaaagccaagaucgugacagcugaaacccaaaauagcucuuuuaucauugauggacccaacacaccugagugccccuccgcgagccgggccuggaacguuugggaaguggaggacuacggcuucggcgucuuuaccacaaauaucuggcugaaacugagagaaauguauacccagcuuugugaccaccgccucauguccgcugccgugaaggaugagcgggccgugcacgcugacaugggguacuggauugagucucagaaaaacggaagcuggaagcuggaaaaggccucccugaucgaggucaaaacgugcacauggccgaagucucauacccucuggagcaauggcguucuggaauccgauaugauuaucccuaaaagccuugcggggcccaucucucagcacaacuacagaccuggauaucauacccaaacagcuggccccuggcaccuggggaagcucgagcuggacuucaauuacugcgagggaaccacgguggugauuacagaaaacuguggcacccgcggcccuucccugcggacaaccacagucagcgggaaacuuauccacgaguggugcuguagaucuugcacccuccccccgcugcgcuauaugggagaagauggcuguugguacgggauggagauucggccuaucaaugaaaaggaggagaacauggugaagucccugguuagcgccggaucuggcaaagccgacaauuuuacgaugggggugcucugccuggcuauuuucuucgaagaggucaugagaggaaaguuuggcaaaaagcauaugaucgccggcgcgcuuuucaccuuugugcugcuccugagcgggcagauuacauggcgggauauggcucacacccugaucaugaucggauccaacgccagcgaccgcaugggcauggggguuacauaucuugcccugauugcuaccuucaaaauccagcccuuucucgcccugggauucuuucucagaaagcugacgucucgggaaaaucuucugcucggcguggggcuggcuauggccacaacccugcaacuucccgaggauauugaacagauggcgaacggaaucgcccugggccucauggcucugaagcucauuacacaguucgagaccuaccagcuguggaccgcccuugucucccugauguguagcaauacaaucuuuacgcucaccguggcuuggagaacagccacccugauccuggccguuauuucccuucugccugugugccaaucuagcuccaugcgcaaaacagacuggcucccgaugaccgucgcugcgaugggcgugcccucucugccucucuucaucuuuagccugaaggauacgcuuaaacggagauccuggccccugaacgagggggugauggccgucggacugguuucuauucucgcuagcuccuuccugcgcaaugacgugccuauggccggcccccuuguggccgggggacugcucaucgcuuguuaugucauuacaggcaccagcgccgaucugaccguggaaaaggcggcugacguuacaugggaggaagaggccgaacagaccggggugucucauaaccucaugaucacagucgacgaugacggaacgaugagaaucaaagaugacgagaccgagaacauucugacagugcuucugaagaccgcccugcucaucguuuccggcauuuuuccuuacagcauccccgcuacacugcuuguguggcacaccuggcagaaacagacgcaacggucuggcguccugugggaugugccguccccucccgaaacccagaaggccgagcucgaagagggggucuaccgcauuaagcagcagggaaucuucggcaaaacacaaguggggguuggagugcagaaggagggcgucuuccauaccauguggcacgugacaagaggggcgguucugacccacaauggaaaacggcucgaaccuaacugggcuaaugugaagaaagaccugauuagcuauggcggcggguggaagcuuucugcccaguggcaaaagggagaggaaguccaggugaucgccguggagcccggcaaaaacccgaaguccuuucagacaaugccugggaucuuccagacgaccacaggagaaauuggcgcuaucgcccuggauuuuaaacccgggaccagcggauccccuauuaucaaucgcgagggcaagguugucggccuguacgggaacggaguggugaccaaaaauggcggguaugucagcggaauugcucaaacaaacgccgagcccgacggccccacgccugaacucgaggaagagauguucaagaagagaaaucugaccaucauggaucuucauccggggucuggcaaaacacggaaguaccugcccgcgaucgugcgcgaagccauuaaaagacggcuccgcacccugauccucgcuccuacaagaguuguggccgcugagauggaggaagcccugaagggacuucccauucgguaucagaccacggccacaaaaagcgagcacaccggcagagaaaucgucgaccugaugugccaugcuaccuuuacaaugcgccugcucuccccugugcggguucccaacuacaaucugauugugauggaugaggcgcacuucaccgacccugccucuaucgcugccagaggguauaucagcacacgcgucggaaugggcgaagccgcugccauuuuuaugaccgcgacgccgcccgggacagcugaugccuucccucaguccaacgcccccauccaggacgaggagcgggacauuccugaaagaucuuggaauagcggaaacgaguggaucaccgauuuugcuggcaagacagugugguucguucccuccauuaaggccgggaaugacaucgcgaacugucuucgcaaaaacggcaagaaagugauucaacugucucggaagaccuuuaauacggaauaccagaaaaccaagcucaacgauugggacuucgucgugacaaccgauaucagcgagaugggagccaauuucaaggcugacagagugaucgauccgcgccggugccugaaaccugucauucugacagacggccccgagagaguuauccucgccgggcccaugccugugaccguggcuuccgccgcucagcggcgcggaagagucggccggaacccccagaaggaaaaugaucaauacauuuuuacagggcagccucuuaacaaugacgaggaucaugcccacuggaccgaagcgaaaaugcugcuggacaacaucaauacgccggagggaauuauccccgcccucuucgaaccugagcgcgagaagagcgcugccaucgacggcgaauauagacugaaaggggagucucggaagacauuuguggaacuuaugagacgcggcgaucugcccguuuggcucgcucacaaaguggccuccgagggaauuaaguacaccgaccggaaguggugcuucgauggcgaaagaaacaaucagauccuggaggagaacauggacgucgaaauuuggaccaaagagggggaaaagaaaaagcugcgcccucgguggcucgaugccagaacauauagcgacccccuugcucugaaagaguuuaaggauuucgcggccggacgcaagucuaucgcucuggaccucgugaccgaaauuggccggguuccgucccaucuggcccacagaacacgcaaugcccuugauaaccuggugaugcuccauacgagcgagcacgggggaagagcuuaccggcacgccgucgaggaacugccugagaccauggaaacacugcuccuucugggccugaugauccuccugaccggcggggcgaugcuuuuucugaucuccggaaaaggcauugggaagacaucuaucggacucauuuguguggucgccagcuccggcaugcuguggauggcugacgugccccugcaguggaucgccagcgcuauuguucucgaguucuuuaugauggugcuucugaucccugagcccgaaaaacaacgcaccccucaggauaaucagcuggccuauguggucauugggauccucacgcuggcggccaucguugcugccaacgagaugggacuucuggaaaccacaaagagagaccucggcaugucuaaagagcccggcgugguguccccgaccagcuaccuggaugucgaccugcauccugcuucugccuggacacucuaugcuguggccaccacgguuauuacacccaugcuucggcacaccaucgaaaauagcacagcgaacgugucccuggccgcuauugccaaccaagcugucgugcugauggggcucgacaagggauggcccaucucuaagauggaucugggcgucccucuucuggcccucgggugcuacagccaggugaauccgcugacccugaccgccgcgguucuccuucuggugacacauuacgcuauuaucggacccggccugcaggccaaagcuacgcgcgaggcccagaagagaaccgccgcugggaucaugaaaaacccuacagucgacggaauuaugaccaucgaucucgaccccgugauuuaugauuccaaguucgagaaacaacugggccagguuaugcuucuggugcucugugccguccagcugcugcucaugcggacaucuugggcguuuugcgaagcccuuacccuggcuacgggcccuaucacaacccugugggaggggagccccggaaaguucuggaauaccacaauugccguguccauggcuaacaucuuuagaggcagcuaccucgccggggcgggacuggccuucucuaucaugaaguccgugggcaccgggaaacgcggaacaggcagccagggcgaaacgcuuggggagaaguggaaaaagaaacugaaucaacucucccggaaggaauucgaccuguauaaaaagucuggaauuaccgagguugagagaacagaagcuaaggagggccugaaacgcggggaaaucacccaccaugccgucagccggggauccgcuaagcuccagugguuuguggagagaaacauggugauuccugaaggccgggucaucgaucuuggguguggacgcggcggcuggucuuacuauugcgccgggcugaaaaagguuacagaggugagaggauacaccaaaggcgggccgggacacgaggaacccgugccuaugagcacguauggcuggaauauugucaagcugauguccgggaaggacguguucuaccuccccccugagaaaugugauacccugcuuugcgacaucggagaaagcucucccuccccgacaguugaggagagccggaccauucgcgugcugaagauggucgaaccuuggcucaaaaacaaucaguuuuguaucaaggugcugaaccccuacaugcccacaguuaucgagcaccuggaaagacuccagcggaaacauggcggcaugcuugugcgcaauccucugucuagaaacuccacccacgagauguauuggauuagcaaugggacaggaaacaucgucucuagcgugaauauggugucccggcugcuccugaaccgcuucaccaugacgcauagacggcccacaauugaaaaggaugucgaccuuggcgcugggaccagacacguuaacgccgagccugagaccccgaauauggaugugaucggagaacgcauucggagaaucaaggaggaacacucuagcacauggcauuacgacgacgagaaccccuauaaaacgugggcguaccacggcuccuaugaagugaaggccaccgggagcgcuuccucuaugaucaauggagucgugaaacugcucacaaagccuugggauguugugcccauggucacccaaauggccaugacagacaccacaccuuuuggccagcagcgcguguucaaagagaagguugauacccggacgcccagaccgaugccuggcacccgcaaggugauggagauuacagcugaauggcuguggcggacccuggggagaaacaaacgcccccggcucugcacaagagaggaauuuaucaagaaaguccgcaccaaugccgccaugggagcgguguucacggaggaaaaccaaugggacagcgcucgggccgccguugaggaugaggaauuuuggaagcugguggacagagagcgcgaacuucauaaacugggcaaguguggguccugcgucuacaauaugaugggaaaaagagagaagaagcucggcgaguucgggaaagcuaagggcucucgggccauuugguauauguggcugggagcucgcuaccuugaauuugaggcccugggcuuccucaacgaagaucacugguuuagcagagagaauuccuacucugggguggaaggagagggccugcauaaacugggguauauccuccgggacauuagcaagaucccuggaggcgcgauguacgccgaugacacagcugggugggauaccagaaucacagaggacgaccugcacaacgaagagaaaauuacccagcagauggaucccgaacaccggcgccuugccaaugcuaucuucaagcugacguaucagaacaaggucgugaaaguucaaagaccuacccccaagggcacagugauggacauuaucucccggaaagaucagcgcggaagcggccaggucgggaccuacggacucaauacauucaccaacauggaggcccagcugauuagacaaauggaaggcgagggggugcuuucuaaggcggaccuggagaauccgcaucuccuggaaaaaaaggugacacaguggcuggagaccaagggaguugaacggcucaaacgcauggccaucuccggcgaugacugcguggucaagccuaucgaugacagauuugcuaacgcccugcuugcucugaacgauauggggaaagugcggaaggacauuccccaguggcagcccagcaaaggcuggcacgauuggcaacagguuccuuucuguucucaucacuuucacgagcucaucaugaaggacggacgcaagcugguggucccgugcagaccccaggaugaacuuauuggccgggcccgcaucucccagggggcuggauggagccugagagagacggccugucucggcaaagcguaugcccaaaugugggcucugauguacuuccaucggcgcgaccugagacucgccucuaaugccauuugcuccgcugugccuguccacugggugcccacaagccggaccaccugguccauccaugcccaccaucaguggaugacaaccgaggacaugcugacaguuuggaacagaguguggauugaagauaauccuuggauggaggacaagacgcccgucaccacaugggaagaugugccuuaucuugggaaacgcgaggaccagugguguggaagccugaucggccucgcgucucgggcuaccugggcccaaaacauccugacagccauucagcagguuagaagccuuaucgggaaugaggaauuucuggauuacaugcccuccaugaagcgcuuccggaaagaggaagagucugaaggcgcuauuugguga

SEQ ID NO: 20867 - RNA, 9873 nt, Artificial Sequence
  derived and/or modified CDS sequence (opt5) from DENV-3__JN697379__SS-prME
acaagccugugccucaugaugaugcugcccgccacacuugcuuuccaccugacguccagagacggcgagccucggaugaucguggggaagaacgaacgcggaaagucucuccuguuuaagacagccagcggcauuaauauguguacacuuaucgcgauggaucugggggagaugugcgacgauaccgugacauacaaguguccccauauuaccgaaguugagcccgaagacaucgauugcugguguaaccucacauccaccugggugacguauggaaccugcaaucaggcuggcgagcacagacgggacaagcgcucuguggcccuggccccucaugucgggaugggacuggauacaagaacccagacauggaugagcgcugagggcgccuggcggcaaguggaaaaaguugagaccugggcucuccgccaccccggcuucacgauucuggcccuuuuucuggcgcauuacaucgggacaucccucacccagaagguggucaucuucauucugcuuaugcuggugacaccuucuaugaccaugagauguguuggagugggcaaccgggacuuugucgaagggcucagcggagccaccuggguggaugugguccuggagcacggcgggugcguuacaacgauggcuaagaauaaacccacccuggacaucgagcuccagaagacagaagccacccaacuggcuacacuucgcaaacuguguauugagggaaagaucaccaacauuacgacagauuccagaugcccuacccagggcgaagccauccucccggaggaacaggaccagaauuauguguguaaacacaccuacguggaucggggcugggggaacggaugcggccuguucgggaagggaagccuugucacaugcgcgaaguuucaaugucuggagucuauugagggcaaagugguucagcaugaaaaucucaaguauaccgugaucaucacaguccacacgggggaccagcaucaggugggaaacgagacccaaggcguuacagccgaaauuaccucccaggcuagcacagccgaggugauccugcccgaauacggcacccuggggcucgagugcucuccucgcacgggacuggacuucaaugagaugauucuucugaccaugaaaaacaaggcuuggaugguccacagacagugguuuuucgaucucccccugccuuggacauccggcgccaccacagaaacccccacguggaaucggaaagagcuucuggugacauuuaagaacgcccacgcuaaaaagcaagaagucgugguucucgggagccaggagggagcgaugcauaccgcccugacaggcgcuaccgaaauccagaccucugggggcacauccauuuucgccggacaccugaagugucgccucaaaauggacaagcugaaacuuaagggcaugagcuaugccaugugccugaauacguuugugcucaaaaaggaggucuccgagacccagcaugggacaauccugaucaagguggaauacaaaggagaggaugcuccguguaagauuccuuucucuaccgaagacggccaagggaaagcccacaacggaagacugaucacagcgaaccccguugugaccaagaaagaggagccugucaauauugaagcugagccgcccuucggcgaaagcaacaucgugauugggaucggcgauaaggcccuuaagaucaauugguaccggaaaggauccagcauuggcaagauguuugaggccacggcuagaggggcccgccggauggcuauccucggagacacagccugggauuucggcucugucggcgggguucugaacucccuggggaaaaugguccaucagauuuuugggagcgcguauaccgcccucuucucuggcgugagcuggaucaugaagauuggaaucggcgugcugcuuaccuggauugggcucaauuccaaaaacacaucuaugagcuuuuccugcaucgcuaucggaauuaucacccucuaccugggcgucgugguucaggccgacauggggugugugauuaauuggaagggaaaggaacugaaaugcggcagcgggaucuucgucacaaacgaggugcacacguggaccgagcaguauaaguuucaagcugauucuccuaaaagacuugccacagcgauugccggcgcuugggaaaauggaguuuguggcauccgcuccaccacacggauggagaaccuccuguggaagcagaucgccaaugaacugaacuacauucucugggagaauaacaucaaacugaccguggucgugggggacauuacgggaguucuugaacagggcaagagaacccugacaccgcagcccauggagcucaaauauagcuggaagaccugggggaaggcuaaaaucgugacagccgagacccaaaauucuuccuucauuaucgauggaccuagcacacccgaaugcccuuccgccucucgcgcuuggaacgucugggagguggaagacuacggcuuuggcguguucaccacgaacaucuggcugaagcugcgggaggucuauacacagcuuugugaccacagacucaugagcgcggccguuaaagaugaacgcgcugugcaugccgacaugggguacuggauugagucccagaagaauggaucuuggaaacuggagaaggccagccugaucgaagugaagaccugcaccuggcccaaaucccacacacucuggagcaacggcguccuggagucugauaugauuaucccgaagucccuugcugggccuauuagccagcauaaucaccggcccggauaccacacccaaacggccggcccuuggcaucuggggaaacucgaacuggacuuuaacuauugcgagggaacaaccgugguuaucucugagaauuguggcacaagaggccccucccugcgcaccacaaccgugagcgggaaacuuauccacgaauggugcugucggucuugcacgcucccuccccugagauacaugggagaggauggcuguugguaugggauggaaauucggccgaucaacgagaaagaagagaauauggucaagagccuggcguccgcuggaagcggcaagguggacaacuucaccauggggguucucugccuggccauucuuuuugaggaagugaugcgcggaaaauucggcaagaaacauaugaucgccggcguccuguucacauuugugcuccugcugucugggcagauuaccuggagagauauggcucacacacuuaucaugauuggauccaauguuagcgaccggaugggcaugggggugaccuaccuggcccucaucgcgacguucaagauccagccuuuucuggcucucggauucuuucugagaaaacuuacaucccgcgagaaccugcuccugggcgucgggcuggccauggccgcuacccuucggcugcccgaagauauugagcaaauggccaauggaaucgcucucggccugauggcccucaagcugauuacacaguucgaaaccuaucagcuuuggaccgcgcuggugucucucacauguagcaacacgaucuuuacccugacaguggccuggagaaccgcuacacugauucuugccggcaucucccugcuccccgucugccagucuagcuccaugcgcaagaccgacuggcugccuaugacgguugcugccaugggggugccgccccucccucuguucaucuuuucucuuaaagauacacugaagagacggagcuggccccugaaugagggagugauggccgucggccucguguccauucuggcuagcucucuucugcgcaacgacguuccuauggcggggccccucguggccggaggccugcucaucgcuuguuacgucauuaccgggaccuccgccgaucugacaguggagaaagccgcugacguuaccugggaagaggaagccgagcaaacaggagugagccauaaucuuaugaucacggucgacgaugacggcaccaugagaauuaaggaugacgaaacagagaacauccugaccgugcugcucaaaacagcgcugcuuaucgucucuggcauuuucccuuauuccauccccgcuacccugcucguguggcacacguggcagaagcagacccagcggagcgggguucugugggaugugccgucuccucccgagacacaaaaagccgaacucgaggaaggagucuaccgcauuaagcagcagggcaucuuugggaagacccaggugggaguuggcgugcaaaaagagggggucuuccacacaauguggcaugugaccagaggagccgugcugacacacaacggcaagcggcuugagccuaauugggcuuccguuaaaaaggaccugauuagcuacggcgggggauggcgccuguccgcccaguggcagaaaggcgaagagguccaagugaucgcgguggaacccgggaagaacccgaagaauuuucagacgaugccuggaauuuuccagaccacaaccggcgagaucggggcuaucgcccucgauuucaaacccggaaccagcggcucuccuauuaucaacagagaaggcaaggucguggggcuguauggaaauggcguugugaccaagaacgggggauacgucagcggcauugcccagacgaaugcugagcccgacgggcccaccccugagcuugaagaggaaauguuuaagaaacggaaccugacaaucauggaucuccauccgggcuccggaaagacccgcaaguaucugcccgccauugugagagaggcuaucaaacggagacuccgcacacugauccuugccccuacccggguuguggcggccgaaauggaggaggcucugaagggccugcccauuagauaccaaacgacagccaccaaaucugaacacaccgggcgcgagaucgucgaccucaugugccaugcuacauucaccaugcggcugcuuagcccugugagaguucccaauuauaaccugauuaucauggaugaagcccacuuuacagacccugccuccauugcugcgcgcggauacaucucuacccgggugggcaugggggaggccgcugccaucuucaugacggccacaccgcccggaaccgcugaugccuuuccucagagcaaugcgcccauucaggacgaagagagagacaucccugagcgcuccuggaacucuggcaaugaauggauuacagauuucgucgggaagaccgugugguuugugcccagcaucaaagcuggcaacgacauugccaauugucuccggaagaacggaaagaaagucauccagcuguccagaaagacguucgauaccgaguaucagaagacaaagcugaacgacugggauuuuguugugaccacagacauuagcgaaaugggcgccaauuucaaagcugaucgggugaucgacccgcgcagaugccucaagccugucauccuuaccgaugggcccgagcgggugauucuggccggacccaugccuguuacaguggcgucugccgcucagcgcagaggccgggucgggagaaacccccagaaggagaaugaccaguacaucuuuaugggacaaccucugaacaaugaugaagaccacgcccauuggaccgaggcuaaaaugcuccuggacaacauuaauacgccggaaggcaucauucccgcccuuuucgagccugaacgcgagaaguccgcugccaucgauggggaguaccggcugaaaggcgaaagcagaaagacauucguggagcucaugcgccggggagaccugcccguuuggcuggcgcacaaaguggccucugaaggcaucaaguauaccgauagaaaauggugcuuugacggggagcgcaacaaucagauucucgaagagaacauggaugucgagaucuggaccaaggaaggagagaagaagaaacuucggccuagauggcuggacgcucgcacauacuccgauccccuggcccucaaagaguucaaagacuuugcugccggcagaaaaagcauugcccuggaucuugugaccgagaucgggcgggucccgucccaucuggcucaccgcacaagaaaugcgcucgacaaccuggugaugcugcacacgucugaacauggaggccgggccuaucgccacgcuguugaggagcucccugaaaccauggagacacuucugcugcucggccugaugauucuucugaccgggggagccaugcuguuccugaucagcggcaaggggaucggaaagacauccauuggccugaucugugugauugccagcucugggaugcucuggauggcugaugugccccuucaguggaucgccuccgcgauuguccuggaauuuuucaugaugguucugcucaucccugagcccgagaaacagagaaccccucaagacaaucagcuggccuacguggugauuggaauccuuacgcuggcugccaucgucgcugccaacgaaaugggccuccuggagaccacaaagcgggaucugggcaugagcaaagaacccggggugguuucuccgaccagcuaucucgacguggaccuucauccugcguccgccuggacacuguacgcugucgccaccacggugauuacacccaugcugagacacaccaucgaaaauucuacagcuaacgucagccucgccgcuauugccaaucaggcggugguucugaugggacuugauaagggcuggcccaucuccaaaauggaccugggggugccucuccuggcccugggaugcuauucucaagucaacccgcucacccuugcugccgcugugcugcugcucguuacccauuacgccauuaucggccccgggcugcaggccaaggcgacacgcgaagcucagaagcggacggccgcuggaaucaugaaaaacccuaccguggauggcauuaugacaaucgaccuugaucccgucauuuacgacagcaaguuugagaaacagcugggccaagugaugcuccuggugcugugugccguucagcuccuucugaugagaaccuccugggcccugugcgagguccucacacuggcuaccgggccuaucacgacacuuugggaaggaagccccggcaaguucuggaauaccaccauugccgugucuauggcgaacaucuuucgcggguccuaucuggccggagcuggccucgccuucagcaucaugaaauccguggggacaggaaagcggggcaccggcucucagggggagacacugggagaaaaguggaaaaagaaacugaaucagcucagcagaaaggaguuugaucuuuacaaaaaguccggcauuacggaagucgaccggaccgaggcuaaagaggggcugaagcgcggagaaaucacacaccacgccguuucuagaggcagcgcgaagcugcaaugguucguggagcggaacauggugauuccugaagggcgcgucaucgaucucggauguggcagaggcgggugguccuauuacugcgccggacugaaaaaggugaccgagguucggggcuauacaaaagggggaccgggccaugaagaacccgugccuaugagcaccuacggguggaauauugucaaacuuaugucuggaaaagacguguuuuaucugcccccugagaagugugauacgcuccugugcgacaucggcgaauccagccccucuccgaccguugaggaaucccgcacaauuagagugcugaagauggucgagccuuggcucaaaaacaaucaguucuguaucaaggugcuuaaccccuacaugcccaccgugaucgagcaccuggaacggcugcagcgcaaacauggcgggaugcucgucagaaauccucugagccggaacucuacacacgagauguacuggauuagcaauggaaccggcaacaucguuuccucugugaauauggugagcagacuucugcucaaccgcuucacaaugacccaccggagacccacgauugaaaaggaugucgaccugggggcuggaacacgccaugugaaugccgagccugaaaccccgaacauggacguuaucggcgagcggauuaaaagaaucaaggaggaacacuccagcaccuggcauuaugaugacgagaaccccuacaagacaugggcuuaucacggguccuacgaagugaaagccacgggaucugcuagcuccaugaucaauggcgucgugaagcugcucaccaaaccuugggauguugugcccauggucacacagauggccaugaccgacacaaccccuuuuggccaacagcgcguguucaaggagaaaguugauacacggacccccagaccgaugccugggacgcgcaaggugauggaaauuaccgcggaguggcuguggcggacacuuggaagaaacaagcgcccccggcugugcaccagagaggaauuuaccaagaagguccgcaccaaugccgcuaugggcgccguguucacggaggaaaaccagugggacucugcuagagccgccgucgaggaugaagaguuuuggaaacucguggaccgggagcgcgaacugcauaaacuugggaaauguggaagcugcguuuauaauaugaugggcaagagagagaaaaagcugggggaguucggcaaggcgaaaggaucccgggcuaucugguacauguggcucggcgccagauaucuggaguuugaggcccugggguuccucaacgaagaucacugguuuucucgggagaauagcuacuccggaguggaaggcgaggggcugcacaaacuuggauacauucugcgcgacaucagcaaaauuccuggcggggcuauguaugccgaugacacagcuggcugggacaccagaaucacagaagaugaccuccauaacgaggagaagaucacccaacagauggaucccgaacaccggcagcuggccaaugcgauuuucaaacuuacguaccagaacaaggucgugaaggugcaacgcccuacccccaaaggaacaguuauggacaucauuucuagaaaggaucagcggggcuccggacaggugggaaccuauggccugaauacauuuaccaacauggaggcccagcucauccgccaaauggaaggggagggaguccugagcaaagcugaccuggaaaauccgcauccucucgagaagaaaauuacacaguggcuggagaccaagggcguggaaagacuuaagcggauggccaucucuggggaugacugcguugugaaacccaucgaugaccgcuucgcuaacgcccugcucgcgcugaaugauaugggcaaggucagaaaagacauuccccaguggcagccuuccaagggauggcacgauuggcaacaggugccguuuuguagccaccauuuccacgagcuuaucaugaaagacggccggaagcuggucgugcccugccgcccucaggacgaacucauugggagagcccggaucucucagggagcuggcuggucccugcgcgagacggccugucuggggaaggcuuacgcccaaauguggacacucauguauuuccauagacgggaucugagacuugcuagcaacgccauuugcuccgcgguucccgugcacugggucccuaccagccgcaccacauggucuauccaugcccaccaccaguggaugaccacagaagacaugcugacgguguggaaccggguuuggauugaggauaaucccuggauggaggacaaaaccccugugacaaccugggaagauguccccuaccucggaaagagagaggaccagugguguggcagccugaucgggcuuacaucccgcgcuaccugggcccaaaacauccugacggccauucaacaggugcggucucucaucggcaaugaagaguuucuggauuauaugccgagcaugaaaagauuccgcaaggaggaagaguccgaaggagcuauuugguga

SEQ ID NO: 20868 - RNA, 9873 nt, Artificial Sequence
  derived and/or modified CDS sequence (opt5) from DENV-3__JQ045687__SS-prME
accagccugugccucaugaugaugcugcccgccacacuugcuuuccaccugacguccagagacggagaaccucggaugaucguggggaagaacgaacgcggaaaaucucuccuguuuaagaccgccagcggcauuaauauguguacccuuaucgcgauggaucugggggaaaugugcgacgauaccgugacauacaaauguccgcucguugcugaaguggagcccgaagacauugauugcugguguaaccugaccuccacaugggugaccuauggaacgugcaaucaggccggcgagcauagacgggacaagcgcucuguggcccuggcuccucacguggggaugggacucgauaccagaacacagaccuggaugagcgccgagggcgcuuggcggcagguugaaaaaguggagacaugggcccugcgccaucccggcuucaccauccuugcgcuguuucucgcccacuacauugggacgucccugacacagaaggucgugaucuucauccuucugaugcucguuaccccuucuaugacaaugagaugugugggagucggcaaccgggacuuuguggaagggcugagcggagcuaccuggguggaugucguucuggagcauggcgggugcgugaccacaauggccaagaauaaacccacgcucgacauugagcugcagaagaccgaagcuacacagcuugccacccugcgcaaacucuguaucgagggaaagauuacaaacaucaccacggauuccagaugcccuacacagggcgaagcgauucugccggaggaacaggaccagaauuauguguguaaacacaccuacgucgaucggggcugggggaacggaugcggccuuuucgggaagggaagccuggugaccugcgccaaguuucaaugucucgagcccaucgagggcaaaguugugcaguaugaaaaucugaaguacacagucauuaucaccgugcacacaggggaccagcaucagguuggaaacgacacgcaaggcgugaccgucgagaucacaccucaggcuucuaccguggaagccguccugcccgaguauggcacacucgggcuggaaugcuccccucgcaccggacuugauuucaaugagaugauucugcucacgaugaaaaacaaggcuuggauggugcacagacagugguuuuucgaccugccccuuccguggaccagcggcgccacaaccgagacaccuaccuggaauaaaaaggaacugcucguuacguuuaaaaacgcccaugcuaagaagcaagagguggucgugcuggggucucaggaaggagcgaugcacacagcccugaccggcgcuacagagauccaaaauuccgggggcaccagcauuuucgccggacaccucaaaugucggcugaagauggauaaacuugaacugaagggcaugucuuacgccaugugccucaacaccuuuguucugaaaaaggagguguccgagacacagcaugggacgauccugauuaaggucgaauacaaaggagaggacgcucccuguaagaucccuuucagcaccgaagauggccaagggaaagcccacaacggacgccuuaucacagcgaaucccguggugaccaagaaagaggagcccguuaacauugaagcugagccuccguucggcgaauccaauaucgucauugggaucggcgacaaggcccucaagauuaacugguauaaaaagggaucuagcaucggcaaaauguuugaggccacagcuagaggggcccggagaauggcuauccugggagauaccgccugggacuucggcuccgucggcggggugcugaauagccucgggaagaugguccaucagauuuuugggucugcguacacggcccuguucuccggcgugagcuggaucaugaaaauuggaaucggcguucuucugacauggauugggcucaacucuaagaauaccagcauguccuuuucuugcaucgugauuggaaucaucacccuguaucugggcgcugucgugcaggccgauauggggugugcuauuaacuggaagggaaaagaacuuaagugcggcagcgggaucuucguuacaaaugaggugcacaccuggacagagcaguacaaauuucaagccgacucccccaagcgccucgcgacggccauugcuggcgccugggaaaacggagucuguggcauccggagcaccacaagaauggagaaucugcuguggaaacagauugcuaacgaacucaauuauauccugugggagaacaauaucaaacuuaccgugguugugggggauauuaucggaguccuggaacagggcaaacgcacacucaccccucagcccauggagcugaaguacucuuggaagacgugggggaaagccaagauugugaccgccgagacacaaaacuccagcuucaucauugacggaccuaacacccccgaaugcccgucugcuucccgggcguggaaugugugggaggucgaagacuauggcuuuggcguuuucacaaccaacaucuggcugaaacuuagagagguguacacacagagcugugaucaucgccucauguccgccgcuaucaaggacgaacgggccgugcacgccgauaugggguacuggauugagucucagaaaaauggaagcuggaagcuggagaaggcuuccuuuaucgaagucaaaaccugcacguggccuaagucucacacacuguggagcaacggcgugcucgaguccgacaugauuauccccaaaagccuggccgggccuauuucucagcauaaucacagacccggauaucauacccaaaccgcgggcccuuggcaccuugggaagcuggaacucgauuucaacuacugcgagggaacaaccguugugaucacggagaauuguggcacacgcggccccucccugcggaccacaaccgucagcgggaaacugauccacgaauggugcuguagaucuugcacacuuccgccucuccgcuauaugggagaggacggcuguugguacgggauggaaauucggcccaucaacgagaaggaagagaauauggugaagucccugguuagcgcuggaucuggcaaaguggauaacuuuaccauggggguccugugccucgccauucuguucgaggaagugaugagaggaaaguucggcaaaaagcauaugaucgccggcguucuuuuuacguucgugcugcuccugagcgggcagauuaccuggcgggacauggcucacacacugaucaugauuggauccaaugccagcgaucgcaugggcaugggggucaccuaucuugcgcugaucgcuacauuuaaaauccagcccuuccucgcccugggauuuuuccucagaaagcugaccucucgggagaaccuucugcucggcguggggcuggccauggcuacgacacugcaacuuccugaagacauugagcagauggccaauggaaucgcucugggccucaugacccugaagcucauuacacaguuugaaaccuaccagcuguggaccgcccuugugucccugacauguagcaacacgaucuucacccucacagucgcguggagaaccgccacacugauucuggcuggcguuucccuucugccgcucugccaaucuagcuccaugcgcaaaaccgauuggcugcccaugacgguggccgcuaugggggugccuccccucccucuguuuaucuucucucuuaaggacacacccaaacggagaagcuggccucugaaugagggagucauggccgugggccugguuuccauccucgccucuagccugcuucgcaacgaugugcccauggcugggccgcuggucgcgggaggccuccugauugccuguuaugugaucaccgggaccuccgcugaccucacaguugagaaggccgccgacgugaccugggaagaggaagcugagcagacaggagucagccauaaccugaugauuacgguggaugacgauggcaccaugagaaucaaagacgaugaaacagagaauauucuuaccguccugcugaagacagcccuccugaucgugucuggcaucuuuccuuacuccauucccgcgacccuucugguuuggcacacguggcagaaacagacccaacggagcggggugcucugggacgucccuucucccccggagacacagaaggcugaacuggaggaaggaguguaccgcaucaagcagcagggcauuuucgggaaaacccaaguuggagugggcguccagaaggaggggguguuucauacaauguggcacgugaccagaggagccguucucacacacaacggcaaacggcuggagccuaauugggccuccgucaagaaagaucuuaucagcuauggcgggggauggcgccugucugcucaguggcaaaagggcgaagagguccaggugauugccgucgaacccgggaagaacccuaaaaauuuccagacgaugcccggaaucuuccagaccacaaccggcgagauuggggcgaucgcucuggacuuuaagcccggaaccuccggcagcccuaucauuaacagagaaggcaaagugguugggcucuacggaaauggcguggucacaaagaacgggggauauguguccggcaucgcccaaacgaaugccgagccggaugggcccaccccugagcuggaagaggaaauguucaaaaagcggaaccuuacaaccauggaccugcaucccggcagcggaaagacacgcaaauaccucccugcuauuguuagagaggccaucaagcggcgccugagaacccucauucuggcucccacgcggguggucgccgcggaaauggaggaggcccuuaaaggccugccuaucagauaucagacaaccgcuaccaagucugaacacacagggcgcgagaucguggaucugaugugccaugccaccuuuacaaugcggcuccugagcccgguuagagugcccaauuacaaccuuauuaucauggacgaagcucacuucaccgauccugccuccauugccgcucgcggauauaucucuacgcgggucggcaugggggaggcggccgcuauuuuuaugacagccacacccccuggaacagccgaggcuuucccccagagcaaugccccgauccaggacgaggagagagacaucccugaacgcuccuggaacucuggcaaugaguggauuaccgauuuuguggggaaaacggugugguucguccccagcaucaaggcgggcaacgacauugcuaacugucugcggaagaauggcaagaagguuauccaacucuccagaaaaaccuuugauacagaauaccagaagacccgccugaacgacugggauuucguggugacaaccgacauuucugagaugggcgccaauuuuaaagccgaucgggucaucgaccccagacggugccugaagccugugauucucacagaugggcccgagcgcguuauccuugcuggaccuaugccggugaccgccgcgagcgccgcucagagacggggccgcgucgggagaaacccccagaaggaaaaugaccaauacaucuucacgggacagccucugaacaaugaugaggaccaugcccacuggacagaagcuaaaaugcugcucgacaacauuaauacccccgagggcaucauuccugcccuguucgaacccgagcgggagaaguccgcugccaucgauggggaauauagacuuaaaggcgagagccgcaagaccuuuguggaacugaugcggagaggagaccucccgguuuggcuggcgcacaaaguggccucugagggcauuaaguacacagaucgcaaauggugcuucgacggggaacggaacaaucagauccuggaggagaacauggaugucgaaaucuggaccaaggagggagaaagaaagaaacuccgcccucgguggcuugacgcuagaacauauuccgauccccuggcccugaaggaguuuaaagacuucgcugccggccgcaagagcauugcccucgaucuggugacggaaaucgggagagucccuucucaucuugcuuaccggacccgcaaugcgcuggacaaccucgugaugcugcacacauccgagcauggaggcagagccuaucggcacgcuguugaggaacugcccgagaccauggaaacacuccuucugcugggccucaugauucugcuuaccgggggagccaugcuguuucucaucagcggcaaagggauuggaaagacguccaucggccugaucugugugauugugucuagcgggaugcuguggauggccgaugucccucuccaguggaucgcuuccgccauuguucuugaguucuuuaugauggugcugcugauccccgagccggaaaagcaacgcaccccucaggacaaucagcucgcguacguggucauuggaauccugacacuugccgcuauuguggccgcuaacgagaugggccugcucgaaaccacaaaaagagaucugggcaugagcaaggagcccgggguugugucucccaccuccuaucuggacgucgaccuccacccugccagcgcguggacgcuuuacgccguggcuacaaccgucaucacaccgaugcugcggcauaccaucgaaaauucuaccgccaacgugagccuggcugccauugcuaaccaagccguugugcucaugggacuggauaaaggcuggcccaucuccaagauggaccuuggggucccucugcucgcgcugggaugcuacucucaggugaauccccugacacucacggccgcuguucuucugcuggugacccacuaugccauuaucggcccugggcuccaggcuaaagccacaagagaggcccagaagcgcaccgcggcuggaauuaugaagaaccccacagucgauggcaucaugaccaucgaccuggauccugugauuuacgacagcaaauucgagaagcaacuuggccaggugaugcugcucguucugugugccguccagcugcuccuuaugcggacguccugggcucugugcgaagcccugacacucgccaccgggccgaucaccacacugugggagggaucucccggcaaauuuuggaauaccacaauugcugugagcauggccaacaucuucagaggguccuaucuugcgggagccggccuggcuuuuagcauuaugaagucuguggggacgggacgccggggcaccggcucccagggggaaacacucggagagaaauggaagaagaaacugaaucaacugagcagaaaggaguucgaucucuacaaaaaguccggcaucaccgaggucgaccggacagaggccaaagaagggcuuaagcgcggagagaccacgcaucacgcuguuucuagaggcagcgccaaacugcagugguuuguggaacggaacauggugaucccugaggggcgcgucauugaucugggauguggcagaggcgggugguccuauuacugcgcgggacucaagaaggugaccgaaguucggggcuauacaaaagggggacccggccaugaggagccugugcccaugucuaccuacggguggaauaucgucaagcugaugagcggaaaagacguguucuaccuuccgccugaaaagugugauacacugcucugcgacauuggcgaguccagccccucucccaccguugaagagucccgcacaaucagagugcugaaaauggucgagccuuggcugaagaacaaucaguucuguauuaaggugcucaaccccuauaugccuaccgugaucgaacaccuugagcggcugcagcgcaaauacggcgggaugcuggucagaaauccgcucagccggaacucuacgcacgaaauguauuggauuuccaauggaacaggcaacaucguuagcucugugaauauggugagcagacugcuucugaaccgcuuuaccaugacccaucggagacccacaaucgagaaggaugucgaccucggggccggaacgcgccacgugaacgcugaaccugagacccccaauauggacguuauuggcgagcggaucaaaagaauuaaggaagaacacuccucuacauggcacuacgaugacgaaaacccuuauaaaaccugggccuaccacgggagcuaugaggugaaggcuacaggauccgccagcuccaugaucaauggcgucgugaagcugcugaccaaacccugggauguugugccgauggucacacaaauggcuaugaccgacacgaccccuuucggccagcagcgcguguuuaaggaaaaaguugauacacggacccccagaccuaugcccgggacacgcaaggugauggagauuaccgccgaguggcucuggcggacgcugggaagaaacaaaaagccucgccuuugcacacgggaagaguucaccaagaaagucagaacaaaugcggccaugggcgcuguguuuaccgaagagaaccaaugggacucugcccgcgcugccgucgaagaugaggaguucuggaagcugguggacagagaacgggagcuccauaaacuggggaaguguggaagcugcguuuacaauaugaugggcaaacgcgaaaagaaacuuggggaguuuggcaaggccaagggauccagagcgaucugguacauguggcugggcgcucgguaucucgaguucgaagcccugggguuucugaacgaggaucacugguucucuagagaaaauagcuacuccggaguggagggcgaagggcuccauaaacugggauauauccuucgggacauuucuaagauccccggcggggccauguacgcugaugacacggccggcugggacacccgcauuacagaggaugaccugcacaacgaggagaaaaucacccagcagauggauccggagcauagacagcucgcuaaugccauuuuuaagcugacauaucaaaacaaagucgugaaggugcagcggccuacccccaagggaacaguuauggacaucaucagccgcaaagaucagagaggcuccggacaggugggaaccuacggccuuaauacguucacaaacauggaagcgcaacugguccggcagauggagggggaaggagugcucagcaaggccgaccuggagaauccccaucugcucgagaaaaagauuacccaguggcuggaaaccaaaggcguugagcgccuuaagagaauggcuaucucuggggaugacugcguggucaagccuauugaugaccgguuugccaacgcucugcucgcccugaacgauaugggcaaagugcgcaaggacaucccgcaguggcaacccuccaaaggauggcacgauuggcagcaggucccuuucuguagccaucacuuccaugaacuuauuaugaaggacggcagaaaacuggugguucccugccggccucaggacgagcucaucgggcgcgcgagaaucucucaaggagccggcuggucccugaaggaaacagcuugucuggggaaggccuaugcucagauguggagccucauguacuuucaccggcgcgaucugagacuugccucuaaugcuauuugcuccgccgugcccguccacuggaucccuaccagccggacaacgugguccauucaugcgcaccaucaguggaugaccacagaggacaugcugaccguguggaacagaguuuggaucgaggauaaucccuggauggaagacaaaacaccggugaccacgugggaggaugucccuuaccucggaaagcgcgaagaccaaugguguggcagccugauugggcuuaccucucgggccacaugggcucagaacauccugaccgccauucaacaggugagaagccucaucggcgaugaggaguuccuggacuauaugcccuccaugaaacgcuuucggaaggaagaggaaucugagggagccaucugguga

SEQ ID NO: 20869 - RNA, 9873 nt, Artificial Sequence
  derived and/or modified CDS sequence (opt5) from DENV-3__JQ045689__SS-prME
accagccugugccucaugaugaugcugcccgccacacuugcuuuccaccugacgucccgggacggcgaaccucggaugaucguggggaagaacgaacgcggaaagucucuccuguuuaagaccgccagcggcauuaauauguguacacuuaucgcgauggaucugggggagaugugcgacgauaccgucacauacaaguguccgcucauugcugaaguugagcccgaagacaucgauugcugguguaaccugaccuccacaugggugaccuauggaacgugcaaucaggccggcgagcacagacgggacaagcgcucuguggcccuggcuccucacgucgggaugggacucgauaccagaacacagaccuggaugagcgccgagggcgcuuggcggcaguucgaaaaaguggagacaugggcccugcgccaucccggcuuuaccauucuugcgcuguuccucgcccacuacaucgggacgucccugacacagaagguugugaucuuuauucuucugaugcucgucaccccuucuaugacaaugagaugugugggaguuggcaaccgggacuucguggaagggcugagcggagcuaccugggucgauguggugcuggagcauggcgggugcgucaccacaauggccaagaauaaacccacgcucgacaucgagcugcagaagaccgaagcuacacaacuugccacccugcgcaaacucuguauugagggaaagaucacaaacauuaccacggauuccagaugcccuacacagggcgaagcgauccugccggaggaacaggaccagaauuauguuuguaaacacaccuacguggaucggggcugggggaacggaugcggccuuuuugggaagggaagccuggugaccugcgccaaguuccaaugucucgagcccauugagggcaaagucgugcaguaugaaaaucugaaguacacaguuaucaucaccgugcacacaggggaccagcaucaggucggaaacgacacgcaaggcgugaccguugagauuacaccucaggcuucuaccguggaagccguccugcccgaguauggcacacucgggcuggaaugcuccccucgcaccggacuugauuuuaaugagaugauccugcucacgaugaaaaacaaggcuuggauggugcacagacagugguucuuugaccugccccuuccguggaccagcggcgccacaaccgagacaccuaccuggaaucggaaagaacugcucgucacguucaagaacgcccaugcuaaaaagcaagaggugguugugcuggggucucaggaaggagcgaugcacacagcccugaccggcgcuacagagauucaaaauuccgggggcaccagcaucuuugccggacaccucaagugucgccugaaaauggauaaacuugaacugaaaggcaugucuuacgccaugugccucaacaccuucguccugaagaaagagguguccgagacacagcaugggacgauucugaucaagguugaauacaagggagaggacgcucccuguaaaaucccuuucagcaccgaagauggccaagggaaggcccacaacggaagacuuauuacagcgaaucccguggucaccaaaaaggaggagcccgugaacaucgaagcugagccuccguuuggcgaauccaauauugugaucgggauuggcgacaaagcccucaagaucaacugguauaagaaaggaucuagcaucggcaagauguucgaggccacagcuagaggggccagacgcauggcuauucugggagauaccgccugggacuuuggcuccguugggggaguccugaauagccucggcaaaauggugcaucagaucuucgggucugcguacacggcccuguuuuccggcgugagcuggauuaugaagaucggaauuggcguccuucugacauggaucgggcucaacucuaaaaauaccagcauguccuucucuugcauugugaucggaaucauuacccuguaucugggcgcuguugugcaggccgauauggggugugcuaucaacuggaagggaaaggaacuuaaaugcggcagcgggauuuuugucacaaaugaggugcacaccuggacagagcaguacaaguuccaagccgacucccccaaacggcucgcgacggccaucgcuggcgccugggaaaacggaguuuguggcauuagaagcaccacacgcauggagaaucugcuguggaagcagaucgcuaacgaacucaauuauauccugugggagaacaauauuaaacuuaccguggucgugggggauaucauuggaguucuggaacagggcaagcggacacucaccccucagcccauggagcugaaauacucuuggaagacgugggggaaggccaaaaucgugaccgccgagacacaaaacuccagcuuuauuaucgacggaccuaacacccccgaaugcccgucugcuuccagagcguggaaugucugggagguggaagacuauggcuucggcguguuuacaaccaacaucuggcugaaacuucgcgaggucuacacacagagcugugaucaucggcucauguccgccgcuauuaaagacgaaagagccguucacgccgauaugggguacuggaucgagucucagaagaauggaagcuggaaacuggagaaggcuuccuucauugaagugaagaccugcacguggccuaaaucucacacacuguggagcaacggcgugcucgaguccgacaugaucauucccaagagccuggccgggccuaucucucagcauaaucaccgccccggauaucauacccaaaccgcgggcccuuggcaccuugggaaacuggaacucgauuuuaacuacugcgagggaacaaccgucgugaucacggagaauuguggcacacggggccccucccugagaaccacaaccguuagcgggaagcugauucacgaauggugcugucgcucuugcacacuuccgccucuccgguauaugggagaggacggcuguugguacgggauggaaaucagacccauuaacgagaaagaagagaauauggugaagucccuggucagcgcuggaucuggcaagguggauaacuucaccauggggguucugugccucgccauccuguucgaggaagugaugcggggaaaauuuggcaagaaacauaugauugccggcguccuuuucacguuugugcugcuccugagcgggcagaucaccuggcgcgacauggcucacacacugauuaugaucggauccaaugccagcgauagaaugggcauggggguuaccuaucuugcgcugaucgcuacauucaagauucagcccuuucucgcccugggauucuuucuccggaaacugaccucuagagagaaccuucugcucggcguggggcuggccauggcuacgacacugcaacuuccugaagacaucgagcagauggccaauggaauugcucugggccucaugacccugaagcucaucacacaguucgaaaccuaccagcuguggaccgcccuugucucccugacauguagcaacacgauuuuuacccucacaguggcguggcgcaccgccacacugauccuggcuggcgugucccuucugccgcucugccaaucuagcuccaugcggaagaccgauuggcugcccaugacggucgccgcuauggggguuccuccccucccucuguucaucuuuucucuuaaagacacacccaagagacgcagcuggccucugaaugagggagugauggccgugggccuggucuccauucucgccucuagccugcuuagaaacgaugugcccauggcugggccgcugguugcgggaggccuccugaucgccuguuaugugauuaccgggaccuccgcugaccucacagucgagaaagccgccgacgugaccugggaagaggaagcugagcagacaggaguuagccauaaccugaugaucacgguggaugacgauggcaccaugcggauuaaggacgaugaaacagagaauauccuuaccguccugcugaaaacagcccuccugaucgugucuggcauuuucccuuacuccauccccgcgacccuucuggucuggcacacguggcagaagcagacccaacgcagcggggugcucugggacguuccuucucccccggagacacagaaagcugaacuggaggaaggaguguacagaauuaagcagcagggcaucuuugggaagacccaagucggagugggcguucagaaagaggggguguuccauacaauguggcacgucacccggggagccgugcucacacacaacggcaagcgccuggagccuaauugggccuccgugaaaaaggaucuuauuagcuauggcgggggauggagacugucugcucaguggcaaaaaggcgaagagguucaggucaucgccguggaacccgggaagaacccuaagaauuuccagacgaugcccggaauuuuucagaccacaaccggcgagaucggggcgaucgcucuggacuucaaacccggaaccuccggcagcccuauuaucaaccgggaaggcaagguggucgggcucuacggaaauggcgugguuaccaagaacgggggauauguguccggcauugcccaaacgaaugccgagccggaugggcccaccccugagcuggaagaggaaauguuuaagaaacgcaaccuuacaaucauggaccugcaucccggcagcggaaagaccagaaaguaccucccugcuauuguccgggaggccaucaaacgcagacugcggacacucauccuggcucccaccagagugguugccgcggaaauggaggaggcccuuaagggccugccuauucgcuaucagacgacagcuaccaaaucugaacacaccgggcgggagaucguggaucugaugugccaugccacauucaccaugagacuccugagcccgguccgcgugcccaauuacaaccuuauuaucauggacgaagcucacuuuacagauccugccuccauugccgcucggggauauaucucuaccagaguuggcaugggggaggcggccgcuaucuucaugacggccacacccccuggaaccgccgaggcuuuuccccagagcaaugccccgauucaggacgaggagcgcgacaucccugaacgguccuggaacucuggcaaugaguggauuacagauuucguggggaagaccgucugguuugugcccagcaucaaagcgggcaacgacauugcuaacugucugagaaagaauggaaagaaagugauccaacucucccgcaagacguucgauaccgaauaccagaaaacacggcugaacgacugggauuuugucguuaccacagacauuucugagaugggcgccaauuucaaggccgauagagugaucgacccccggcgcugccugaaaccugugauccucaccgaugggcccgagagagucauucuugcuggaccuaugccggugacagccgcgagcgccgcucagcggcgcggcagaguugggcggaacccccagaaggaaaaugaccaauacaucuucaccggacagccucugaacaaugaugaggaccaugcccacuggacggaagcuaagaugcugcucgacaacauuaauacacccgagggcaucauuccugcccuguuugaacccgagagagagaaauccgcugccaucgauggggaauaucgccuuaagggcgagagccggaaaaccuucguggaacugaugagacgcggagaccucccggucuggcuggcgcacaagguggccucugagggcaucaaauacaccgaucggaaguggugcuuugacggggaaagaaacaaucagauucuggaggagaacauggauguugaaaucuggacaaaagagggagaacgcaagaagcuccggccuagauggcuugacgcucgcaccuauuccgauccccuggcccugaaagaguucaaggacuuugcugccggcagaaaaagcauugcccucgaucuggugacagaaaucgggcgggucccuucucaucuugcucaccgcacgagaaaugcgcuggacaaccucgugaugcugcauaccuccgagcacggaggccgggccuaccgccacgcugucgaggaacugcccgagacaauggaaacccuccuucugcugggccucaugauucugcuuacagggggagccaugcuguuccucaucagcggcaaggggaucggaaaaaccuccauuggccugaucugugugauuguuucuagcgggaugcuguggauggccgaugugccucuccaguggaucgcuuccgccauugugcuugaguuuuucaugaugguccugcugauccccgagccggaaaagcaaagaacgccucaggacaaucagcucgcguauguugugauuggaauccugacccuugccgcuaucguggccgcuaacgagaugggccugcucgaaacaaccaagcgggaucugggcaugagcaaagagcccggggucgugucucccacauccuaccuggacguugaccuccauccugccagcgcguggacccuuuaugccguggcuacgacagucauuaccccgaugcugagacacacaaucgaaaauucuaccgccaacgugagccuggcugccauugcuaaccaagccgucgugcucaugggacuggauaagggcuggcccaucuccaaaauggaccuugggguuccucugcucgcgcugggaugcuacucucaggugaauccccugacccucacagccgcuguccuucugcuggugacgcauuacgccauuaucggcccugggcuccaggcuaaggccacccgcgaggcccagaaacggacagcggcuggaaucaugaagaaccccaccguugauggcauuaugacaaucgaccuggauccugugauuuaugacagcaaguuugagaaacaacuuggccaggucaugcugcucgugcugugugccgugcagcugcuccuuaugagaaccuccugggcucugugcgaagcccugacgcucgccacagggccgaucaccacccugugggagggaucucccggcaaguucuggaauacaaccauugcuguuagcauggccaacaucuuucgcggguccuaccuugcgggagccggccuggcuuucagcaucaugaaaucugucgggacaggacggagaggcacgggcucccagggggaaacccucggagagaaguggaaaaagaagcugaaucaacugagccggaaagaauuugaucucuauaagaaauccggcauuacagagguggaccgcaccgaggccaaggaagggcuuaaaagaggagagacaacccaccaugcugugucucggggcagcgccaagcugcagugguucgucgaacgcaacaugguuacgccugaggggagagugaucgaucugggauguggccggggcgggugguccuacuauugcgcgggacucaaaaaggugaccgaaguccgcggcuacacaaaaggcgggcccgggcacgaggagccugugcccaugucuaccuauggguggaauauuguuaaacugaugagcggaaaggacguguucuaccuuccgccugaaaaaugugauacacugcucugcgacaucggcgaguccagccccucucccaccgucgaagaguccagaacaauucgggugcugaagaugguugagccuuggcugaaaaacaaucaguuuuguaucaaggugcucaaccccuacaugccuaccgucauugaacaccuugagcgccugcagagaaaguauggcgggaugcuggugcggaauccgcucagcagaaacucuacgcaugaaauguacuggaucuccaauggaacaggcaacaucgugagcucugucaauaugguuagccgccugcuucugaaccgguucaccaugacccacagacgccccacaauugagaaagauguggaccucggggccggaacgcggcaugugaacgcugaaccugagacccccaauauggacgucaucggcgagagaauuaagcgcaucaaagaagaacacuccucuacauggcacuaugaugacgaaaacccuuacaagaccugggccuaucaugggagcuacgaggugaaagcuacaggauccgccagcuccaugauuaauggcguugugaagcugcugaccaagcccugggaugucgugccgaugguuacacaaauggcuaugaccgacacgaccccuuuuggccagcagcggguguucaaagaaaaggucgauacaagaacaccccgcccuaugcccgggacacggaaagugauggagaucaccgccgaguggcucuggagaacgcugggacgcaacaagaaaccucggcuuugcacaagagaagaguuuaccaagaagguucgcacaaaugcggccaugggcgcuguguucaccgaagagaaccaaugggacucugccagagcugccgucgaagaugaggaguuuuggaaacugguggaccgggaacgcgagcuccacaagcuggggaaauguggaagcugcgucuauaauaugaugggcaagagagagaagaaacuuggggaguucggcaaagccaagggaucccgggcgaucugguacauguggcugggcgcuagauaccucgaguuugaagcccugggguuccugaacgaggaucauugguuuucucgggaaaauagcuauuccggaguggagggcgaagggcuccacaagcugggauacauucuucgcgacaucucuaaaauucccggcggggccauguaugcugaugacacggccggcugggacaccagaaucacagaggaugaccugcauaacgaggaaaagauuacccagcagauggauccggagcaccggcagcucgcuaaugccaucuucaaacugacauaccaaaacaagguugugaaaguccagcgcccuacccccaagggaacagugauggacaucauuagcagaaaggaucagcggggcuccggacaggugggaaccuauggccuuaauacguuuacaaacauggaagcgcaacugguucgccagauggagggggaaggagugcucagcaaagccgaccuggagaauccccaucugcucgagaagaaaaucacccaguggcuggaaaccaagggcgucgagagacuuaaacggauggcuauuucuggggaugacugcgugguuaagccuaucgaugaccgcuucgccaacgcucugcucgcccugaacgauaugggcaaggugagaaaagacauuccgcaguggcaacccuccaagggauggcaugauuggcagcaggucccuuucuguagccaccauuuucacgaacuuaucaugaaagacggccggaagcuggugguccccugccgcccucaggacgagcucaucgggagagcgcggauuucucaaggagccggcuggucccugaaagaaacagcuugucuggggaaggccuacgcucagauguggagccucauguauuuccaccgcagagaucugcggcuugccucuaaugcuaucugcuccgccgugcccguucauuggauuccuaccagcagaacaacgugguccauccacgcgcaucaccaguggaugaccacagaggacaugcugaccguguggaaccgcgucuggauugaggauaaucccuggauggaagacaagacaccggugaccacgugggaggauaucccuuaccucggaaaacgggaagaccaaugguguggcagccugauugggcuuaccucuagagccacaugggcucagaacauccugaccgccauccagcagguucgcagccucauuggcgaugaggaguuucuggacuacaugcccuccaugaagcgguucagaaaagaagaggaaucugagggagccaucugguga

SEQ ID NO: 20870 - RNA, 9873 nt, Artificial Sequence
  derived and/or modified CDS sequence (opt5) from DENV-3__JQ045691__SS-prME
accagccugugccucaugaugaugcugcccgccacacuugcuuuccaccugacgucccgggacggagaaccucggaugaucguggggaagaaugaacgcggaaagucucuccuguuuaagaccgccagcggcauuaauauguguacacuuaucgcgauggaucugggggaaaugugcgacgauaccgugacauacaaauguccgcucauugcugaaguugagcccgaagacaucgauugcugguguaaccugaccuccacaugggugaccuauggaacgugcaaucaggccggcgagcaccggcgggacaagcgcucuguggcccuggcuccucacauugggaugggacucgauaccagaacacagaccuggaugagcgccgagggcgcuuggcggcaggucgaaaaaguggagacaugggcccugcgccaucccggcuucaccauccuugcgcuguuucucgcccacuacaucgggacgucccugacacagaagguugugauuuucauccuucugaugcucgucaccccuucuaugacaaugagaugugugggaguuggcaaccgggacuuuguggaagggcugagcggagcuaccugggucgauguggugcuggagcauggcgggugcgucaccacaauggccaagaauaaacccacgcucgacauugagcugcagaagaccgaagcuacacaacuugccacccugcgcaaacucuguaucgagggaaagauuacaaacaucaccacggauuccagaugcccuacacagggcgaagcgauucugccggaggaacaggaccagaauuauguuuguaaacacaccuacguggaucggggcugggggaacggaugcggccuuuucgggaagggaagccuggugaccugcgccaaguuucaaugucucgagcccaucgagggcaaagucgugcaguaugaaaaucugaaguacacaguuaucauuaccgugcacacaggggaccagcaucaggucggaaacgacacgcaaggcgugaccguugagaucacaccucaggcuucuaccguggaagccauucugcccgaguauggcacacucgggcuggaaugcuccccucgcaccggacuugauuucaaugagaugauccugcucacgaugaaaaacaaggcuuggaugguccacagacagugguuuuucgaccugccccuuccguggaccagcggcgccacaaccgagacaccuaccuggaaucggaaagaacugcucgugacguuuaagaacgcccaugcuaaaaagcaagaggucgugguucuggggucucaggaaggagcgaugcacacagcccugaccggcgcuacagagauucagaucuccgggggcaccagcaucuucgccggacaccucaagugucgccugaaaauggauaaacuugaacugaaaggcaugucuuacgccaugugccucaauaccuuugugcugaagaaagaggucuccgagacacagcaugggacgauucugaucaagguggaauacaagggagaggacgcucccuguaaaauuccuuucagcaccgaagauggccaagggaaggcccacaacggaagacuuaucacagcgaaccccguugugaccaaaaaggaggagcccgucaauauugaagcugagccuccguucggcgaauccaacaucgugaucgggauuggcgacaaagcccucaagaucaauugguauaagaaaggaucuagcauuggcaagauguuugaggccacagcuagaggggccagacgcauggcuauccugggagauaccgccugggacuucggcuccgucggagggguucugaacagccucggcaaaaugguccaucagauuuuugggucugcguacacggcccuguucuccggcgugagcuggaucaugaagauuggaaucggcgugcuucugacauggaucgggcucaauucuaaaaacaccagcauguccuuuucuugcauugucaucggaauuaucacccuguaucugggcgcugugguucaggccgauauggggugugcuauuaauuggaagggaaaggaacuuaaaugcggcagcgggaucuucgugacaaacgagguccacaccuggacagagcaguacaaguuucaagccgacucccccaaacggcucgcgacggccaucgcuggcgccugggaaaauggaguguguggcauuagaagcaccacacgcauggagaaccugcuguggaagcagaucgcuaaugaacucaacuauauucugugggagaauaacaucaaacuuaccguuguggucggggauauuaucggagugcuggaacagggcaagcggacacucaccccucagcccauggagcugaaauacucuuggaagacgugggggaaggccaaaaucguuaccgccgagacacaaaauuccagcuucauuaucgacggaccuaacacccccgaaugcccgucugcuuccagagcguggaacgugugggaggucgaagacuauggcuuuggcguguucacaaccaauauuuggcugaaacuucgcgagguguacacacagagcugugaucaucggcucauguccgccgcuaucaaagacgaaagagccguccacgccgauaugggguacuggauugagucucagaagaacggaagcuggaaacuggagaaggcuuccuuuaucgaaguuaagaccugcacguggccuaaaucucacacacuguggagcaauggcgugcucgaguccgacaugaucauucccaagagccuggccgggccuaucucucagcauaaccaccgccccggauaucauacccaaaccgcgggcccuuggcaccuugggaaacuggaacucgauuucaauuacugcgagggaacaaccguggucauuacggagaacuguggcacacggggccccucccugagaaccacaaccgugagcgggaagcugauccacgaauggugcugucgcucuugcacacuuccgccucuccgguauaugggagaggacggcuguugguacgggauggaaauuagacccaucaaugagaaagaagagaacaugguuaagucccuggugagcgcuggaucuggcaaggucgauaauuuuaccaugggggugcugugccucgccauucuguucgaggaaguuaugcggggaaaauucggcaagaaacauaugaucgccggcgugcuuuuuacguucguccugcuccugagcgggcagaucaccuggcgcgacauggcucacacacugauuaugaucggauccaacgccagcgauagaaugggcaugggggugaccuaucuugcgcugauugcuacauuuaagauccagcccuuccucgcccugggauuuuuccuccggaaacugaccucuagagagaaucuucugcucggcguugggcuggccauggcuacgacacugcaacuuccugaagacauugagcagauggccaacggaaucgcucugggccucaugacccugaagcucaucacacaguuugaaaccuaccagcuguggaccgcccuugugucccugacauguagcaauacgauuuucacccucacagucgcguggcgcaccgccacacugauccuggcuggcgugucccuucugccgcucugccaaucuagcuccaugcggaagaccgauuggcugcccaugacgguggccgcuaugggggucccuccccucccucuguuuauuuucucucuuaaagacacacccaagaaaagaagcuggccucugaacgagggaguuauggccgugggccugguguccauccucgccucuagccugcuucgcaaugauguccccauggcugggccgcugguggcgggaggccuccugauugccuguuauguuaucaccgggaccuccgcugaccucacaguggagaaggccgccgacgucaccugggaagaggaagcugagcagacaggagugagccauaaccugaugaucacgguugaugacgauggcaccaugagaauuaaagacgaugaaacagagaacauccuuaccgugcugcugaagacagcccuccugauugucucuggcaucuuuccuuacuccauucccgcgacccuucugguguggcacacguggcagaaacagacccaacggagcgggguccucugggacgugccuucucccccggagacacagaaggcugaacuggaggaaggaguuuaccgcaucaagcagcagggcauuuucgggaaaacccaagugggagucggcgugcagaaggaggggguuuuucauacaauguggcacgugaccagaggagccguccucacacacaauggcaaacggcuggagccuaacugggccuccgugaagaaagaucuuaucagcuauggcgggggauggcgccugucugcucaguggcaaaagggcgaagaggugcagguuaucgccgucgaacccgggaagaauccuaaaaacuuccagacgaugcccggaauuuuccagaccacaaccggcgagaucggggcgauugcucuggacuuuaagcccggaaccuccggcagcccuaucauuaauagagaaggcaaagugguggggcucuacggaaacggcgucgugacaaagaaugggggauauguuuccggcaucgcccaaacgaacgccgagccggaugggcccaccccugagcuggaagaggaaauguucaaaaagcggaaucuuacaaucauggaccugcaucccggcagcggaaagacccgcaaauaccucccugcuauugugagagaggccaucaagcggcgccugagaacacucauucuggcucccacccgggucguggccgcggaaauggaggaggcccuuaaaggccugccuaucagauaucagacgacagcuaccaagucugaacacaccgggcgcgagauuguugaucugaugugccaugccacauuuaccaugcggcuccugagcccggugagaguccccaacuacaaucuuaucaucauggacgaagcucacuucacagauccugccuccauugccgcucgcggauauaucucuacccgggugggcaugggggaggcggccgcuauuuuuaugacggccacacccccuggaaccgccgaggcuuucccccagagcaacgccccgauccaggacgaggagagagacauuccugaacgcuccuggaacucuggcaacgaguggaucacagauuuuguugggaaaaccgugugguucguccccagcauuaaggcgggcaaugacaucgcuaacugucugcggaagaacgggaaaaaggugauccaacucuccagaaaaacguuugauaccgaauaccagaagacacgccugaaugacugggauuucguggucaccacagacauuucugagaugggcgccaacuuuaaagccgaucggguuaucgaccccagacggugccugaagccugugauucucaccgaugggcccgagcgcgugauccuugcuggaccuaugccggucacagccgcgagcgccgcucagagacggggccgcguggggagaaauccccagaaggaaaacgaccaauacauuuucaccggacagccucugaauaacgaugaggaccaugcccacuggacggaagcuaaaaugcugcucgacaauaucaacacacccgagggcaucauuccugcccuguucgaacccgagcgggagaaguccgcugccaucgauggggaauauagacuuaaaggcgagagccgcaagaccuuuguugaacugaugcggagaggagaccucccgguguggcuggcgcacaaagucgccucugagggcauuaaguacaccgaucgcaaauggugcuucgacggggaacggaauaaccagauccuggaggagaauauggauguggaaauuuggacaaaggagggagaaagaaagaaacuccgcccucgguggcuugacgcuagaaccuauuccgauccccuggcccugaaggaguuuaaagacuucgcugccggccgcaagagcaucgcccucgaucugguuacagaaaucgggagagugccuucucaucuugcucaccggacgcgcaacgcgcuggacaaucucgucaugcugcauaccuccgagcacggaggcagagccuaccggcacgcuguggaggaacugcccgagacaauggaaacccuccuucugcugggccucaugauucugcuuacagggggagccaugcuguuucuccugagcggcaaagggaucggaaagaccuccauuggccugaucugugucauugugucuagcgggaugcucuggauggccgauguuccucuucaguggaucgcuuccgccauugugcuggaguucuuuaugauggugcugcucauccccgagccggaaaagcaacgcacgccucaggacaaccagcuggcguaugucguuaucggcauucuuacccuggccgcuaucguggccgcuaaugagaugggccuccuggaaacaaccaaaagagaucugggcaugagcaaggagcccgggguggucucucccacauccuaccucgacguggaccuucauccugccagcgcguggacccuguaugccguugcuacgacagugauuaccccgaugcugcggcacacaaucgaaaacucuaccgccaaugucagccucgcugccauugcuaaccaagccgugguccugaugggacuugauaaaggcuggcccaucuccaagauggaccugggggugccucuccuggcgcugggaugcuacucucagguuaacccccucacccuuacagccgcugugcugcugcucgucacgcauuacgccaucauuggcccugggcugcaggcuaaagccaccagagaggcccagaagcgcacagcggcuggaaucaugaagaaucccaccguggauggcauuaugacaaucgaccuugauccuguuauuuaugacagcaaauucgagaagcaacugggccaggugaugcuccugguccugugugccgugcagcuccuucugaugcggaccuccugggcucugugcgaagcccucacgcuggccacagggccgaucaccacccuuugggagggaucucccggcaaauuuuggaacacaaccaucgcugugagcauggccaauauuuucagaggguccuaccuggcgggagccggccucgcuuuuagcaucaugaagucuguugggacaggacgccggggcacgggcucccagggggaaacccugggagagaaauggaagaagaaacugaaccaacucagcagaaaggaguucgaucuuuauaaaaaguccggcauuacagaggucgaccggaccgaggccaaagaagggcugaagcgcggagagacaacccaccaugcugugucuagaggcagcgccaaacugcagugguuuguggaacggaauauggucaucccugaggggcgcguuauugaucucggauguggcagaggcgggugguccuacuauugcgcgggacugaagaaggugacggaagugcggggcuacaccaaagggggacccggccacgaggagccuguccccaugucuacauauggguggaaccuugugaagcugaugagcggaaaagacguuuucuaccucccgccugaaaagugugauacccugcugugcgacaucggcgaguccagccccucuuccacaguggaagagagccgcaccauuagaguccucaaaaugguggagcccuggcuuaagaauaaccaguucuguaucaagguucugaauccuuacaugcccacagugaucgaacaccuggagcggcuccagcgcaaauauggcgggaugcuggucagaaacccucuuucuagaaauuccacccaugaaauguacuggauuagcaacggaacgggcaauaucgugucuagcgugaacauggucuccagacugcuccugaaucgcuuuacaaugacccaccggagaccgaccauugagaaggauguugaccugggggccggaacacgccaugugaacgcugaacccgagacgccuaacauggacgugaucggcgagcggauuaaaagaaucaaggaagaacacucuagcaccuggcacuaugaugacgaaaaucccuacaaaacaugggccuaucauggguccuacgaggucaaggcuaccggaagcgccuccucuaugaucaacggcgugguuaagcuccugacaaaaccuugggaugugguccccauggugacccaaauggcuaugacagacaccacgccguucggccagcagcgcguuuuuaaggaaaaaguggauacccggacaccuagagccaugcccgggacccgcaaggucauggagauuacagcggaguggcuuuggcggacccugggaagaaauaaaaagccucgccucugcacgcgggaagaguucacaaagaaagugagaaccaacgccgcuaugggcgccguuuuuacagaagagaaucaaugggacagcgcucgcgccgccguggaagaugaggaguucuggaagcuggucgacagagaacgggagcuucacaaacuggggaaguguggauccugcguguauaacaugaugggcaaacgcgaaaagaaacucggggaguuuggcaaggcgaagggaucuagagcuaucugguacauguggcugggcgcccgguaccuggaguucgaagcccucggguuucugaaugaggaucauugguucagcagagaaaacuccuauucuggagucgagggcgaagggcuucacaaacugggauacauucuccgggacaucagcaagauucccggcggggcuauguaugccgaugacaccgcuggcugggacacgcgcaucaccgaggaugaccugcauaaugaggagaagaucacacagcagauggauccugagcacagacagcuugccaacgcgauuuuuaagcugaccuaccaaaauaaagugguuaaggugcagcggcccacaccgaagggaaccgucauggacaucauuucccgcaaagaucagagaggcagcggacaggugggaacauauggccucaacaccuucacgaauauggaagcccaacuggugcggcagauggagggggaaggaguucugucuaaggcugaccucgagaacucccaucugcuugagaaaaagaucacacaguggcuggaaaccaaaggcguggagcgccucaagagaauggccauuagcggggaugacugcgucgugaagccuaucgaugaccgguuugcuaaugcccugcuugcgcugaacgauaugggcaaaguucgcaaggacaucccccaguggcaacccucuaaaggauggcaugauuggcaacaggugccuuucuguucccaccauuuccacgaacucauuaugaaggacggcagaaaacuggucgugccgugccggccccaggacgagcugaucgggcgcgccagaauuagccaaggagcuggcuggucucucaaggaaaccgccugucuggggaaggcuuacgcccagauguggucccuuauguauuuucaccggcgcgaucugagacucgcuagcaacgccaucugcuccgcggucccugugcauuggauucccacaagccggaccacauggucuauccacgcccaucaccaguggaugacgaccgaggacaugcugacaguuuggaauagaguguggauugaggauaacccuuggauggaagacaaaacccccgucacaaccugggaggaugugccuuaccuuggaaagcgcgaagaccaaugguguggcagccugaucgggcucacgucccgggcuaccugggcccagaauauccugacagccauucagcagguuagaucucugaucggcgaugaggaguuccucgacuacaugcccagcaugaaacgcuuucggaaggaagaggaauccgagggagcuauuugguga

SEQ ID NO: 20871 - RNA, 9873 nt, Artificial Sequence
  derived and/or modified CDS sequence (opt5) from DENV-3__JQ045692__SS-prME
accagccugugccucaugaugaugcugcccgccacacuugcuuuccaccugacgucccgggacggcgaaccucggaugaucguggggaagaaugaacgcggaaagucucuccuguuuaagaccgccagcggcauuaauauguguacacuuaucgcgauggaucugggggagaugugcgacgauaccgucacauacaaguguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacagaccuggaugagcgccgagggcgcuuggcggcaggucgaaaagguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaagcccacgcucgacaucgagcugcagaagaccgaagcuacacaacuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggugaccugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccauccugcccgaguauggcacacucgggcuggaaugcuccccucgcaccggacuugauuucaaugagaugauucugcucacgaugaaaaacaaggcuuggauggugcacagacagugguuuuucgaccugccccuuccguggaccagcggcgccacaaccgagacaccuaccuggaaucggaaagaacugcucgucacguuuaagaacgcccaugcuaaaaagcaagaggugguugugcuggggucucaggaaggagcgaugcacacagcccugaccggcgcuacagagauccagauuuccgggggcaccagcaucuucgccggacaccucaagugucgccugaaaauggauaaacuugaacugaaaggcaugucuuacgccaugugccucaauaccuuuguccugaagaaagagguguccgagacacagcaugggacgauccugauuaagguugaauacaagggagaggacgcucccuguaaaaucccuuucagcaccgaagauggccaagggaaggcccacaacggaagacuuauuacagcgaaccccguggucaccaaaaaggaggagcccgugaauaucgaagcugagccuccguucggcgaauccaacauugugaucgggaucggcgacaaagcccucaagauuaauugguauaagaaaggaucuagcaucggcaagauguuugaggccacagcuagaggggccagacgcauggcuauucugggagauaccgccugggacuucggcuccguugggggaguccugaacagccucggcaaaauggugcaucagaucuuugggucugcguacacggcccuguucuccggcgugagcuggauuaugaagaucggaauuggcguccuucugacauggaucgggcucaauucuaaaaacaccagcauguccuuuucuugcaucgugauuggaaucauuacccuguaucugggcgcuguugugcaggccgauauggggugugcuaucaauuggaagggaaaggaacuuaaaugcggcagcgggauuuucgucacaaacgaggugcacaccuggacagagcaguacaaguuucaagccgacucccccaaacggcucgcgacggccaucgcuggcgccugggaaaauggaguuuguggcaucagaagcaccacacgcauggagaaccugcuguggaagcagauugcuaaugaacucaacuauauccugugggagaauaacauuaaacuuaccguggucgugggggauaucauuggaguucuggaacagggcaagcggacacucaccccucagcccauggagcugaaauacucuuggaagacgugggggaaggccaaaaucgugaccgccgagacacaaaauuccagcuucaucauugacggaccuaacacccccgaaugcccgucugcuuccagagcguggaacgucugggagguggaagacuauggcuuuggcguguucacaaccaauaucuggcugaaacuucgcgaggucuacacacagagcugugaucaucggcucauguccgccgcuauuaaagacgaaagagccguucacgccgauaugggguacuggaucgagucucagaagaacggaagcuggaaacuggagaaggcuuccuuuauugaagugaagaccugcacguggccuaaaucucacacacuguggagcaauggcgugcucgaguccgacaugaucauccccaagagccuggccgggccuauuucucagcauaaccaccgccccggauaucauacccaaaccgcgggcccuuggcaccuugggaaacuggaacucgauuucaauuacugcgagggaacaaccgucgugaucacggagaacuguggcacacggggccccucccugagaaccacaaccguuagcgggaagcugauucacgaauggugcugucgcucuugcacacuuccgccucuccgguauaugggagaggacggcuguugguacgggauggaaaucagacccauuaaugagaaagaagagaacauggugaagucccuggucagcgcuggaucuggcaagguggauaauuuuaccauggggguucugugccucgccauccuguucgaggaagugaugcggggaaaauucggcaagaaacauaugauugccggcguccuuuuuacguucgugcugcuccugagcgggcagaucaccuggcgcgacauggcucacacacugaucaugauuggauccaacgccagcgauagaaugggcauggggguuaccuaucuugcgcugaucgcuacauuuaagauucagcccuuccucgcccugggauuuuuccuccggaaacugaccucuagagagaaucuucugcucggcguggggcuggccauggcuacgacacugcaacuuccugaagacaucgagcagauggccaacggaauugcucugggccucaugacccugaagcucaucacacaguuugaaaccuaccagcuguggaccgcccuugucucccugacauguagcaauacgaucuucacccucacaguggcguggcgcaccgccacacugauucuggcuggcgugucccuucugccgcucugccaaucuagcuccaugcggaagaccgauuggcugcccaugacggucgccgcuauggggguuccuccccucccucuguuuaucuucucucuuaaagacacacccaagagacgcagcuggccucugaacgagggagugauggccgugggccuggucuccauucucgccucuagccugcuuagaaaugaugugcccauggcugggccgcugguugcgggaggccuccugaucgccuguuaugugauuaccgggaccuccgcugaccucacagucgagaaagccgccgacgugaccugggaagaggaagcugagcagacaggaguuagccauaaccugaugaucacgguggaugacgauggcaccaugcggaucaaggacgaugaaacagagaacauucuuaccguccugcugaaaacagcccuccugaucgugucuggcauuuuuccuuacuccauccccgcgacccuucuggucuggcacacguggcagaagcagacccaacgcagcggggugcucugggacguuccuucucccccggaggcucagaaagccgaacuggaggaaggaguguacagaauuaagcagcagggcaucuucgggaagacacaagucggagugggcguucagaaagaggggguguuucauaccauguggcacgucacacggggagccgugcucacccacaauggcaagcgccuggagccuaacugggcuuccgugaaaaaggaucuuauuagcuauggcgggggauggagacugucugcccaguggcaaaaaggcgaagagguucaggucaucgcgguggaacccgggaagaauccuaagaacuuccagacaaugcccggaaucuuccagacgaccacaggcgagauuggggcuaucgcccuggacuuuaaacccggaaccuccggcagcccuauuaucaaucgggaaggcaagguggucgggcucuacggaaacggcgugguuaccaaaaaugggggauauguguccggcauugcccaaacaaacgcugagccggaugggcccacgccugagcuggaagaggaaauguucaagaaacgcaaucuuaccaucauggaccugcaucccggcagcggaaagacaagaaaguaccucccugccaucguccgggaggcuauuaaacgcagacugcggacccucauccuggcccccacaagagugguugcggccgaaauggaggaggcucuuaagggccugccuauucgcuaucagaccacggccacaaaaucugaacacaccgggcgggagaucguggaucugaugugccaugcuaccuuuacaaugagacuccugagcccgguccgcgugcccaacuacaaucuuauuaucauggacgaagcccacuucaccgauccugccuccaucgcugcgcggggauauauuucuacaagaguuggcaugggggaggccgcugccaucuuuaugaccgccacgcccccuggaacagcugaagccuucccccagagcaacgcgccgauucaggacgaggagcgcgacaucccugaacgguccuggaacucuggcaacgaguggauuaccgauuuuguggggaagacagucugguucgugcccagcaucaaagcuggcaaugacauugccaacugucugagaaagaacggaaagaaagugauccaacucucccgcaagaccuuugauacggaauaccagaaaacccggcugaaugacugggauuucgucguuacaaccgacaucucugagaugggcgccaacuuuaaggcugauagagugauugacccccggcgcugccugaaaccugugauccucacagaugggcccgagagagucauucuugccggaccuaugccggugaccgcggccagcgcugcccagcggcgcggcagaguugggcggaauccccagaaggaaaacgaccaauacaucuucacaggacagccucugaauaacgaugaggaccaugcucacuggaccgaagccaagaugcugcucgacaauauuaacacgcccgagggcaucaucccugcucuguucgaacccgagagagagaaauccgccgcgauugauggggaauaucgccuuaagggcgagagccggaaaacauuuguggaacugaugagacgcggagaccucccggucuggcuggcccacaagguggcuucugagggcaucaaauacaccgaucggaaguggugcuucgacggggaaagaaauaaccagauucuggaggagaauauggauguugaaaucuggaccaaagagggagaacgcaagaagcuccggccuagauggcuugacgcccgcacauauuccgauccccuggcucugaaagaguuuaaggacuucgccgccggcagaaaaagcauugcucucgaucuggugaccgaaaucgggcgggucccuucucaucuugcgcaccgcacaagaaacgcccuggacaaucucgugaugcugcauacguccgagcacggaggccgggcuuaccgccacgccgucgaggaacugcccgagaccauggaaacauuucuccuucugggccugaugauccuccugaccgggggagccaugcuuuuccugcucagcggcaaggggauuggaaaaacauccaucggccugauuugugugaucguuucuagcgggaugcuguggauggcugaugugccucuccaguggauugccuccgcgaucgugcuugaguuuuucaugaugguccugcugauucccgagccggaaaagcaaagaaccccucaggacaaccagcucgccuauguugugaucggaauccugacgcuugcugccauuguggcugccaaugagaugggccugcucgaaaccacaaagcgggaucugggcaugagcaaagagcccggggucgugucucccaccuccuaccuggacguugaccuccauccugcgagcgccuggacacuuuaugcuguggccaccacggucaucacaccgaugcugagacacaccauugaaaacucuacagcuaaugugagccuggccgcuaucgccaaccaagcggucgugcucaugggacuggauaagggcuggcccauuuccaaaauggaccuugggguuccucugcucgcccugggaugcuacucucaggugaacccccugacccucaccgcugccguccuucugcuggugacacauuacgcuaucaucggcccugggcuccaggccaaggccacgcgcgaggcgcagaaacggaccgcugccggaauuaugaagaaucccacaguugauggcaucaugaccauugaccuggauccugugaucuaugacagcaaguuugagaaacaacuuggccaggucaugcugcucgugcugugugcugugcagcugcuccuuaugagaacauccugggcccugugcgaagcccugacccucgcuacggggccgauuacaacccugugggagggaucucccggcaaguucuggaacaccacaaucgccguuagcauggcgaauaucuuucgcggguccuaccuugccggagcuggccuggccuucagcauuaugaaaucugucgggaccggacggagaggcacaggcucccagggggaaacgcucggagagaaguggaaaaagaagcugaaccaacugagccggaaagaauuugaucucuauaagaaauccggcaucaccgagguggaccgcacagaggcuaaggaagggcuuaaaagaggagagaccacacaccaugccgugucucggggcagcgcgaagcugcagugguucgucgaacgcaauaugguuauuccugaggggagagugaucgaucugggauguggccggggcgggugguccuacuauugcgccggacucaaaaaggugaccgaaguccgcggcuacacgaaaggcgggcccgggcacgaggagccugugcccaugucuaccuauggguggaaccugguuaaacuuaugagcggaaaggacguguucuaccugccgccugaaaaaugugauacacuccugugcgacauuggcgaguccagccccucuuccaccgucgaagagagcagaacaauccgggugcugaagaugguugagcccuggcucaaaaauaaccaguuuuguauuaaggugcuuaauccuuacaugcccaccgucaucgaacaccuggagcgccugcagagaaaguauggcgggaugcucgugcggaacccucugucuagaaauuccacacaugaaauguacuggaucagcaacggaaccggcaauauugugucuagcgucaacaugguuucccgccuucugcucaaucgguucacgaugacacacagacgcccgaccaucgagaaagauguggaccugggggcuggaacccggcaugugaacgccgaacccgagacaccuaacauggacgucauuggcgagagaaucaagcgcauuaaagaggaacacucuagcacguggcacuaugaugacgaaaaucccuacaagaccugggcuuaucauggguccuacgaggugaaagccacaggaagcgcuuccucuaugaucaacggcguugugaagcugcucaccaagccuugggaugucgugcccaugguuacacaaauggccaugaccgacacaaccccguuuggccagcagcggguguucaaagaaaaggucgauacgagaaccccucgcgcgaugcccgggacacggaaagugauggagaucaccgccgaguggcuguggagaacacuuggacgcaauaagaaaccucggcugugcaccagagaagaguuuacgaagaagguucgcacaaacgcugccaugggcgcuguguucaccgaagagaaucaaugggacagcgccagagccgcggucgaagaugaggaguuuuggaaacucguggaccgggaacgcgagcugcacaaacuugggaaauguggauccugcgucuauaacaugaugggcaagagagagaagaagcugggggaguucggcaaagcuaagggaucucgggccauuugguacauguggcucggcgccagauaccuggaguuugaagcucugggguuccucaaugaggaucauugguuuagccgggaaaacuccuauucuggaguggagggcgaagggcugcacaaacuuggauacauccugcgcgacauuagcaaaauccccggcggggccauguaugcugaugacacagccggcugggacaccagaauuacggaggaugaccuccauaaugaggaaaagaucacccagcagauggauccugagcaccggcagcuggcgaacgccaucuucaaacuuacauaccaaaauaagguugugaaaguccagcgccccaccccgaagggaacagugauggacauuaucuccagaaaggaucagcggggcagcggacaggugggaaccuauggccugaacacauuuaccaauauggaagcucaacucguucgccagauggagggggaaggagugcugucuaaagccgaccuggagaacccucaccuccuggagaagaaaauuacgcaguggcuugaaacaaagggcgucgagagacugaaacggauggcuaucuccggggaugacugcgugguuaagcccauugaugaccgcuucgccaaugcgcuccuggcccuuaacgauaugggcaaggugagaaaagacaucccccaguggcaaccuagcaagggauggcaugauuggcagcaggucccguucuguucucaccauuuucacgaacugaucaugaaagacggccggaagcucgugguccccugccgcccucaggacgagcugauugggagagcucggaucucccaaggagccggcuggagccugaaagaaaccgcuugucucgggaaggccuacgcucagauguggucucugauguauuuccaccgcagagaucuucggcuggccuccaacgcgauuugcagcgccgugcccguucauuggaucccuaccuccagaacaaccuggagcauucacgcucaucaccaguggaugacaacggaggacaugcucaccguguggaaucgcgucuggaucgaggauaaccccuggauggaagacaagacaccugugaccacaugggaggauguucccuaccugggaaaacgggaagaccaaugguguggcucucuuauugggcugaccagcagagccacgugggcccagaauauccucaccgcuauccaacaggugcgcucccugauuggcgaugaggaguuucuggacuacaugccgucuaugaagcgguucagaaaagaagaggaaagcgagggagccaucugguga

SEQ ID NO: 20872 - RNA, 9873 nt, Artificial Sequence
  derived and/or modified CDS sequence (opt5) from DENV-3__JQ045694__SS-prME
acaagccugugccucaugaugaugcugcccgccacacuugcuuuccaccugacgucccgggacggcgaaccucggaugaucguggggaagaacgaacgcggaaagucucuccuguuuaagaccgccagcggcauuaauauguguacacuuaucgcgauggaucugggggaaaugugcgacgauaccgucacauacaaguguccgcucauugcugaaguugaacccgaagacaucgauugcugguguaaccugaccuccacaugggugaccuauggaacgugcaaucaggccggcgagcaucggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaaacccacgcucgacaucgagcugcagaagaccgaagcuacacagcuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggucacaugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccucgcaccggacuugauuucaaugagaugauccugcucacgaugaaaaacaaggcuuggaugguccacagacagugguuuuucgaccugccccuuccguggaccagcggcgccacaaccgagacaccuaccuggaaucggaaagaacugcucgugacguuuaagaacgcccaugcuaaaaagcaagagguugugguccuggggucucaggaaggagcgaugcacacagcccugaccggcgcuacagagauucaaaauuccgggggcaccagcaucuucgccggacaccucaagugucgccugaaaauggauaaacuugaacugaaaggcaugucuuacgccaugugccucaacaccuuugugcugaagaaagagguuuccgagacacagcaugggacgauucugaucaagguggaauacaagggagaggacgcucccuguaaaaucccuuucagcaccgaagauggccaagggaaggcccacaacggaagacuuauuacagcgaaucccgucgugaccaaaaaggaggagcccgugaacaucgaagcugagccuccguucggcgaauccaauauuguuaucgggauuggcgacaaagcccucaagaucaacugguauaagaaaggaucuagcaucggcaagauguuugaggccacagcuagaggggccagacgcauggcuauucugggagauaccgccugggacuucggcuccgucgggggagugcugaauagccucggcaaaauggugcaucagaucuuugggucugcguacacggcccuguucuccggcgucagcuggauuaugaagaucggaauuggcgugcuucugacauggaucgggcucaacucuaaaaauaccagcauguccuuuucuugcauuguuaucggaaucauuacccuguaucugggcgcugugguccaggccgauauggggugugcuaucaacuggaagggaaaggaacuuaaaugcggcagcgggauuuucgugacaaaugagguucacaccuggacagagcaguacaaguuucaagccgacucccccaaacggcucgcgacggccaucgcuggcgccugggaaaacggaguguguggcauuagaagcaccacacgcauggagaaucugcuguggaagcagaucgcuaacgaacucaauuauauccugugggagaacaauauuaaacuuaccgucgugguuggggauaucauuggagugcuggaacagggcaagcggacacucaccccucagcccauggagcugaaauacucuuggaagacgugggggaaggccaaaaucgucaccgccgagacacaaaacuccagcuucauuaucgacggaccuaacacccccgaaugcccgucugcuuccagagcguggaaugugugggagguggaagacuauggcuuuggcgucuucacaaccaacaucuggcugaaacuucgcgagguuuacacacagagcugugaucaucggcucauguccgccgcuauuaaagacgaaagagccgugcacgccgauaugggguacuggaucgagucucagaagaauggaagcuggaaacuggagaaggcuuccuuuauugaagugaagaccugcacguggccuaaaucucacacacuguggagcaacggcguccucgaguccgacaugaucauucccaagagccuggccgggccuaucucucagcauaaucaccgccccggauaucauacccaaaccgcgggcccuuggcaccuugggaaacuggaacucgauuucaacuacugcgagggaacaaccgugguuaucacggagaauuguggcacacggggccccucccugagaaccacaaccgugagcgggaagcugauucacgaauggugcugucgcucuugcacacuuccgccucuccgguauaugggagaggacggcuguugguacgggauggaaaucagacccauuaacgagaaagaagagaauauggucaagucccuggugagcgcuggaucuggcaagguugauaacuuuaccaugggggugcugugccucgccauccuguucgaggaagucaugcggggaaaauucggcaagaaacauaugauugccggcgugcuuuuuacguucguucugcuccugagcgggcagaucaccuggcgcgacauggcucacacacugauuaugaucggauccaaugccagcgauagaaugggcaugggggugaccuaucuugcgcugaucgcuacauuuaagauucagcccuuccucgcccugggauuuuuccuccggaaacugaccucuagagagaaccuucugcucggcgucgggcuggccauggcuacgacacugcaacuuccugaagacaucgagcagauggccaauggaauugcucugggccucaugacccugaagcucaucacacaguuugaaaccuaccagcuguggaccgcccuugugucccugacauguagcaacacgauuuucacccucacaguggcguggcgcaccgccacacugauccuggcuggcgucucccuucugccgcucugccaaucuagcuccaugcggaagaccgauuggcugcccaugacgguugccgcuaugggggugccuccccucccucuguuuaucuucucucuuaaagacacacccaagagacgcagcuggccucugaaugagggagugauggccgucggccugguguccauucucgccucuagccugcuuagaaacgauguucccauggcugggccgcugguggcgggaggccuccugaucgccuguuaugucauuaccgggaccuccgcugaccucacaguggagaaagccgccgacguuaccugggaagaggaagcugagcagacaggagugagccauaaccugaugaucacggucgaugacgauggcaccaugcggauuaaggacgaugaaacagagaauauccuuaccgugcugcugaaaacagcccuccugaucgucucuggcauuuuuccuuacuccauccccgcgacccuucugguguggcacacguggcagaagcagacccaacgcagcgggguucucugggacgugccuucucccccggagacacagaaagcugaacuggaggaaggagucuacagaauuaagcagcagggcaucuucgggaagacccaagugggaguuggcgugcagaaagagggggucuuucauacaauguggcacgugacccggggagccgugcucacacacaacggcaagcgccuggagccuaauugggccuccguuaaaaaggaucuuauuagcuauggcgggggauggagacugucugcucaguggcaaaaaggcgaagagguccaggugaucgccguggaacccgggaagaacccuaagaauuuccagacgaugcccggaauuuuccagaccacaaccggcgagaucggggcgaucgcucuggacuuuaaacccggaaccuccggcagcccuauuaucaaccgggaaggcaaggucguggggcucuacggaaauggcguugugaccaagaacgggggauaugucuccggcauugcccaaacgaaugccgagccggaugggcccaccccugagcuggaagaggaaauguucaagaaacgcaaccuuacaaucauggaccugcaucccggcagcggaaagaccagaaaguaccucccugcuauugugcgggaggccaucaaacgcagacugcggacacucauccuggcucccaccagaguuguggccgcggaaauggaggaggcccuuaagggccugccuauucgcuaucagacgacagcuaccaaaucugaacacaccgggcgggagaucgucgaucugaugugccaugccacauuuaccaugagacuccugagcccgauucgcgugcccaauuacaaccuuaucauuauggacgaagcucacuucacagauccugccuccaucgccgcucggggauauaucucuaccagaguuggcaugggggaggcggccgcuauuuuuaugacggccacacccccuggaaccgccgaggcuuucccccagagcaaugccccgauccaggacgaggagcgcgacauuccugaacgguccuggaacucuggcaaugaguggaucacagauuuuguggggaagaccgucugguucgugcccagcauuaaagcgggcaacgacaucgcuaacugucugagaaagaauggaaagaaagugauucaacucucccgcaagacguuugauaccgaauaccagaaaacacggcugaacgacugggauuucgucguuaccacagacaucucugagaugggcgccaauuuuaaggccgauagagugaucgacccccggcgcugccugaaaccugugauucucaccgaugggcccgagagagucauccuugcuggaccuaugccggugacagccgcgagcgccgcucagcggcgcggcagaguugggcggaacccccagaaggaaaaugaccaauacauuuucaccggacagccucugaacaaugaugaggaccaugcccacuggacggaagcuaagaugcugcucgacaacaucaauacacccgagggcauuaucccugcccuguucgaacccgagagagagaaauccgcugccaucgauggggaauaucgccuuaagggcgagagccggaaaaccuuuguggaacugaugagacgcggagaccucccggucuggcuggcgcacaagguggccucugagggcauuaaauacaccgaucggaaguggugcuucgacggggaaagaaacaaucagauccuggaggagaacauggauguugaaauuuggacaaaagagggagaacgcaagaagcuccggccuagauggcuugacgcucgcaccuauuccgauccccuggcccugaaagaguuuaaggacuucgcugccggcagaaaaagcaucgcccucgaucuggugacagaaauugggcgggucccuucucaucuugcuuaccgcacgagaaaugcgcuggacaaccucgugaugcugcacaccuccgagcauggaggccgggccuaucgccacgcugucgaggaacugcccgagacaauggaaacccuccuucugcugggccucaugauccugcuuacagggggagccaugcuguuucucaugagcggcaaggggaucggaaaaaccuccauuggccugaucugugugauuguuucuagcgggaugcuguggauggccgaugugccucuccaguggaucgcuuccgccauugugcuugaguucuuuaugaugguccugcugauccccgagccggaaaagcaaagaacgccucaggacaaucagcucgcguacguugugauuggaauccugacccuugccgcuaucguggccgcuaacgagaugggccugcucgaaacaaccaagcgggaucugggcaugagcaaagagcccggggucgugucucccacauccuaucuggacguugaccuccacccugccagcgcguggacccuuuacgccguggcuacgacagucauuaccccgaugcugagacauacaaucgaaaauucuaccgccaacgugagccuggcugccauugcuaaccaagccgucgugcucaugggacuggauaagggcuggcccaucuccaaaauggaccuugggguuccucugcucgcgcugggaugcuacucucaggugaauccccugacccucacagccgcuguccuucugcuggugacgcacuaugccauuaucggcccugggcuccaggcuaaggccacccgcgaggcccagaaacggacagcggcuggaaucaugaagaaccccaccguugauggcauuaugacaaucgaccuggauccugugauuuacgacagcaaguucgagaaacaacuuggccaggucaugcugcucgugcugugugccgugcagcugcuccuuaugagaaccuccugggcucugugcgaagcccugacgcucgccacagggccgaucaccacccugugggagggaucucccggcaaguuuuggaauacaaccauugcuguuagcauggccaacaucuuccgcggguccuaucuugcgggagccggccuggcuuuuagcaucaugaaaucugucgggacaggacggagaggcacgggcccucagggggaaacccucggagagaaguggaaaaagaagcugaaucaacugucccggaaagaguucgaucucuacaagaaaagcggcauuacagagguggaccgcaccgaggccaaggaagggcuuaaaagaggagagacaacccaucacgcugugucccggggcucugccaagcugcagugguuugucgaacgcaacaugguuauccccgaggggagagugauugaucugggauguggccggggcggguggagcuauuacugcgcgggacucaaaaaggugacggaaguccgcggcuauaccaaaggcgggccugggcaugaggagcccgugccgauguccacauacggguggaaucugguuaaacuuaugucuggaagagacguguucuaccugccucccgaaaagugugauacccuccugugcgacaucggcgagagcucccccagcccuacagucgaagagucucggaccauucgcgugcugaaaaugguugagcccuggcucaagaacaaucaguucuguaucaaagugcuuaacccuuauaugccgacagucauugaacaccuggagagacugcagcggaaguacggcgggaugcucgugagaaauccccugucccgcaacagcacccacgaaauguauuggaucucuaauggaacgggcaacaucguguccagcgucaauaugguuucucggcuucugcucaacagauuuacaaugacccaucgccggccuaccauugagaaggauguggaccugggggccggaacaagacacgugaacgcugaacccgagacgccuaauauggacgucaucggcgagcgcauuaaacggaucaaggaagaacauagcuccaccuggcacuacgaugacgaaaaccccuauaaaacaugggccuaccacgggucuuaugaggugaaggcuaccggaagcgccuccagcaugauuaauggcguugugaaacugcucacaaagccgugggaugucgugccuaugguuacccaaauggcuaugacagacaccacgcccuucggccagcagagaguguuuaaggaaaaagucgauacccgcacaccucggcccaugccugggaccagaaaggugauggagaucacagccgaguggcuguggcgcacccuuggacggaacaaaaagcccagacugugcacgcgcgaagaguucaccaagaagguuagaaccaaugcggccaugggcgcuguguuuacagaagagaaccaaugggacuccgcccgggcugccgucgaagaugaggaguucuggaagcucguggaccgcgaaagagagcugcauaaacuugggaaguguggaucuugcgucuacaauaugaugggcaaacgggaaaagaaacugggggaguuuggcaaggccaaaggaagcagagcgaucugguacauguggcucggcgcucgguaucuggaguucgaagcccugggguuucucaacgaggaucacugguucucccgcgaaaauucuuacagcggaguggagggcgaagggcugcauaaacuuggauauauucugagagacaucuccaagauuccgggcggggccauguacgcugaugacaccgccggcugggacacgcggaucaccgaggaugaccuccacaacgaggagaagauuacacagcagauggauccugagcaucgccagcuggcuaaugccaucuuuaaacuuaccuaucaaaacaaaguugugaagguccagagacccacacccaaaggaaccgugauggacaucauuucucggaaggaucagcgcggcagcggacaggugggaacauacggccugaauaccuucacgaacauggaagcgcaacucguuagacagauggagggggaaggagugcuguccaaggccgaccuggagaauccucaccuccuggagaaaaagaucacacaguggcuugaaaccgagggcgucgaacggcugaaacgcauggcuauuagcggggaugacugcgugguuaagccgaucgaugacagauuugccaacgcucuccuggcccuuaacgauaugggcaaagugcggaaggacauuccccaguggcaaccuucuaagggauggcacgauuggcagcagguccccuucuguucccaucacuuccaugagcugaucaugaaagacggccgcaagcucguggucccuugcagaccccaggacgaacugaucgggcgggcgcgcauuagccaaggagccggcuggucucugaaagagaccgcuugucucgggaaggccuaugcucagauguggucccugauguacuuucacagacgggaucuuagacuggccagcaaugcuaucugcucugccgugccuguucacuggauucccacaucccgcaccacauggagcauccaugcgcaccaucaguggaugacgaccgaggacaugcucacaguguggaaccgggucuggauugaagauaauccguggauggaggacaaaaccccugugacaaccugggaagauguucccuaccugggaaagagagaggaccaaugguguggcucccuuaucgggcugacgagccgcgccaccugggcucagaacauucucacagccauccaacaggugcggucucugaucggcgaugaggaguuccuggacuauaugccuagcaugaagagauuucgcaaagaggaagaguccgaaggagccauuugguga

SEQ ID NO: 20873 - RNA, 9873 nt, Artificial Sequence
  derived and/or modified CDS sequence (opt5) from DENV-3__GU363549__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacgagcaaggcaaggcgcauaacgggagacugaucacagcuaaucccguugugaccaaaaaggaagagcccgucaacauugaagccgagccuccguucggagaauccaauaucgugauuggcaucggggauaacgcccugaaaaucaauugguauaagaagggcucuagcauuggaaaaauguuugaggcuacggcccggggcgcuagacgcauggccauccuuggggacacagcgugggauuucggauccgugggcgggguucucaacagccugggaaagaugguccaccagauuuuuggcucugccuacaccgcucuguucuccggggugagcugggugaugaaaaucggcauuggaguccuccugaccuggaucggccuuaauucuaagaacacaagcauguccuuuucuugcauugccaucgggaucauuacccuguaucucggagcugugguucaggccgacaugggcugugugaucaauuggaaagggaaggagcugaagugcggaagcggcauuuucgucacaaacgaagugcauacguggaccgagcaguacaaauuucaagcggauucccccaagcggcuggccacagcuaucgccggggcuugggaaaauggcguuuguggaauuagaagcaccacacgcauggagaaccuucucuggaaacagaucgccaaugaacugaacuauauccugugggagaauaacauuaagcucaccguggucgugggcgacacgaucgggguucuggagcagggaaaacggacccuuacaccucagcccauggaacugaaguacucuuggaaaaccuggggcaaggccaagauugugacagcugagacccaaaacuccagcuucaucauugaugggccuaauacacccgaaugcccgucugcguccagagccuggaacgucugggagguggaagacuauggauuuggcguguucaccacgaauaucuggcucaaacugcgcgaggucuacacacagaugugugaccaccggcugaugagcgcugccguuaaggaugagagagccgugcacgcugacaugggcuacuggaucgaaucccagaaaaacgggucuuggaagcuugagaaagccagccucauugaagugaagaccugcaccuggccuaagucccauacacuguggucuaauggaguccuggagagcgauaugaucauucccaaaucccucgcgggcccuaucagccagcacaacuaucgccccggguaccauacccaaacggcuggaccuuggcaccugggcaagcuugagcuggacuuuaauuauugcgaagggacaaccgugguuauuacagagaacuguggaacccggggccccucucucagaacaaccacgguguccggcaaacugauccacgaauggugcugucgcagcugcacccugccgccucuucgguacaugggggaggauggauguugguauggcauggaaaucagacccauuucugagaaggaggaaaauauggucaaaucccucgugagcgccgggucuggaaagguugacaacuucacaaugggcgugcugugccuggccauccucuuugaggaagucaugcgggggaaguucggaaaaaagcauaugauugcuggcguguuccugaccuuuaugcuucugcucagcggccagaucacauggcgcgauauggcccacacccugauuaugaucggguccaaugcgagcgacagaaugggaaugggcguuacguaccuggcucuuauugccacauucaaaauccagcccuuucuggcccucggguucuuucugcggaagcucaccucuagagagaaccugcuucugggagugggccucgcuauggccacaaccauccaacugccugaagauauugagcagauggcuaaugggaucgcccugggacuuauggcgcugaaacucauuacccaguucgagacauaucagcuguggacggcccucaucucccugaccuguagcaacacaauuuuuacccuuacagucgcuuggcgcaccgccacgcugauccucgcuggcgugucccugcugccggugugccaaucuagcuccaugcggaagacagacuggcuucccaugaccgucgccgccaugggcguuccuccccugccucucuucaucuuuucucugaaggauacccucaaaagacgcagcuggccccugaaugaaggggugauggcugugggacuugucuccauucuggcgucuagccugcucagaaacgacgugccuauggccggcccccugguugcugggggacuucugaucgccuguuacgugauuacaggcaccuccgccgaucucacagucgagaaggcugccgacgugacgugggaagaggaagcggagcagaccgggguuagccauaaccugaugaucacaguggacgaugacggaaccaugcggauuaaagaugacgagacagaaaauauccucaccguccugcuuaagacggcucugcugaucgugucuggcauuuucccguacuccaucccugccacccuccuggucuggcacacauggcagaaacagacccaacgcagcggcgugcuuugggauguucccucuccucccgagacacagaaggccgaacuggaggaggggguguauagaauuaaacagcagggaauccucggcaagacccaagucggggugggaguucagaaggaaggcguguuucauacaauguggcacgucacgcggggggcugugcugacccacaacggaaaacgccucgagccgaauugggccuccgugaagaaagaccugauuagcuacggcggcggguggagacuuucugcgcaguggcaaaagggagaagagguucaggucaucgcuguggaaccuggcaaaaaccccaagaauuuccagacaaugccugggaccuuucagaccacaacgggagagauuggcgccaucgcccuggauuucaagcccgggaccuccggaagccccaucauuaaccgggagggcaaaguggucggccuguaugggaauggagugguuacaaagaacggcggguacguguccggaaucgcucaaaccaaugccgaaccugacggcccgacacccgagcucgaagaggaaauguucaaaaagcgcaaccugaccauuauggaucuucauccugggagcggcaaaacgagaaaguaucugcccgcuaucguccgggaggccauuaagcgcagacuccggacacugauccucgcgccuaccagagugguugccgcugagauggaagaggcccugaaaggacuucccauccgcuaccagaccacagcuaccaagucugaacacacaggccgggagauuguggaccugaugagacaugccaccuuuacgaugcgccugcucagcccuguccgggugccgaauuauaaccugaucauuauggaugaagcccacuucacagaccccgcuuccaucgcggccagaggguacauuucuacccgcguuggaaugggcgaggcugccgccaucuuuaugacagcuaccccucccgggacggccgaugcguucccucagagcaaugcucccauccaggacgaggaacgggacauuccggagagauccuggaacucuggaaaugaauggaucaccgauuuugccggcaaaacagugugguucgucccuagcauuaaggccgggaacgacaucgcuaacugccuucgcaaaaauggcaagaaggugauucaacugucccggaaaaccuuugauacagaguaccagaagaccaaacucaacgacugggauuucguggucacaaccgacaucucugagaugggagccaauuuuaaggcggauagaguuauugacccccggcgcugucugaaacccgugauccugacggauggcccugaaagagugauccucgccgggcccaugccugucacaguggcuagcgccgcucagcggcgcggaagaguuggccggaacccgcagaaggagaaugaccaauauauuuucaccgggcagccccuuaacaaugaugaagaccaugcccacuggaccgaggcuaagaugcugcuggacaacaucaauacaccugaaggaauuauccccgcccucuuugagccugagagagaaaaauccgcggccauugauggcgaguaccgccugaagggggaaagccggaaaaccuucguggagcuuaugagacgcggcgaccugcccgucuggcucgcucacaagguggccucugaaggaaucaaauauacagaucggaaguggugcuucgacggccagagaaacaaucagauccuggaggagaacauggauguugaaauuuggacgaaagagggggaaaagaagaaacugcgcccgcgguggcucgacgcuagaaccuacuccgauccucuugcccugaaggaguuuaaagacuucgccgcuggacgcaagagcaucgcgcuggaucucgugacagaaauuggcagaguccccucucaucuggcccaccggacccgcaaugcucuugacaaccuggugaugcuccauacauccgagcacgggggaagagccuaucggcacgccgucgaggaacugccugagaccauggaaacgcugcuccuucugggccugaugauccuccugaccggcggggcuaugcuuuuucugauuagcggaaaaggcaucgggaagacauccaucggacucauuugcgugaucgccucuagcggcaugcuguggauggcggagauuccccugcaauggaucgccuccgcuauuguucucgaguucuuuaugauggugcuucugaucccugaacccgagaagcagcgcaccccgcaggauaaucaacuggccuacguggucauugggauccucacacuggcugccaucauugcggccaacgaaaugggacuucuggagaccacgaaaagagaccucggcaugagcaaggaaccuggcguugugucucccacauccuaucuggauguggaccugcaucccgcuagcgccuggacccucuacgcugucgccacaaccgugaucaccccuaugcuucggcacacaauugagaauucuacggcuaacguuagccuggccgcgaucgccaaccaggcugugguccugauggggcucgacaaaggauggccgauuuccaagauggaucugggcgugccccuucuggcccucggguguuacucucaggucaauccucugacccugacagcugccgugcuccuucugguuacccauuaugccaucaucggacccggccugcaggcgaaagcuacaagagaggcccaaaagcgcaccgcugccgggauuaugaagaacccuacgguggacggaaucauuacaaucgaucucgaccccgucauuuacgauagcaaauucgaaaagcagcugggccaggugaugcuucugguucucugcgccgugcagcugcugcucaugcggaccuccugggcucuuugugaggcccugacccuggcgacaggcccuaucaccacacucugggaagggucuccgggaaaauuuuggaauacgaccaucgccgucagcauggcuaacauuuucagaggcuccuaucuggccggggcuggacuugccuuuagcaucaugaagucugugggcacagggaaacgcggaaccggcucccaaggcgagacacugggggaaaaguggaagaaaaagcucaaucagcugagccggaaagaguucgaccuguacaagaaauccggaauuaccgagguggauagaacggaagcgaaggagggccucaaacggggggaaaccacacaccaugccguuucucgcggaagcgcuaagcuucagugguuugucgagagaaacauggugauccccgaaggccgggugauugaccuggggugcggacgcggcggcugguccuauuacugugccgggcugaagaaagucaccgagguuagaggauauacaaagggcgggccuggacacgaggaacccgugccuaugucuacccacggcuggaauaucgugaaacucaugagcgggaaggaugucuucuaccugcccccggagaaaugcgacacacuucugugugauauuggagaauccagcccuucucccaccguggaggagucccggacgauccgcguucucaagaugguggaacccuggcugaagaacaaucaguuuugcaucaaaguccugaacccuuacaugcccgcugugauugagcaucucgaaagacuucaacggaagcacggcggcaugcugguucgcaauccucugagcagaaacucuacacaugagauguauuggaucuccaaugggaccggaaacauugugagcucugucaauauggugagccggcuccugcuuaacagauucaccaugacacaccgccggccgacgaucgaaaaagacguggaucugggcgccgggaccagacacgucaacgcugagcccgagacaccuaauauggacguuauuggagaacgcauccggagaaucaaggaggaacauaacuccaccuggcacuacgacgaugagaaucccuauaaaacaugggccuaccauggcucuuaugaagugaaggcgaccgggagcgccuccagcaugauuaacggaguggucaagcuccugacaaaaccuugggacgugguucccauggugacccagauggcuaugacggauaccacaccguucggccagcaacgcgucuuuaaggagaaaguggacacccggacaccuagacccaugccuggcacccgcaagguuauggagaucacggccgaauggcuguggcggacacucgggagaaauaaacgcccccggcuguguaccagagaggaauucacaaagaaggugcgcaccaacgcugccaugggagccgucuuuacggaggaaaaucagugggauuccgcgaaagcugccguggaggacgaggaauucuggaagcuuguugauagagagcgggaacugcacaaacucggcaagugcgggucuuguguguacaacaugaugggaaaacgcgagaagaaacugggcgaguuugggaaggccaagggcagcagagcuauuugguauauguggcuuggagcccgguaccuggaauucgaggcucucggcuuucugaaugaagaccauugguucuccagagagaacucuuacagcggggucgaaggagagggccugcacaaacucggguauauccugcgggauauuuccaagaucccuggaggcgccauguacgcggacgauaccgccgggugggacacacgcaucaccgaggacgaucuucacaaugaagagaaaauuacacagcagaugaaccccgaacauagacugcucgcuaaugccaucuuuaagcugaccuaucaaaacaaaguggucaaggugcagcggccgacaccuaccggcacgguuauggacauuaucucucgcaaggaucagagaggaagcggccagguggggacauacggacuuaauaccuucaccaacauggaggcucaacugguccggcagauggaaggcgagggggugcucuccaaagccgaccuggagaacccccaccugcccgaaaagaaaauuacacaguggcucgagaccaagggaguggaacgccugaaaagaauggcgaucagcggcgaugacugcguugugaagccuaucgaugaccgguuugccaaugcucuucuggcccucaacgauauggggaagguccgcaaagacauuccgcaguggcaacccucuaagggcuggcaugauuggcagcaggugccuuucugcucccaccacuuucaugagcugaucaugaaagacggaagaaagcuuguugugcccugucggccucaggaugaacugauuggccgcgcuagaaucagccaaggggccggauggucucuccgggagacagcuugccugggcaaagccuaugcgcagauguggucccugauguacuuccaccgcagagaccuccggcuggccagcaaugcuauuuguucugccguccccgugcauugggucccuacguccagaaccacauggagcauccacgcccaucaccaguggaugaccacagaggacaugcuuaccguguggaaccgcguuuggauugaagauaaucccuggauggaggacaagacgccggugaccacaugggaaaacgucccuuaucuggggaagcgggaggaucaauggugcggaucccucaucggccugaccagcagagcuacaugggcccagaauaucucuaccgcgauucagcaggugcgcagccuuaucgggaacgaggaauuccuggacuacaugcccuccaugaaacgguuuagaaaggaggaagagucugaaggcgcuauuugguga

SEQ ID NO: 20874 - RNA, 9873 nt, Artificial Sequence
  derived and/or modified CDS sequence (opt5) from DENV-3__KJ622197__SS-prME
accagccugugccucaugaugaugcugcccgccacccuugcuuuccaccugacgagccgggacggcgaaccucggaugaucguggggaagaacgaacgcggaaagucucuccuguuuaagaccgccagcggcauuaauauguguacccuuaucgcgauggaucugggggaaaugugcgacgauaccgucacauacaaguguccgcucauugcugaaguugaacccgaagacaucgauugcugguguaaccugaccuccacaugggugaccuauggaacgugcaaucaggccggcgagcaucggcgggacaagcgcucuguggcccuggcuccucacgucgggaugggacucgauacccggacacaaaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuauggcuaugagauguguuggagugggcaaccgggacuuugucgaagggcugagcggagccacauggguggaugugguccuggagcauggcgggugcguuaccaccauggcuaagaauaaacccacacucgacaucgagcugcagaagacggaagccacccaacuugcgacacugcgcaaacucuguauugagggaaagaucaccaacauuacaaccgauuccagaugcccuacgcagggcgaagccauccugccggaggaacaggaccagaauuauguguguaaacacacauacguggaucggggcugggggaacggaugcggccuuuucgggaagggaagccuggugacaugcgcuaaguuucaaugucucgagucuauugagggcaaagugguucagcacgaaaaucugaaguauaccgugacaaucaccguccauacaggggaccagcaccaggugggaaacgacacgcaaggcguuaccgccgagaucacaccccaggcuuccaccguggaagccauucugccugaguacggcacacucgggcuggaaugcagcccccgcaccggacuugauuucaaugagaugauccugcucacgaugaaaaacaaggccuggaugguccauagacagugguuuuucgaccugccucuucccuggaccucuggcgcuauuacagagaccccgacauggaaucggaaagaacugcucgugaccuuuaagaacgcgcacgccaaaaagcaagaggucgugguucuggggucccaggaaggagcuaugcacacggcccugacaggcgccaccgagauccagaauagcgggggcacaucuauuuucgcuggacaucucaagugucgccugaaaauggauaaacuugaacugaaaggcauguccuaugccaugugccucaacaccuuugugcugaagaaagaggucagcgagacccagcacgggacaauccugaucaagguggaauacaagggagaggacgcgccuuguaaaauucccuucuccacggaagauggccaagggaaggcucauaacggaagacuuaucaccgccaauccuguugugaccaagaaggaggagcccgucaacauugaagccgagcccccuuucggcgaaucuaauaucgugauugggaucggcgacaaagcucucaagaucaacugguacaagaaaggaagcuccauuggcaagauguuugaggccaccgcuagaggggccagacgcauggcgauccugggagauacagccugggacuucggcagcgucggcgggguucucaauucucucgggaaaaugguccaccagauuuuuggguccgcuuauaccgcccuguucggcggagugagcuggaucaugaagauuggcaucggggugcuucugacguggauuggacucaacucuaaaaauacaagcauguccuuuucuugcaucgucaucggcauuaucacccuguaccuggggaccgugguucaggcugauaugggaugugugauuaacuggaagggcaaggaacuuaaaugcgggagcggcaucuucgucacaaaugaggugcauaccuggacagagcaguauaaguuucaagccgacuccccgaaacggcucgcgacggccauugcuggagccugggaaaacggcguuugugggaucagaagcaccacacgcauggagaaucugcuguggaagcagaucgcuaacgaacucaauuacauucugugggagaacaauaucaaacuuaccguggucgugggagauauuaucggcguucuggaacaggggaagcggacacucacaccccagccuauggagcugaaauauucuuggaagacguggggaaaggccaaaauugugaccgccgagauccaaaacuccagcuucaucauugacggccccaacacaccugaaugccccucugcuuccagagcguggaaugucugggagguggaagacuacggcuuugggguguucaccacaaacaucuggcugaaacuucgcgaggucuauacccagacaugugaucaccggcucaugagcgccgcuauuaaagacgaaagagccguucacgccgauaugggauacuggaucgagucccagaagaauggcucuuggaaacuggagaaggcuagcuuuauugaagugaagaccugcacguggccgaaaucccauacacuguggucuaacggggugcucgagagcgacaugaucaucccuaagucccuggccggacccauuagccagcacaaucaucgcccuggcuaccacacccaaaccgcggggcccuggcaccuuggaaaacuggaacucgauuucaacuauugcgagggcacaaccgucgugaucacggagaauuguggcacacgggggccuucucugagaaccacaaccguuuccggaaagcugauucaugaauggugcugucgcagcugcacacuucccccgcuccgguacaugggcgaggacggguguugguauggaauggaaaucagaccuauuaacgagaaagaagagaauauggugaagucucuggucuccgcuggcagcgggaagguggauaacuuuaccaugggaguucugugccucgccauccuguucgaggaagugaugcggggcaaauucggcaagaaacacaugauugccgggguccuucugacguuuaugcuccugcugucuggacagaucaccuggcgcgacauggcucauacacuuaucaugauuggcagcaaugccuccgauagaauggggaugggagugaccuaccuggcgcucaucgcuacauucaagauucagcccuuucuggcccucggcuucuuucugcggaaacuuaccagcagagagaaccugcuccuggggguuggacuggccauggcuacgacacuucaacugcccgaagacaucgagcagauggccaauggcauugcucucggccugauggcccucaagcugaucacccaguucgaaacauaucagcuuuggaccgcgcuggugucucucaccuguuccaacacaaucuuuacgcugaccgucgccuggcgcacagcuacccugauucuugccggggugagccugcucccugugugccaauccucuagcaugcggaagacagauuggcugccggucgcuguugccgccaugggagugcccccucucccccuguucaucuuuucccuuaaagacacccugaagagacgcucuuggccucugaaugagggcgugauggcugucgggcucgugagcauucuggcguccucucuucugagaaacgauguucccauggccggaccucucguggcuggcgggcugcucaucgccuguuacgucauuacgggaacaagcgccgaccugaccguggagaaagcugccgacguuaccugggaagaggaagcggagcagacaggcgugucccacaaccuuaugaucaccgucgaugacgauggcacaaugcggaucaaggacgaugaaacggagaauauucugaccgugcugcucaaaacagcucugcuuaucgucagcgggauuuuccccuauucuaucccggccacccugcucguguggcauacauggcagaagcagacccaacgcuccggaguucugugggacgugccuucucccccugagacgcagaaagccgaacucgaggaaggcgucuacagaauuaagcagcaggggaucuuuggaaagacccaagugggcguuggggugcagaaagagggagucuuccacacaauguggcacgugacccggggcgcugugcugacacauaacggcaagcgccuugagcccaauugggccuccguuaaaaaggaucugauuuccuacgggggaggcuggagacugagcgcgcaguggcaaaaaggggaagagguccaggugaucgcuguggaaccgggacggaacccuaagaauuuucagaccaugcccggcaucuuccagacaacgaccggggagauuggagccaucgcccucgacuucaagccuggcacaucuggcucccccauuaucaaccgcgaagggaaagucgugggacuguauggcaaugggguugugaccaagaacggaggcuacgucagcgggauugcucaagccaaugcugagcccgauggcccuaccccggagcuugaagaggaaauguuuaaaaagagaaaccugacaaucauggaccuccaccccggauccggcaaaacgcggaaguaucugccugccaucgugcgcgaggcgauuaagagacggcucagaacccugauccuugcccccacacgcguuguggcugccgaaauggaggaggcucugaaagggcugccuauucgguaccagaccacagccaccaagagcgaacauacgggaagagagaucgucgaucucaugugccacgccacauucaccaugcgccugcuuucucccgugcggguuccuaauuauaaccugauuaucauggacgaagcucauuuuaccgauccggcgagcaucgccgcuagaggcuacauuuccacacgcguggggaugggagaggccgccgcuaucuucaugaccgccacacccccuggcaccgcggaggcuuuuccccagucuaaugccccuauucaggacgaggagcgggacauccccgaaagaagcuggaacuccgggaaugaguggauuacggauuucgucggcaaaacagugugguuugugccgucuaucaaggccggaaacgacauugcuaacugucuccgcaaaaauggcaagaaggucauccaacugagccggaaaaccuucgauacagaauaucagaagaccaaacugaacgacugggauuuuguugugacgaccgacaucuccgagaugggggccaauuucaaggcggauagagugauugacccucggcgcugccucaaacccgucauccuuacagauggacccgagagagugauucuggccggcccuaugcccguuaccgcugccucugcugcccagcggcgcgggagagugggacggaacccucagaaggaaaaugaccaauacaucuuuacaggccagccgcugaacaaugaugaggaccacgcucacuggaccgaagccaagaugcuccuggacaacauuaauacacccgaggggaucaucccugcgcuuuucgaacccgagagagagaaaagcgccgcuauugauggcgaauaccgccugaagggagagucccggaaaaccuucgucgaacucaugagacgcggcgaccugccuguguggcuggcccauaagguugcuagcgaggggaucaaauauacggaucggaaguggugcuuugacggagaaagaaacaaucagauucucgaggagaacauggauguggaaaucuggacaaaagagggcgaacgcaagaaacuucggcccagauggcuggacgcccgcaccuacucuaauccgcuggcccucaaagaguucaaggauuuugcugcggggagaaaauccauugcccuggaccuugucaccgaaaucggacgggugccuagccaccuggcucaucgcacaagaaacgcccucgauaaucuggucaugcugcacaccucugagcacggcggccgggccuaucgccaugcuguggaggaacuccccgagacaauggaaacgcuucugcugcucgggcugaugauccuucugaccggaggcgccaugcuguuccugauuuccgggaagggaaucggcaaaacaagcauugggcugaucuguguuauuguguccucuggaaugcucuggauggcggacgugccucuucaguggaucgccagcgcuauuguccuggaguuuuucaugaugguucugcucauccccgagccugaaaagcaaagaacaccccaggauaaccagcuggccuacguggugaucggcauucuuacacuggcugccaucgucgcggccaaugagaugggccuccuggaaaccacgaagcgggaccuggggauguccaaagagccgggagugguuagcccuaccucuuaucucgauguggaccuucaccccgcuuccgccuggacacuguacgcugucgccaccacagugauuacccccaugcugagacauacgaucgaaaacagcacagcuaacgucucucucgccgcgauugccaaucaagcugugguucugaugggccuugacaagggguggccuaucagcaaaauggaucugggagugccgcuccuggcccugggcugcuauucccaggucaacccccucacccuuacagcugccgugcugcugcucguuacccacuacgccaucauugggccuggacugcaggcgaaggcuacccgcgaggcccagaaacggacagcugccggcaucaugaagaaucccacgguggacggcauuaugaccaucgaucuugacccugucauuuacgauucuaaguuugagaaacaacugggacaggugaugcuccuggugcugugugccguucagcuccuucugaugagaacaagcugggcucugugcgaagcccucacccuggcgacaggacccaucaccacgcuuugggagggcuccccugggaaguucuggaacacaaccaucgccgucucuauggcuaauauuuuucgcggaagcuaucuggccggcgcugggcucgccuucuccaucaugaaaagcgugggaaccggcaagcggggcacagggucucagggagaaacccugggcgagaaauggaagaagaaacugaaccaacucuccagacgggaauuugagcuuuacaagaaaagcgggauuacagagguggaccgcacggaagcgaaggagggacugaaaagaggcgaaaccacacaucacgccgucucccgggggucugcuaagcugcagugguucguugagcgcaauauggugaucccggaaggaagagugauugaucucggcuguggcagagggggauggagcuauuacugcgccggccugaaaaaggucaccgaggugcgcggguauacaaagggaggccccgggcacgaggaaccuguucccauguccaccuacggauggaacacggugaaacuuaugucuggcaaggacgucuuuuaucugccucccgagaaaugugauacccuccugugcgacaucggcgaaagcuccccgagcccuacaguggaggagucuagaaccauucggguucugaagaugguggaacccuggcucaaaaauaaccaguucuguaucaagguccuuaaucccuacaugccuacagugaucgagcaucuggaacgccugcagagaaagcacgggggaaugcucgugcggaacccccuguccagaaauagcacccaugagauguacuggauuucuaacggcacagggaauaucgucuccagcguuaacauggugucucgccuucugcucaaccgguucaccaugacgcacagacgcccuacaauugaaaaagauguggaccugggagcuggcacccggcacgucaaugccgagccggagacccccaacauggaugugaucggggaaagaauuaagcgcaucaaagaggaacauagcuccacauggcacuaugacgacgagaauccuuacaagacgugggcuuaucauggaucuuacgaaguuaaagccaccggcagcgcguccagcaugaucaacggcguggucaagcugcucacaaagcccugggaugugguuccuauggugacccaaauggccaugacagacaccacacccuuugggcagcagcgggucuucaaagagaagguggauaccagaacgccgcgcccuaugcccggaacccggaaaguuauggagauuacagcugaauggcuguggagaacccuuggccgcaauaagcggccuagacugugcacacgcgaggaauuuaccaaaaaggugagaacgaacgccgcuaugggggccgucuucacagaggaaaaucaaugggaguccgcccgggcggcuguggaggacgaagaguuuuggaagcucgucggacgcgaaagagagcugcacaaacuuggcaagugugggucuugcguguauaacaugaugggcaaacgggagaagaaacugggagaguucggcaaggccaaagggagcagagccaucugguacauguggcucggagcucgguaucuggaguuugaagcccugggcuuccucaaugaggaucauugguuuucccgcgaaaacucuuacagcgggguugagggagagggccugcacaaacuuggguacauucugagagacaucuccaagauucccggcggagcuauguaugccgaugacaccgcgggcugggauacacggaucaccgaagacgaucuccacaaugaggagaagaucacgcagcagauggacccugagcaucgccagcuggccaacgcuauuuucaaacuuaccuaccaaaauaaaguggucaaggugcagagacccacaccgaaagggaccgugauggacaucauuucucggaaggaucagcgcggaagcggccagguugggacauauggacugaacaccuuuacaaauauggaagcccaacucaucagacagauggagggcgagggggugcuguccaaggcugaccuggaaaacccucaccuccuggagaaaaagauuacccaguggcuugaaacgaaaggcgucgagcggcugaagcgcauggccaucagcggagaugacugcgugguuaaacccaucgaugacagauucgcgaacgcccuccuggcucuuaaugauaugggcaaggugcggaaggacauuccccaguggcaaccuucuaaaggguggcaugauuggcagcaggucccguuuuguucccaccacuuccaugaacugaucaugaaggacggacgcaaacucgugguccccugcagaccucaggaugagcugauuggccgggcccgcaucagccaaggggcuggauggucucugaaggagacagccugucucggcaaggcuuacgcccagauguggucccugauguauuuccacagacgggaccuuagacuggcgagcaacgccauuugcucugcugugcccguucauugggugccuaccucccgcaccacauggagcauccacgcccaucaccaguggaugaccacagaagauaugcucacggucuggaaucggguguggauugaggacaaccccuggauggaagacaagaccccuguuacaaccugggaggaugugcccuaccuggggaagagagaggaccaaugguguggcucccuuaucggacugacaagccgcgccaccugggcucagaauauccucacggccauucagcagguccggucucugaucggcgaugaagaguuucuggacuauaugccgagcaugaaaagauuccgcaaggaagaggaauccgagggggcgauuugguga

SEQ ID NO: 20875 - RNA, 9873 nt, Artificial Sequence
  derived and/or modified CDS sequence (opt5) from DENV-3__KJ622198__SS-prME
accagccugugccucaugaugaugcugcccgccacccuugcuuuccaccugacgagccgggacggcgaaccucggaugaucguggggaagaacgaacgcggaaaaucucuccuguuuaagaccgccagcggcauuaauauguguacccuuaucgcgauggaucugggggaaaugugcgacgauaccgucacauacaaauguccgcucauugcugaaguugaacccgaagacaucgauugcugguguaaccugaccuccacaugggugaccuauggaacgugcaaucaggccggcgagcaccggcgggacaagcgcucuguggcccuggcuccucacgucgggaugggacucgauacccggacacaaaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuauggcuaugagauguguuggagugggcaaccgggacuuugucgaagggcugagcggagccacauggguggaugugguccuggagcauggcgggugcguuaccaccauggcuaagaauaaacccacacucgacaucgagcugcagaagacggaagccacccaacuugcgacacugcgcaaacucuguauugagggaaagaucaccaacauuacaaccgauuccagaugcccuacgcagggcgaagccauccugccggaggaacaggaccagaauuauguguguaaacacacauacguggaucggggcugggggaacggaugcggccuuuucgggaagggaagccuggugacaugcgcuaaguuucaaugucucgagucuauugagggcaaagugguucagcacgaaaaucugaaguauaccgugacaaucaccguccauacaggggaccagcaccaggugggaaacgacacgcaaggcguuaccgccgagaucacaccccaggcuuccaccguggaagccauucugccugaguacggcacacucgggcuggaaugcagcccccgcaccggacuugauuucaaugagaugauccugcucacgaugaaaaacaaggccuggaugguccauagacagugguuuuucgaccugccucuucccuggaccucuggcgcuauuacagagaccccgacauggaaucggaaagaacugcucgugaccuuuaagaacgcgcacgccaaaaagcaagaggucgugguucuggggucccaggaaggagcuaugcacacggcccugacaggcgccaccgagauccagaauagcgggggcacaucuauuuucgcuggacaucucaagugucgccugaaaauggauaaacuugaacugaaaggcauguccuaugccaugugccucaacaccuuugugcugaagaaagaggucagcgagacccagcacgggacaauccugaucaagguggaauacaagggagaggacgcgccuuguaaaauucccuucuccacggaagauggccaagggaaggcucauaacggaagacuuaucaccgccaauccuguugugaccaagaaggaggagcccgucaacauugaagccgagcccccuuucggcgaaucuaauaucgugauugggaucggcgacaaagcucucaagaucaacugguacaagaaaggaagcuccauuggcaagauguuugaggccaccgcuagaggggccagacgcauggcgauccugggagauacagccugggacuucggcagcgucggcgggguucucaauucucucgggaaaaugguccaccagauuuuuggguccgcuuauaccgcccuguucggcggagugagcuggaucaugaagauuggcaucggggugcuucugacguggauuggacucaacucuaaaaauacaagcauguccuuuucuugcaucgucaucggcauuaucacccuguaccuggggaccgugguucaggcugauaugggaugugugauuaacuggaagggcaaggaacuuaaaugcgggagcggcaucuucgucacaaaugaggugcauaccuggacagagcaguauaaguuucaagccgacuccccgaaacggcucgcgacggccauugcuggagccugggaaaacggcguuugugggaucagaagcaccacacgcauggagaaucugcuguggaagcagaucgcuaacgaacucaauuacauucugugggagaacaauaucaaacuuaccguggucgugggagauauuaucggcguucuggaacaggggaagcggacacucacaccccagccuauggagcugaaauauucuuggaagacguggggaaaggccaaaauugugaccgccgagauccaaaacuccagcuucaucauugacggccccaacacaccugaaugccccucugcuuccagagcguggaaugucugggagguggaagacuacggcuuugggguguucaccacaaacaucuggcugaaacuucgcgaggucuauacccagacaugugaucaccggcucaugagcgccgcuauuaaagacgaaagagccguucacgccgauaugggauacuggaucgagucccagaagaauggcucuuggaaacuggagaaggcuagcuuuauugaagugaagaccugcacguggccgaaaucccauacacuguggucuaacggggugcucgagagcgacaugaucaucccuaagucccuggccggacccauuagccagcacaaucaucgcccuggcuaccacacccaaaccgcggggcccuggcaccuuggaaaacuggaacucgauuucaacuauugcgagggcacaaccgucgugaucacggagaauuguggcacacgggggccuucucugagaaccacaaccguuuccggaaagcugauucaugaauggugcugucgcagcugcacacuucccccgcuccgguacaugggcgaggacggguguugguauggaauggaaaucagaccuauuaacgagaaagaagagaauauggugaagucucuggucuccgcuggcagcgggaagguggauaacuuuaccaugggaguucugugccucgccauccuguucgaggaagugaugcggggcaaauucggcaagaaacacaugauugccgggguccuucugacguuuaugcuccugcugucuggacagaucaccuggcgcgacauggcucauacacuuaucaugauuggcagcaaugccuccgauagaauggggaugggagugaccuaccuggcgcucaucgcuacauucaagauucagcccuuucuggcccucggcuucuuucugcggaaacuuaccagcagagagaaccugcuccuggggguuggacuggccauggcuacgacacuucaacugcccgaagacaucgagcagauggccaauggcauugcucucggccugauggcccucaagcugaucacccaguucgaaacauaucagcuuuggaccgcgcuggugucucucaccuguuccaacacaaucuuuacgcugaccgucgccuggcgcacagcuacccugauucuugccggggugagccugcucccugugugccaauccucuagcaugcggaagacagauuggcugccggucgcuguugccgccaugggagugcccccucucccccuguucaucuuuucccuuaaagacacccugaagagacgcucuuggccucugaaugagggcgugauggcugucgggcucgugagcauucuggcguccucucuucugagaaacgauguucccauggccggaccucucguggcuggcgggcugcucaucgccuguuacgucauuacgggaacaagcgccgaccugaccguggagaaagcugccgacguuaccugggaagaggaagcggagcagacaggcgugucccacaaccuuaugaucaccgucgaugacgauggcacaaugcggaucaaggacgaugaaacggagaauauucugaccgugcugcucaaaacagcucugcuuaucgucagcgggauuuuccccuauucuaucccggccacccugcucguguggcauacauggcagaagcagacccaacgcuccggaguucugugggacgugccuucucccccugagacgcagaaagccgaacucgaggaaggcgucuacagaauuaagcagcaggggaucuuuggaaagacccaagugggcguuggggugcagaaagagggagucuuccacacaauguggcacgugacccggggcgcugugcugacacauaacggcaagcgccuugagcccaauugggccuccguuaaaaaggaucugauuuccuacgggggaggcuggagacugagcgcgcaguggcaaaaaggggaagagguccaggugaucgcuguggaaccgggacggaacccuaagaauuuucagaccaugcccggcaucuuccagacaacgaccggggagauuggagccaucgcccucgacuucaagccuggcacaucuggcucccccauuaucaaccgcgaagggaaagucgugggacuguauggcaaugggguugugaccaagaacggaggcuacgucagcgggauugcucaagccaaugcugagcccgauggcccuaccccggagcuugaagaggaaauguuuaaaaagagaaaccugacaaucauggaccuccaccccggauccggcaaaacgcggaaguaucugccugccaucgugcgcgaggcgauuaagagacggcucagaacccugauccuugcccccacacgcguuguggcugccgaaauggaggaggcucugaaagggcugccuauucgguaccagaccacagccaccaagagcgaacauacgggaagagagaucgucgaucucaugugccacgccacauucaccaugcgccugcuuucucccgugcggguuccuaauuauaaccugauuaucauggacgaagcucauuuuaccgauccggcgagcaucgccgcuagaggcuacauuuccacacgcguggggaugggagaggccgccgcuaucuucaugaccgccacacccccuggcaccgcggaggcuuuuccccagucuaaugccccuauucaggacgaggagcgggacauccccgaaagaagcuggaacuccgggaaugaguggauuacggauuucgucggcaaaacagugugguuugugccgucuaucaaggccggaaacgacauugcuaacugucuccgcaaaaauggcaagaaggucauccaacugagccggaaaaccuucgauacagaauaucagaagaccaaacugaacgacugggauuuuguugugacgaccgacaucuccgagaugggggccaauuucaaggcggauagagugauugacccucggcgcugccucaaacccgucauccuuacagauggacccgagagagugauucuggccggcccuaugcccguuaccgcugccucugcugcccagcggcgcgggagagugggacggaacccucagaaggaaaaugaccaauacaucuuuacaggccagccgcugaacaaugaugaggaccacgcucacuggaccgaagccaagaugcuccuggacaacauuaauacacccgaggggaucaucccugcgcuuuucgaacccgagagagagaaaagcgccgcuauugauggcgaauaccgccugaagggagagucccggaaaaccuucgucgaacucaugagacgcggcgaccugccuguguggcuggcccauaagguugcuagcgaggggaucaaauauacggaucggaaguggugcuuugacggagaaagaaacaaucagauucucgaggagaacauggauguggaaaucuggacaaaagagggcgaacgcaagaaacuucggcccagauggcuggacgcccgcaccuacucuaauccgcuggcccucaaagaguucaaggauuuugcugcggggagaaaauccauugcccuggaccuugucaccgaaaucggacgggugccuagccaccuggcucaucgcacaagaaacgcccucgauaaucuggucaugcugcacaccucugagcacggcggccgggccuaucgccaugcuguggaggaacuccccgagacaauggaaacgcuucugcugcucgggcugaugauccuucugaccggaggcgccaugcuguuccugauuuccgggaagggaaucggcaaaacaagcauugggcugaucuguguuauuguguccucuggaaugcucuggauggcggacgugccucuucaguggaucgccagcgcuauuguccuggaguuuuucaugaugguucugcucauccccgagccugaaaagcaaagaacaccccaggauaaccagcuggccuacguggugaucggcauucuuacacuggcugccaucgucgcggccaaugagaugggccuccuggaaaccacgaagcgggaccuggggauguccaaagagccgggagugguuagcccuaccucuuaucucgauguggaccuucaccccgcuuccgccuggacacuguacgcugucgccaccacagugauuacccccaugcugagacauacgaucgaaaacagcacagcuaacgucucucucgccgcgauugccaaucaagcugugguucugaugggccuugacaagggguggccuaucagcaaaauggaucugggagugccgcuccuggcccugggcugcuauucccaggucaacccccucacccuuacagcugccgugcugcugcucguuacccacuacgccaucauugggccuggacugcaggcgaaggcuacccgcgaggcccagaaacggacagcugccggcaucaugaagaaucccacgguggacggcauuaugaccaucgaucuugacccugucauuuacgauucuaaguuugagaaacaacugggacaggugaugcuccuggugcugugugccguucagcuccuucugaugagaacaagcugggcucugugcgaagcccucacccuggcgacaggacccaucaccacgcuuugggagggcuccccugggaaguucuggaacacaaccaucgccgucucuauggcuaauauuuuucgcggaagcuaucuggccggcgcugggcucgccuucuccaucaugaaaagcgugggaaccggcaagcggggcacagggucucagggagaaacccugggcgagaaauggaagaagaaacugaaccaacucuccagacgggaauuugagcuuuacaagaaaagcgggauuacagagguggaccgcacggaagcgaaggagggacugaaaagaggcgaaaccacacaucacgccgucucccgggggucugcuaagcugcagugguucguugagcgcaauauggugaucccggaaggaagagugauugaucucggcuguggcagagggggauggagcuauuacugcgccggccugaaaaaggucaccgaggugcgcggguauacaaagggaggccccgggcacgaggaaccuguucccauguccaccuacggauggaacacggugaaacuuaugucuggcaaggacgucuuuuaucugccucccgagaaaugugauacccuccugugcgacaucggcgaaagccugccguccccuacaguggaggagagcagaaccauucggguucucaagaugguggaacccuggcuuaaaaauaaccaguucuguaucaagguccugaaucccuacaugccuacagugaucgagcaucuggaacgccuccagagaaagcacgggggaaugcuggugcggaacccccuuucuagaaauuccacccaugagauguacuggauuagcaacggcacagggaauaucgucucuuccguuaacauggugagccgccugcuccugaaccgguucaccaugacgcacagacgcccuacaauugaaaaagauguggaccugggagcuggcacccggcacgucaaugccgagccggagacccccaacauggaugugaucggggaaagaauuaagcgcaucaaagaggaacauucuagcacauggcacuaugacgacgagaauccuuacaagacgugggcuuaucauggauccuacgaaguuaaagccaccggcucugcgagcuccaugaucaacggcguggucaagcuccugacaaagcccugggaugugguuccuauggugacccaaauggccaugacagacaccacacccuuugggcagcagcgggucuucaaagagaagguggauaccagaacgccgcgcccuaugcccggaacccggaaaguuauggagauuacagcugaauggcuuuggagaacccugggccgcaauaagcggccuagacucugcacacgcgaggaauuuaccaaaaaggugagaacgaacgccgcuaugggggccgucuucacagaggaaaaucaaugggagagcgcccgggcggcuguggaggacgaagaguuuuggaagcuggucggacgcgaaagagagcuucacaaacugggcaaguguggguccugcguguauaacaugaugggcaaacgggagaagaaacucggagaguucggcaaggccaaagggucuagagccaucugguacauguggcugggagcucgguaucuggaguuugaagcccucggcuuccugaaugaggaucauugguuuagccgcgaaaacuccuacucugggguugagggagagggccuucacaagcugggguacauucucagagacaucagcaagauucccggcggagcuauguaugccgaugacaccgcgggcugggauacacggaucaccgaagacgaucugcacaaugaggagaagaucacgcagcagauggacccugagcaucgccagcuugccaacgcuauuuucaagcugaccuaccaaaauaaaguggucaaggugcagagacccacaccgaaagggaccgugauggacaucauuucccggaaggaucagcgcggaucuggccagguugggacauauggacucaacaccuuuacaaauauggaagcccaacugaucagacagauggagggcgagggggugcugagcaaggcugaccucgaaaacccucaucugcuugagaaaaagauuacccaguggcuggaaacgaaaggcgucgagcggcucaagcgcauggccaucuccggagaugacugcgugguuaaacccaucgaugacagauucgcgaacgcccugcuugcucugaaugauaugggcaaggugcggaaggacauuccccaguggcaaccuagcaaaggguggcaugauuggcagcaggucccguuuuguucucaccacuuccaugaacucaucaugaaggacggacgcaaacuggugguccccugcagaccucaggaugagcugauuggccgggcccgcaucucccaaggggcuggauggagccucaaggagacagccugucugggcaaggcuuacgcccagauguggucucuuauguauuuccacagacgggaccugagacucgcguccaacgccauuugcagcgcugugcccguucauugggugccuaccucucgcaccacaugguccauccacgcccaucaccaguggaugaccacagaagauaugcugacggucuggaaucggguguggauugaggacaaccccuggauggaagacaagaccccuguuacaaccugggaggaugugcccuaccuugggaagagagaggaccaaugguguggcagccugaucggacucacaucccgcgccaccugggcucagaauauccugacggccauucagcagguccggagccugaucggcgaugaagaguuucucgacuauaugccgucuaugaaaagauuccgcaaggaagaggaaagcgagggggcgauuugguga

SEQ ID NO: 20876 - RNA, 9873 nt, Artificial Sequence
  derived and/or modified CDS sequence (opt5) from DENV-3__KJ622191__SS-prME
accagccugugccucaugaugaugcugcccgccacacuugcuuuccaccugacgagccgggacggcgaaccucggaugaucguggggaagaacgaacgcggaaagucucuccuguuuaagaccgccagcggcauuaauauguguacccuuaucgcgauggaucugggggaaaugugcgacgauaccgucacauacaaauguccgcucauugcugaaguugaacccgaagacaucgauugcugguguaaccugaccuccacaugggugaccuauggaacgugcaaucaggccggcgagcaucggcgggacaagcgcucuguggcccuggcuccucacgucgggaugggacucgauacccggacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuauggcuaugagauguguuggagugggcaaccgggacuuugucgaagggcugagcggagccacauggguggaugugguccuggagcauggcgggugcguuaccaccauggcuaagaauaaacccacacucgacaucgagcugcagaagacggaagccacccagcuugcgacacugcgcaaacucuguauugagggaaagaucaccaacauuacaaccgauuccagaugcccuacgcagggcgaagccauccugccggaggaacaggaccagaauuauguguguaaacacacauacguggaucggggcugggggaacggaugcggccuuuucgggaagggaagccuggugacaugcgcuaaguuucaaugucucgagucuauugagggcaaagugguucagcacgaaaaucugaaguauaccgugacaaucaccguccauacaggggaccagcaccaggugggaaacgacacgcaaggcguuaccgccgagaucacaccccaggcuuccaccguggaagccauucugccugaguacggcacacucgggcuggaaugcagcccccgcaccggacuugauuucaaugaggucauccugcucacgaugaaaaacaaggccuggauggugcauagacagugguuuuucgaccugccucuucccuggaccucuggcgcuauuacagagaccccgacauggaaucggaaagaacugcucgucaccuuuaagaacgcgcacgccaaaaagcaagaggugguugugcuggggucccaggaaggagcuaugcacacggcccugacaggcgccaccgagauccagaauagcgggggcacaucuauuuucgcuggacaucucaagugucgccugaaaauggauaaacuugaacugaaaggcauguccuaugccaugugccucaacaccuuuguccugaagaaagaggugagcgagacccagcacgggacaauccugaucaagguugaauacaagggagaggacgcgccuuguaaaauucccuucuccacggaagauggccaagggaaggcucauaacggaagacuuaucaccgccaauccuguggucaccaagaaggaggagcccgugaacauugaagccgagcccccuuucggcgaaucuaauaucgugauugggaucggcgacaaagcucucaagaucaacugguacaagaaaggaagcuccauuggcaagauguuugaggccaccgcuagaggggccagacgcauggcgauccugggagauacagccugggacuucggcagcguugggggaguccucaauucucucggcaaaauggugcaccagauuuuuggguccgcuuauaccgcccuguucggcggagugagcuggaucaugaagauuggcaucgggguccuucugacguggauuggacucaacucuaaaaauacaagcauguccuuuucuugcaucgugaucggcauuaucacccuguaccuggggaccguugugcaggcugauaugggaugugucauuaacuggaagggcaaggaacuuaaaugcgggagcggcaucuucgugacaaaugagguucauaccuggacagagcaguauaaguuucaagccgacuccccgaaacggcucgcgacggccauugcuggagccugggaaaacggcgugugugggaucagaagcaccacacgcauggagaaucugcuguggaagcagaucgcuaacgaacucaauuacauucugugggagaacaauaucaaacuuaccgucgugguuggagauauuaucggcgugcuggaacaggggaagcggacacucacaccccagccuauggagcugaaauauucuuggaagacguggggaaaggccaaaauugucaccgccgagauccaaaacuccagcuucaucauugacggccccaacacaccugaaugccccucugcuuccagagcguggaaugugugggagguggaagacuacggcuuuggggucuucaccacaaacaucuggcugaaacuucgcgagguuuauacccagacaugugaucaccggcucaugagcgccgcuauuaaagacgaaagagccgugcacgccgauaugggauacuggaucgagucccagaagaauggcucuuggaaacuggagaaggcuagcuuuauugaagugaagaccugcacguggccgaaaucccauacacuguggucuaacgggguccucgagagcgacaugaucaucccuaagucccuggccggacccauuagccagcacaaucaucgcccuggcuaccacacccaaaccgcggggcccuggcaccuuggaaaacuggaacucgauuucaacuauugcgagggcacaaccgugguuaucacggagaauuguggcacacgggggccuucucugagaaccacaaccguguccggaaagcugauucaugaauggugcugucgcagcugcacacuucccccgcuccgguacaugggcgaggacggguguugguauggaauggaaaucagaccuauuaacgagaaagaagagaauauggucaagucucugguguccgcuggcagcgggaagguugauaacuuuaccaugggagugcugugccucgccauccuguucgaggaagucaugcggggcaaauucggcaagaaacacaugauugccggggugcuucugacguuuaugcuccugcugucuggacagaucaccuggcgcgacauggcucauacacuuaucaugauuggcagcaaugccuccgauagaauggggaugggaguuaccuaccuggcgcucaucgcuacauucaagauucagcccuuucuggcccucggcuucuuucugcggaaacuuaccagcagagagaaccugcuccugggggugggacuggccauggcuacgacacuucaacugcccgaagacaucgagcagauggccaauggcauugcucucggccugauggcccucaagcugaucacccaguucgaaacauaucagcuuuggaccgcgcuggucucucucaccuguuccaacacaaucuuuacgcugaccguggccuggcgcacagcuacccugauucuugccggggugagccugcucccugucugccaauccucuagcaugcggaagacagauuggcugccgguugcuguggccgccaugggagugcccccucucccccuguucaucuuuucccuuaaagacacccugaagagacgcucuuggccucugaaugagggcgucauggcuguggggcucguuagcauucuggcguccucucuucugagaaacgaugugcccauggccggaccucucgucgcuggcgggcugcucaucgccuguuacgugauuacgggaacaagcgccgaccugaccguugagaaagcugccgacgugaccugggaagaggaagcggagcagacaggcgucucccacaaccuuaugaucaccguggaugacgauggcacaaugcggaucaaggacgaugaaacggagaauauucugaccguccugcucaaaacagcucugcuuaucgugagcgggauuuuccccuauucuaucccggccacccugcucguuuggcauacauggcagaagcagacccaacgcuccggagugcugugggacgucccuucucccccugagacgcagaaagccgaacucgaggaaggcguguacagaauuaagcagcaggggaucuuuggaaagacccaaguuggcguggggguccagaaagagggaguguuccacacaauguggcacgugacccggggcgcuguucugacacauaacggcaagcgccuugagcccaauugggccuccgucaaaaaggaucugauuuccuacgggggaggcuggagacugagcgcgcaguggcaaaaaggggaagagguccaggugaucgcugucgaaccgggacggaacccuaagaauuuucagaccaugcccggcaucuuccagacaacgaugggggagauuggagccaucgcccucgacuucaagccuggcaccucuggcucccccauuaucaaccgcgaagggaaagugguuggacuguauggcaaugggguggucacaaagaacggaggcuacgugagcgggauugcucaagccaaugcugagcccgauggcccuaccccggagcuugaagaggaaauguuuaaaaagagaaaccugaccaucauggaccuccaccccggauccggcaaaacacggaaguaucugccugccaucguucgcgaggcgauuaagagacggcucagaacgcugauccuugcccccacccgcguggucgcugccgaaauggaggaggcucugaaagggcugccuauucgguaccagacaaccgccacaaagagcgaacauaccggaagagagaucguggaucucaugugccacgccacguucacaaugcgccugcuuucucccguucgggugccuaauuauaaccugauuaucauggacgaagcucauuuuaccgauccggcgagcaucgccgcuagaggcuacauuuccacccgcgucgggaugggagaggccgccgcuaucuucaugacagccacacccccuggcacagcggaggcuuuuccccagucuaaugccccuauucaggacgaggagcgggacauccccgaaagaagcuggaacuccgggaaugaguggauuaccgauuucgugggcaaaacggugugguuugucccgucuaucaaggccggaaacgacauugcuaacugucuccgcaaaaauggcaagaagguuauccaacugagccggaaaacauucgauaccgaauaucagaagacaaaacugaacgacugggauuuuguggugaccacggacaucuccgagaugggggccaauuucaaggcggauagagucauugacccucggcgcugccucaaacccgugauccuuaccgauggacccgagagaguuauucuggccggcccuaugcccgugacagcugccucugcugcccagcggcgcgggagagucggacggaacccucagaaggaaaaugaccaauacaucuuuaccggccagccgcugaacaaugaugaggaccacgcucacuggacagaagccaagaugcuccuggacaacauuaauacccccgaggggaucaucccugcgcuuuucgaacccgagagagagaaaagcgccgcuauugauggcgaauaccgccugaagggagagucccggaaaacauucguggaacucaugagacgcggcgaccugccuguuuggcuggcccauaagguggcuagcgaggggaucaaauauaccgaucggaaguggugcuuugacggagaaagaaacaaucagauucucgaggagaacauggaugucgaaaucuggacgaaagagggcgaacgcaagaaacuucggcccagauggcuggacgcccgcacauacucugauccgcuggcccucaaagaguucaaggacuuugcugcggggagaaaauccauugcccuggaucuugugaccgaaaucggacgggucccuagccaccuggcucaucgcaccagaaaugcccucgacaaccuggugaugcugcacacaucugagcacggcggccgggccuaucgccaugcuguugaggaacuccccgagaccauggaaacacuucugcugcucgggcugaugauccuucugacgggaggcgccaugcuguuccugauuuccgggaagggaaucggcaaaaccagcauugggcugaucugugugauuguguccucuggaaugcucuggauggcggaugucccucuucaguggaucgccagcgcuauuguucuggaguuuuucaugauggugcugcucauccccgagccugaaaagcaaagaacaccccaggacaaucagcuggccuacguggucaucggcauucuuacccuggcugccaucguggcggccaacgagaugggccuccuggaaacaaccaagcgggaucuggggauguccaaagagccgggaguugugagcccuacgucuuaucucgacgucgaccuucaccccgcuuccgccuggacccuguacgcuguggccacaaccgucauuacacccaugcugagacauaccaucgaaaauagcacggcuaacgugucucucgccgcgauugccaaccaagcuguugugcugaugggccuugauaagggguggccuaucagcaaaauggaccugggagucccgcuccuggcccugggcugcuauucccaggugaauccccucacacuuaccgcugccguucugcugcucgugacacacuacgccaucauugggccuggacugcaggcgaaggcuacccgcgaggcccagaaacggaccgcugccggcaucaugaagaaccccacagucgauggcauuaugacgaucgaccuugauccugugauuuacgacucuaaguuugagaaacaacugggacaggugaugcuccugguucugugugccguccagcuccuucugaugagaaccagcugggcucugugcgaagcccucacacuggcgaccggacccaucacaacccuuugggagggcuccccugggaaguucuggaauacgacaaucgccgugucuauggcuaacauuuuucgcggaagcuaucuggccggcgcugggcucgccuucuccaucaugaaaagcgugggaaccggcaagcggggcaccgggucucagggagaaacacugggcgagaaauggaagaagaaacugaaucaacucuccagacgggaauuugagcuuuacaagaaaagcgggauuaccgaggucgaucgcacagaagcgaaggagggacugaaaagaggcgaaacgacccaucacgccguuucccgggggucugcuaagcugcagugguucguggagcgcaacauggugaucccggaaggaagagucauugaccucggcuguggcagaggcggguggagcuauuacugcgccgggcugaaaaaggugacagagguucgcggguauaccaagggaggccccgggcacgaggaaccugugcccauguccacauacggauggaauaccgucaaacuuaugucuggcaaggauguguuuuaucugccucccgagaaaugugacacgcuccugugcgauaucggcgaaagcuccccgagcccuaccguugaggagucuagaacaauucgggugcugaagauggucgaacccuggcucaaaaacaaucaguucuguaucaaggugcuuaaccccuacaugccuaccgugaucgagcaucuggaacgccugcagagaaagcacgggggaaugcucguccggaauccccuguccagaaacagcacacaugagauguacuggauuucuaauggcaccgggaacaucguuuccagcgugaauauggugucucgccuucugcucaaccgguucacaaugacccacagacgcccuacgauugaaaaagacgucgaucugggagcuggcacacggcacgugaacgccgagccggagacccccaauauggacguuaucggggaaagaauuaagcgcaucaaagaggaacauagcuccaccuggcacuaugacgaugagaacccuuacaagacaugggcuuaucauggaucuuacgaagugaaagccacgggcagcgcguccagcaugaucaauggcgucgugaagcugcucaccaagcccugggacguugugccuauggucacacaaauggccaugaccgauacaacccccuuugggcagcagcggguguucaaagagaagguugacacaagaaccccgcgcccuaugcccggaacgcggaaagugauggagauuaccgcugaauggcuguggagaacacuuggccgcaacaagcggccuagacugugcacccgcgaggaauuuaccaagaaggucagaaccaaugccgcuaugggggccguguucacggaggaaaaccaaugggaguccgcccgggcggcugucgaggaugaagaguuuuggaagcucgugggacgcgaaagagagcugcacaaacuuggcaagugugggucuugcguuuauaauaugaugggcaaacgggagaagaaacugggagaguucggcaaggccaaagggagcagagccaucugguacauguggcucggagcucgguaucuggaguuugaagcccugggcuuccucaacgaggaccauugguuuucccgcgaaaauucuuacagcgggguggagggagagggccugcacaaacuuggguacauucugagagauaucuccaagauucccggcggagcuauguaugccgacgauacagcgggcugggacacccggaucacagaagaugaccuccacaacgaggagaagaucacccagcagauggacccugagcaucgccagcuggccaaugcuauuuucaaacuuacguaccaaaacaaagucgugaaggugcagagacccaccccgaaagggacaguuauggauaucauuucucggaaggaccagcgcggaagcggccagguggggaccuauggacugaauacauuuaccaacauggaagcccaacucaucagacagauggagggcgaggggguccuguccaaggcugaucuggaaaauccucaccuccuggagaaaaagauuacacaguggcuugaaaccaaaggcguggagcggcugaagcgcauggccaucagcggagacgauugcguugugaaacccaucgacgauagauucgcgaacgcccuccuggcucuuaacgacaugggcaagguccggaaggauauuccccaguggcaaccuucuaaaggguggcaugacuggcaacaggugccguuuuguucccaccacuuccaugaacugaucaugaaggauggacgcaaacucgucgugcccugcagaccucaggacgagcugauuggccgggcccgcaucagccaaggggcuggauggucucugaaggagacggccugucucggcaaggcuuacgcccagauguggucccugauguauuuccacagacgggaucuuagacuggcgagcaaugccauuugcucugcuguucccgugcauugggucccuacaucccgcaccaccuggagcauccacgcccaucaccaguggaugacaaccgaagacaugcucacaguguggaaccggguuuggauugaggacaaucccuggauggaagauaagacgccugugaccacaugggaggacguccccuaccuggggaagagagaggaucaaugguguggcucccuuaucggacugaccagccgcgccacaugggcucagaacauccucaccgccauucaacaggugcggucucugaucggcgacgaagaguuucuggauuauaugccgagcaugaaaagauuccgcaaggaagaggaauccgagggggcgauuugguga

SEQ ID NO: 20877 - RNA, 9873 nt, Artificial Sequence
  derived and/or modified CDS sequence (opt5) from DENV-3__KJ622192__SS-prME
accagccugugccucaugaugaugcugcccgccacccuugcuuuccaccugacgagccgggacggcgaaccucggaugaucguggggaagaacgaacgcggaaagucucuccuguuuaagaccgccagcggcauuaauauguguacccuuaucgcgauggaucugggggaaaugugcgacgauaccgucacauacaaguguccgcucauugcugaaguugaacccgaagacaucgauugcugguguaaccugaccuccacaugggugaccuauggaacgugcaaucaggccggcgagcaucggcgggacaagcgcucuguggcccuggcuccucacgucgggaugggacucgauacccggacacaaaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuauggcuaugagauguguuggagugggcaaccgggacuuugucgaagggcugagcggagccacauggguggaugugguccuggagcauggcgggugcguuaccaccauggcuaagaauaaacccacacucgacaucgagcugcagaagacggaagccacccaacuugcgacacugcgcaaacucuguauugagggaaagaucaccaacauuacaaccgauuccagaugcccuacgcagggcgaagccauccugccggaggaacaggaccagaauuauguguguaaacacacauacguggaucggggcugggggaacggaugcggccuuuucgggaagggaagccuggugacaugcgcuaaguuucaaugucucgagucuauugagggcaaagugguucagcacgaaaaucugaaguauaccgugacaaucaccguccauacaggggaccagcaccaggugggaaacgacacgcaaggcguuaccgccgagaucacaccccaggcuuccaccguggaagccauucugccugaguacggcacacucgggcuggaaugcagcccccgcaccggacuugauuucaaugagaugauccugcucacgaugaaaaacaaggccuggaugguccauagacagugguuuuucgaccugccucuucccuggaccucuggcgcuauuacagagaccccgacauggaaucggaaagaacugcucgugaccuuuaagaacgcgcacgccaaaaagcaagaggucgugguucuggggucccaggaaggagcuaugcacacggcccugacaggcgccaccgagauccagaauagcgggggcacaucuauuuucgcuggacaucucaagugucgccugaaaauggauaaacuugaacugaaaggcauguccuaugccaugugccucaacaccuuugugcugaagaaagaggucagcgagacccagcacgggacaauccugaucaagguggaauacaagggagaggacgcgccuuguaaaauucccuucuccacggaagauggccaagggaaggcucauaacggaagacuuaucaccgccaauccuguugugaccaagaaggaggagcccgucaacauugaagccgagcccccuuucggcgaaucuaauaucgugauugggaucggcgacaaagcucucaagaucaacugguacaagaaaggaagcuccauuggcaagauguuugaggccaccgcuagaggggccagacgcauggcgauccugggagauacagccugggacuucggcagcgucggcgggguucucaauucucucgggaaaaugguccaccagauuuuuggguccgcuuauaccgcccuguucggcggagugagcuggaucaugaagauuggcaucggggugcuucugacguggauuggacucaacucuaaaaauacaagcauguccuuuucuugcaucgucaucggcauuaucacccuguaccuggggaccgugguucaggcugauaugggaugugugauuaacuggaagggcaaggaacuuaaaugcgggagcggcaucuucgucacaaaugaggugcauaccuggacagagcaguauaaguuucaagccgacuccccgaaacggcucgcgacggccauugcuggagccugggaaaacggcguuugugggaucagaagcaccacacgcauggagaaucugcuguggaagcagaucgcuaacgaacucaauuacauucugugggagaacaauaucaaacuuaccguggucgugggagauauuaucggcguucuggaacaggggaagcggacacucacaccccagccuauggagcugaaauauucuuggaagacguggggaaaggccaaaauugugaccgccgagauccaaaacuccagcuucaucauugacggccccaacacaccugaaugccccucugcuuccagagcguggaaugucugggagguggaagacuacggcuuugggguguucaccacaaacaucuggcugaaacuucgcgaggucuauacccagacaugugaucaccggcucaugagcgccgcuauuaaagacgaaagagccguucacgccgauaugggauacuggaucgagucccagaagaauggcucuuggaaacuggagaaggcuagcuuuauugaagugaagaccugcacguggccgaaaucccauacacuguggucuaacggggugcucgagagcgacaugaucaucccuaagucccuggccggacccauuagccagcacaaucaucgcccuggcuaccacacccaaaccgcggggcccuggcaccuuggaaaacuggaacucgauuucaacuauugcgagggcacaaccgucgugaucacggagaauuguggcacacgggggccuucucugagaaccacaaccguuuccggaaagcugauucaugaauggugcugucgcagcugcacacuucccccgcuccgguacaugggcgaggacggguguugguauggaauggaaaucagaccuauuaacgagaaagaagagaauauggugaagucucuggucuccgcuggcagcgggaagguggauaacuuuaccaugggaguucugugccucgccauccuguucgaggaagugaugcggggcaaauucggcaagaaacacaugauugccgggguccuucugacguuuaugcuccugcugucuggacagaucaccuggcgcgacauggcucauacacuuaucaugauuggcagcaaugccuccgauagaauggggaugggagugaccuaccuggcgcucaucgcuacauucaagauucagcccuuucuggcccucggcuucuuucugcggaaacuuaccagcagagagaaccugcuccuggggguuggacuggccauggcuacgacacuucaacugcccgaagacaucgagcagauggccaauggcauugcucucggccugauggcccucaagcugaucacccaguucgaaacauaucagcuuuggaccgcgcuggugucucucaccuguuccaacacaaucuuuacgcugaccgucgccuggcgcacagcuacccugauucuugccggggugagccugcucccugugugccaauccucuagcaugcggaagacagauuggcugccggucgcuguugccgccaugggagugcccccucucccccuguucaucuuuucccuuaaagacacccugaagagacgcucuuggccucugaaugagggcgugauggcugucgggcucgugagcauucuggcguccucucuucugagaaacgauguucccauggccggaccucucguggcuggcgggcugcucaucgccuguuacgucauuacgggaacaagcgccgaccugaccguggagaaagcugccgacguuaccugggaagaggaagcggagcagacaggcgugucccacaaccuuaugaucaccgucgaugacgauggcacaaugcggaucaaggacgaugaaacggagaauauucugaccgugcugcucaaaacagcucugcuuaucgucagcgggauuuuccccuauucuaucccggccacccugcucguguggcauacauggcagaagcagacccaacgcuccggaguucugugggacgugccuucucccccugagacgcagaaagccgaacucgaggaaggcgucuacagaauuaagcagcaggggaucuuuggaaagacccaagugggcguuggggugcagaaagagggagucuuccacacaauguggcacgugacccggggcgcugugcugacacauaacggcaagcgccuugagcccaauugggccuccguuaaaaaggaucugauuuccuacgggggaggcuggagacugagcgcgcaguggcaaaaaggggaagagguccaggugaucgcuguggaaccgggacggaacccuaagaauuuucagaccaugcccggcaucuuccagacaacgaccggggagauuggagccaucgcccucgacuucaagccuggcacaucuggcucccccauuaucaaccgcgaagggaaagucgugggacuguauggcaaugggguugugaccaagaacggaggcuacgucagcgggauugcucaagccaaugcugagcccgauggcccuaccccggagcuugaagaggaaauguuuaaaaagagaaaccugacaaucauggaccuccaccccggauccggcaaaacgcggaaguaucugccugccaucgugcgcgaggcgauuaagagacggcucagaacccugauccuugcccccacacgcguuguggcugccgaaauggaggaggcucugaaagggcugccuauucgguaccagaccacagccaccaagagcgaacauacgggaagagagaucgucgaucucaugugccacgccacauucaccaugcgccugcuuucucccgugcggguuccuaauuauaaccugauuaucauggacgaagcucauuuuaccgauccggcgagcaucgccgcuagaggcuacauuuccacacgcguggggaugggagaggccgccgcuaucuucaugaccgccacacccccuggcaccgcggaggcuuuuccccagucuaaugccccuauucaggacgaggagcgggacauccccgaaagaagcuggaacuccgggaaugaguggauuacggauuucgucggcaaaacagugugguuugugccgucuaucaaggccggaaacgacauugcuaacugucuccgcaaaaauggcaagaaggucauccaacugagccggaaaaccuucgauacagaauaucagaagaccaaacugaacgacugggauuuuguugugacgaccgacaucuccgagaugggggccaauuucaaggcggauagagugauugacccucggcgcugccucaaacccgucauccuuacagauggacccgagagagugauucuggccggcccuaugcccguuaccgcugccucugcugcccagcggcgcgggagagugggacggaacccucagaaggaaaaugaccaauacaucuuuacaggccagccgcugaacaaugaugaggaccacgcucacuggaccgaagccaagaugcuccuggacaacauuaauacacccgaggggaucaucccugcgcuuuucgaacccgagagagagaaaagcgccgcuauugauggcgaauaccgccugaagggagagucccggaaaaccuucgucgaacucaugagacgcggcgaccugccuguguggcuggcccauaagguugcuagcgaggggaucaaauauacggaucggaaguggugcuuugacggagaaagaaacaaucagauucucgaggagaacauggauguggaaaucuggacaaaagagggcgaacgcaagaaacuucggcccagauggcuggacgcccgcaccuacucugauccgcuggcccucaaagaguucaaggacuuugcugcggggagaaaauccauugcccuggaucuugucaccgaaaucggacgggugccuagccaccuggcucaucgcacaagaaaugcccucgacaaccuggucaugcugcacaccucugagcacggcggccgggccuaucgccaugcuguggaggaacuccccgagacaauggaaacgcuucugcugcucgggcugaugauccuucugaccggaggcgccaugcuguuccugauuuccgggaagggaaucggcaaaacaagcauugggcugaucuguguuauuguguccucuggaaugcucuggauggcggaugugccucuucaguggaucgccagcgcuauuguccuggaguuuuucaugaugguucugcucauccccgagccugaaaagcaaagaacaccccaggacaaucagcuggccuacguggugaucggcauucuuacacuggcugccaucgucgcggccaacgagaugggccuccuggaaaccacgaagcgggaucuggggauguccaaagagccgggagugguuagcccuaccucuuaucucgacguggaccuucaccccgcuuccgccuggacacuguacgcugucgccaccacagugauuacccccaugcugagacauacgaucgaaaauagcacagcuaacgucucucucgccgcgauugccaaccaagcugugguucugaugggccuugauaagggguggccuaucagcaaaauggaccugggagugccgcuccuggcccugggcugcuauucccaggucaauccccucacccuuacagcugccgugcugcugcucguuacccacuacgccaucauugggccuggacugcaggcgaaggcuacccgcgaggcccagaaacggacagcugccggcaucaugaagaaccccacgguggauggcauuaugaccaucgaccuugauccugucauuuacgacucuaaguuugagaaacaacugggacaggugaugcuccuggugcugugugccguucagcuccuucugaugagaacaagcugggcucugugcgaagcccucacccuggcgacaggacccaucaccacgcuuugggagggcuccccugggaaguucuggaauacaaccaucgccgucucuauggcuaacauuuuucgcggaagcuaucuggccggcgcugggcucgccuucuccaucaugaaaagcgugggaaccggcaagcggggcacagggucucagggagaaacccugggcgagaaauggaagaagaaacugaaucaacucuccagacgggaauuugagcuuuacaagaaaagcgggauuacagagguggaucgcacggaagcgaaggagggacugaaaagaggcgaaaccacacaucacgccgucucccgggggucugcuaagcugcagugguucguugagcgcaacauggugaucccggaaggaagagugauugaccucggcuguggcagagggggauggagcuauuacugcgccggccugaaaaaggucaccgaggugcgcggguauacaaagggaggccccgggcacgaggaaccuguucccauguccaccuacggauggaauacggugaaacuuaugucuggcaaggaugucuuuuaucugccucccgagaaaugugacacccuccugugcgauaucggcgaaagcuccccgagcccuacaguggaggagucuagaaccauucggguucugaagaugguggaacccuggcucaaaaacaaucaguucuguaucaagguccuuaaccccuacaugccuacagugaucgagcaucuggaacgccugcagagaaagcacgggggaaugcucgugcggaauccccuguccagaaacagcacccaugagauguacuggauuucuaauggcacagggaacaucgucuccagcguuaauauggugucucgccuucugcucaaccgguucaccaugacgcacagacgcccuacaauugaaaaagacguggaucugggagcuggcacccggcacgucaacgccgagccggagacccccaauauggacgugaucggggaaagaauuaagcgcaucaaagaggaacauagcuccacauggcacuaugacgaugagaacccuuacaagacgugggcuuaucauggaucuuacgaaguuaaagccaccggcagcgcguccagcaugaucaauggcguggucaagcugcucacaaagcccugggacgugguuccuauggugacccaaauggccaugacagauaccacacccuuugggcagcagcgggucuucaaagagaagguggacaccagaacgccgcgcccuaugcccggaacccggaaaguuauggagauuacagcugaauggcuguggagaacccuuggccgcaacaagcggccuagacugugcacacgcgaggaauuuaccaaaaaggugagaacgaaugccgcuaugggggccgucuucacagaggaaaaccaaugggaguccgcccgggcggcuguggaggaugaagaguuuuggaagcucgucggacgcgaaagagagcugcacaaacuuggcaagugugggucuugcguguauaauaugaugggcaaacgggagaagaaacugggagaguucggcaaggccaaagggagcagagccaucugguacauguggcucggagcucgguaucuggaguuugaagcccugggcuuccucaacgaggaccauugguuuucccgcgaaaauucuuacagcgggguugagggagagggccugcacaaacuuggguacauucugagagauaucuccaagauucccggcggagcuauguaugccgacgauaccgcgggcugggacacacggaucaccgaagaugaccuccacaacgaggagaagaucacgcagcagauggacccugagcaucgccagcuggccaaugcuauuuucaaacuuaccuaccaaaacaaaguggucaaggugcagagacccacaccgaaagggaccgugauggauaucauuucucggaaggaccagcgcggaagcggccagguugggacauauggacugaauaccuuuacaaacauggaagcccaacucaucagacagauggagggcgagggggugcuguccaaggcugaucuggaaaauccucaccuccuggagaaaaagauuacccaguggcuugaaacgaaaggcgucgagcggcugaagcgcauggccaucagcggagacgauugcgugguuaaacccaucgacgauagauucgcgaacgcccuccuggcucuuaacgacaugggcaaggugcggaaggauauuccccaguggcaaccuucuaaaggguggcaugacuggcagcaggucccguuuuguucccaccacuuccaugaacugaucaugaaggauggacgcaaacucgugguccccugcagaccucaggacgagcugauuggccgggcccgcaucagccaaggggcuggauggucucugaaggagacagccugucucggcaaggcuuacgcccagauguggucccugauguauuuccacagacgggaucuuagacuggcgagcaaugccauuugcucugcugugcccguucauugggugccuaccucccgcaccacauggagcauccacgcccaucaccaguggaugaccacagaagacaugcucacggucuggaaccggguguggauugaggacaaucccuggauggaagauaagaccccuguuacaaccugggaggacgugcccuaccuggggaagagagaggaucaaugguguggcucccuuaucggacugacaagccgcgccaccugggcucagaacauccucacggccauucagcagguccggucucugaucggcgacgaagaguuucuggauuauaugccgagcaugaaaagauuccgcaaggaagaggaauccgagggggcgauuugguga

SEQ ID NO: 20878 - RNA, 9873 nt, Artificial Sequence
  derived and/or modified CDS sequence (opt5) from DENV-3__KJ622193__SS-prME
accagccugugccucaugaugaugcugcccgccacccuugcuuuccaccugacgagccgggacggcgagccucggaugaucguggggaagaacgaacgcggaaagucucuccuguuuaagaccgccagcggcauuaauauguguacccuuaucgcgauggaucugggggagaugugcgacgauaccgucacauacaaguguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacaaaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuauggcuaugagauguguuggagugggcaaccgggacuuugucgaagggcugagcggagccacauggguggaugugguccuggagcauggcgggugcguuaccaccauggcuaagaauaaacccacacucgacaucgagcugcagaagacggaagccacccaacuugcgacacugcgcaaacucuguauugagggaaagaucaccaacauuacaaccgauuccagaugcccuacgcagggcgaagccauccugccggaggaacaggaccagaauuauguguguaaacacacauacguggaucggggcugggggaacggaugcggccuuuucgggaagggaagccuggucacaugcgcuaaguuucaaugucucgagucuauugagggcaaagugguucagcacgaaaaucugaaguauaccgugacaaucaccguccauacaggggaccagcaccaggugggaaacgacacgcaaggcguuaccgccgagaucacaccccaggcuuccaccguggaagccauucugccugaguacggcacacucgggcuggaaugcagcccccgcaccggacuugauuucaaugagaugauccugcucacgaugaaaaacaaggccuggaugguccauagacagugguuuuucgaccugccucuucccuggaccucuggcgcuauuacagagaccccgacauggaaucggaaagaacugcucgugaccuuuaagaacgcgcacgccaaaaagcaaggggucgugguucugggaucccaggagggcgcuaugcacacggcccugacaggggccaccgaaauccagaauagcggcggaacaucuauuuucgcuggccaucucaagugucgccugaaaauggauaaacuugagcugaaagggauguccuaugccaugugccucaacaccuuugugcugaagaaagaagucagcgagacccagcacggaacaauccugaucaagguggaguacaagggcgaagacgcgccuuguaaaauucccuucuccacggaggaugggcaaggaaaggcucauaacggcagacuuaucaccgccaauccuguugugaccaagaaggaggaacccgucaacauugaggccgaacccccuuucggggagucuaauaucgugauuggcaucggagacaaagcucucaagaucaacugguacaagaaaggcagcuccauugggaagauguuugaagccaccgcucggggagccagacgcauggcgauccugggcgauacagccugggacuucgggagcgugggaggcguucucaauucucucgggaaaaugguccaccagauuuuuggcuccgcuuauaccgcccuguucggaggcgugagcuggaucaugaagauugggaucggagugcuucugacguggauuggccucaacucuaaaaauacaagcauguccuuuucuugcaucgucaucgggauuaucacccuguaccugggaaccgugguucaggcugauaugggcugugugauuaacuggaaggggaaggagcuuaaaugcggcagcggaaucuucgucacaaaugaagugcauaccuggacagagcaguauaaguuucaagccgacuccccgaaacggcucgcgacggccauugcuggcgccugggagaacgggguuuguggaaucagaagcaccacacgcauggaaaaucugcuguggaagcagaucgcuaacgagcucaauuacauucugugggaaaacaauaucaaacuuaccguggucgugggcgauauuaucgggguucuggagcagggaaagcggacacucacaccccagccuauggaacugaaauauucuuggaagacguggggcaaggccaaaauugugaccgccgagauccaaaacuccagcuucaucauugacggccccaacacaccugagugccccucugcuuccagagcguggaaugucugggaaguggaggacuacggguuuggaguguucaccacaaacaucuggcugaaacuucgcgaagucuauacccagacaugugaucaccggcucaugagcgccgcuauuaaagacgagagagccguucacgccgauaugggcuacuggaucgaaucccagaagaaugggucuuggaaacuggagaaggcuagcuuuauugaggugaagaccugcacguggccgaaaucccauacacuguggucuaacggagugcucgaaagcgacaugaucaucccuaagucccuggccggccccauuagccagcacaaucaucgcccuggguaccacacccaaaccgcgggacccuggcaccuuggcaaacuggagcucgauuucaacuauugcgaaggcacaaccgucgugaucacggagaauugugggacacggggaccuucucugagaaccacaaccguuuccggcaagcugauucaugaguggugcugucgcagcugcacacuucccccgcuccgguacaugggggaagacggauguugguauggcauggagaucagaccuauuaacgaaaaagaggaaaauauggugaagucucuggucuccgcugggagcggaaagguggauaacuuuaccaugggcguucugugccucgccauccuguucgaggaggugaugcggggcaaauucgggaagaaacacaugauugccggaguccuucugacguuuaugcuccugcugucuggccagaucaccuggcgcgacauggcucauacacuuaucaugauugggagcaaugccuccgauagaaugggaaugggcgugaccuaccuggcgcucaucgcuacauucaagauucagcccuuucuggcccucggguucuuucugcggaaacuuaccagcagagaaaaccugcuccugggaguuggccuggccauggcuacgacacuucaacugcccgaggacaucgaacagauggccaauggcauugcucucgggcugauggcccucaagcugaucacccaguucgagacauaucagcuuuggaccgcgcuggugucucucaccuguuccaacacaaucuuuacgcugaccgucgccuggcgcacagcuacccugauucuugccggagugagccugcucccugugugccaauccucuagcaugcggaagacagauuggcugccggucgcuguugccgccaugggcgugcccccucucccccuguucaucuuuucccuuaaagacacccugaagagacgcucuuggccucugaaugaaggggugauggcugucggacucgugagcauucuggcguccucucuucugagaaacgauguucccauggccggcccucucguggcugggggacugcucaucgccuguuacgucauuacgggcacaagcgccgaccugaccguggagaaagcugccgacguuaccugggaggaagaggcggaacagacaggcgugucccacaaccuuaugaucaccgucgaugacgaugggacaaugcggaucaaggacgaugagacggaaaauauucugaccgugcugcucaaaacagcucugcuuaucgucagcggaauuuuccccuauucuaucccggccacccugcucguguggcauacauggcagaagcagacccaacgcuccggcguucugugggacgugccuucucccccugagacgcagaaagccgagcucgaagagggggucuacagaauuaagcagcagggaaucuuuggcaagacccaaguggggguuggagugcagaaagaaggcgucuuccacacaauguggcacgugacccggggcgcugugcugacacauaacgggaagcgccuugagcccaauugggccuccguuaaaaaggaucugauuuccuacggaggcggguggagacugagcgcgcaguggcaaaaaggagaggaaguccaggugaucgcuguggagccgggccggaacccuaagaauuuucagaccaugcccgggaucuuccagacaacgaccggagaaauuggcgccaucgcccucgacuucaagccuggcacaucugggucccccauuaucaaccgcgagggaaaagucgugggccuguaugggaauggaguugugaccaagaacggcggguacgucagcggcauugcucaagccaaugcugaacccgauggaccuaccccggagcuugaggaagagauguuuaaaaagagaaaccugacaaucauggaccuccaccccggcuccgggaaaacgcggaaguaucugccugccaucgugcgcgaagcgauuaagagacggcucagaacccugauccuugcccccacacgcguuguggcugccgagauggaagaggcucugaaaggacugccuauucgguaccagaccacagccaccaagagcgagcauacgggcagagaaaucgucgaucucaugugccacgccacauucaccaugcgccugcuuucucccgugcggguuccuaauuauaaccugauuaucauggacgaggcucauuuuaccgauccggcgagcaucgccgcuagaggguacauuuccacacgcgugggaaugggcgaagccgccgcuaucuucaugaccgccacacccccugggaccgcggaggcuuuuccccagucuaaugccccuauucaggacgaagaacgggacauccccgagagaagcuggaacuccggcaaugaauggauuacggauuucgucggaaaaacagugugguuugugccgucuaucaaggccggcaacgacauugcuaacugucuccgcaaaaaugggaagaaggucauccaacugagccggaaaaccuucgauacagaguaucagaagaccaaacugaacgacugggauuuuguugugacgaccgacaucuccgaaaugggagccaauuucaaggcggauagagugauugacccucggcgcugccucaaacccgucauccuuacagauggccccgagagagugauucuggccgggccuaugcccguuaccgcugccucugcugcccagcggcgcggaagagugggccggaacccucagaaggagaaugaccaauacaucuuuacagggcagccgcugaacaaugaugaagaccacgcucacuggaccgaggccaagaugcuccuggacaacauuaauacacccgaaggcaucaucccugcgcuuuucgagcccgaaagagagaaaagcgccgcuauugauggagaguaccgccugaagggcgaaucccggaaaaccuucgucgagcucaugagacgcggggaccugccuguguggcuggcccauaagguugcuagcgaaggaaucaaauauacggaucggaaguggugcuuugacggcgagagaaacaaucagauucucgaagagaacauggauguggagaucuggacaaaagaaggggagcgcaagaaacuucggcccagauggcuggacgcccgcaccuacucugauccgcuggcccucaaagaguucaaggacuuugcugcgggaagaaaauccauugcccuggaucuugucaccgagaucggccgggugccuagccaccuggcucaucgcacaagaaaugcccucgacaaccuggucaugcugcacaccucugaacacggcgggcgggccuaucgccaugcuguggaggagcuccccgaaacaauggagacgcuucugcugcucggacugaugauccuucugaccggcggggccaugcuguuccugauuuccggaaagggcaucgggaaaacaagcauuggacugaucuguguuauuguguccucuggcaugcucuggauggcggaugugccucuucaguggaucgccagcgcuauuguccuggaauuuuucaugaugguucugcucauccccgagccugagaagcaaagaacaccccaggacaaucagcuggccuacguggugaucggcauucuuacacuggcugccaucgucgcggccaacgaaauggggcuccuggagaccacgaagcgggaucugggaauguccaaagaaccgggcgugguuagcccuaccucuuaucucgacguggaccuucaccccgcuuccgccuggacacuguacgcugucgccaccacagugauuacccccaugcugagacauacgaucgagaauagcacagcuaacgucucucucgccgcgauugccaaccaagcugugguucugauggggcuugauaagggauggccuaucagcaaaauggaccugggcgugccgcuccuggcccuggggugcuauucccaggucaauccccucacccuuacagcugccgugcugcugcucguuacccacuacgccaucauuggaccuggccugcaggcgaaggcuacccgcgaagcccagaaacggacagcugccggcaucaugaagaaccccacgguggaugggauuaugaccaucgaccuugauccugucauuuacgacucuaaguuugagaaacaacugggacaggugaugcuccuggugcugugugccguucagcuccuucugaugagaacaagcugggcucugugcgaggcccucacccuggcgacaggccccaucaccacgcuuugggaaggguccccuggaaaguucuggaauacaaccaucgccgucucuauggcuaacauuuuucgcggcagcuaucuggccggggcuggacucgccuucuccaucaugaaaagcgugggcaccggcaagcgggggacaggaucucagggcgagacccugggggaaaaauggaagaagaaacugaaucaacucuccagacgggaguuugaacuuuacaagaaaagcggaauuacagagguggaucgcacggaggcgaaggaaggccugaaaagaggggagaccacacaucacgccgucucccggggaucugcuaagcugcagugguucguugaacgcaacauggugaucccggagggcagagugauugaccucggcugugggcggggaggcuggagcuauuacugcgccgggcugaaaaaggucaccgaagugcgcggauauacaaagggcgggcccggacacgaggagccuguucccauguccaccuacggcuggaauacggugaaacuuaugucuggcaaggaugucuuuuaucugccucccgaaaaaugugacacccuccugugcgauaucggggagagcuccccgagcccuacaguggaagagucuagaaccauucggguucugaagaugguggagcccuggcucaaaaacaaucaguucuguaucaagguccuuaaccccuacaugccuacagugaucgaacaucuggagcgccugcagagaaagcacggaggcaugcucgugcggaauccccuguccagaaacagcacccaugaaauguacuggauuucuaaugggacaggaaacaucgucuccagcguuaauauggugucucgccuucugcucaaccgguucaccaugacgcacagacgcccuacaauugagaaagacguggaucugggcgcugggacccggcacgucaacgccgaaccggagacccccaauauggacgugaucggagagagaauuaagcgcaucaaagaggaacauagcuccacauggcacuaugacgaugaaaacccuuacaagacgugggcuuaucauggcucuuacgagguuaaagccaccggcagcgcguccagcaugaucaaugggguggucaagcugcucacaaagcccugggacgugguuccuauggugacccaaauggccaugacagauaccacacccuuuggacagcagcgggucuucaaagaaaagguggacaccagaacgccgcgcccuaugcccggcacccggaaaguuauggagauuacagcugaguggcuguggagaacccuugggcgcaacaagcggccuagacugugcacacgcgaagaguuuaccaaaaaggugagaacgaaugccgcuaugggagccgucuucacagaagagaaccaaugggaauccgcccgggcggcuguggaggaugaggaauuuuggaagcucgucggccgcgagagagaacugcacaaacuugggaaguguggcucuugcguguauaauaugaugggaaaacgggagaagaaacugggcgaguucgggaaggccaaaggaagcagagccaucugguacauguggcucggcgcucgguaucuggaauuugaggcccugggguuccucaacgaagaccauugguuuucccgcgaaaauucuuacagcggaguugaaggcgaggggcugcacaaacuuggcuacauucugagagauaucuccaagauucccggaggcgcuauguaugccgacgauaccgcggggugggacacacggaucaccgaggaugaccuccacaacgaagagaaaaucacgcagcagauggacccugaacaucgccagcuggccaaugcuauuuucaaacuuaccuaccaaaacaaaguggucaaggugcagagacccacaccgaaaggaaccgugauggauaucauuucucggaaggaccagcgcggcagcgggcagguuggaacauauggccugaauaccuuuacaaacauggaggcccaacucaucagacagauggaaggggagggcgugcuguccaaggcugaucuggagaauccucaccuccuggagaagaagauuacccaguggcuugagacgaaaggagucgaacggcugaagcgcauggccaucagcggcgacgauugcgugguuaaacccaucgacgauagauucgcgaacgcccuccuggcucuuaacgacauggggaaggugcggaaggauauuccccaguggcaaccuucuaaaggauggcaugacuggcagcaggucccguuuuguucccaccacuuccaugagcugaucaugaaggauggccgcaaacucgugguccccugcagaccucaggacgaacugauugggcgggcccgcaucagccaaggagcuggcuggucucugaaggagacagccugucucgggaaggcuuacgcccagauguggucccugauguauuuccacagacgggaucuuagacuggcgagcaaugccauuugcucugcugugcccguucauugggugccuaccucccgcaccacauggagcauccacgcccaucaccaguggaugaccacagaggacaugcucacggucuggaaccggguguggauugaagacaaucccuggauggaggauaagaccccuguuacaaccugggaagacgugcccuaccugggcaagagagaggaucaaugguguggaucccuuaucggccugacaagccgcgccaccugggcucagaacauccucacggccauucagcagguccggucucugaucggggacgaggaauuucuggauuauaugccgagcaugaaaagauuccgcaaggaggaagaguccgaaggagcgauuugguga

SEQ ID NO: 20879 - RNA, 9873 nt, Artificial Sequence
  derived and/or modified CDS sequence (opt5) from DENV-3__KJ622194__SS-prME
accagccugugccucaugaugaugcugcccgccacccuugcuuuccaccugacgagccgggacggcgaaccucggaugaucguggggaagaaugaacgcggaaagucucuccuguuuaagaccgccagcggcauuaauauguguacacuuaucgcgauggaucugggggaaaugugcgacgauaccgucacauacaaguguccgcucauugcugaaguugaacccgaagacaucgauugcugguguaaccugaccuccacaugggugaccuauggaacgugcaaucaggccggcgagcaucggcgggacaagcgcucuguggcccuggcuccucacgucgggaugggacucgauacccggacacaaaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuauggcuaugagauguguuggagugggcaaccgggacuuugucgaagggcugagcggagccacauggguggaugugguccuggagcauggcgggugcguuaccaccauggcuaagaauaaacccacacucgacaucgagcugcagaagacggaagccacccaacuugcgacacugcgcaaacucuguauugagggaaagaucaccaacauuacaaccgauuccagaugcccuacgcagggcgaagccauccugccggaggaacaggaccagaauuauguguguaaacacacauacguggaucggggcugggggaacggaugcggccuuuucgggaagggaagccuggugacaugcgcuaaguuucaaugucucgagucuauugagggcaaagugguucagcacgaaaaucugaaguauaccgugacaaucaccguccauacaggggaccagcaccaggugggaaacgacacgcaaggcguuaccgccgagaucacaccccaggcuuccaccguggaagccauucugccugaguacggcacacucgggcuggaaugcagcccccgcaccggacuugauuucaaugagaugauccugcucacgaugaaaaacaaggccuggaugguccauagacagugguuuuucgaccugccucuucccuggaccucuggcgcuauuacagagaccccgacauggaaucggaaagaacugcucgugaccuuuaagaacgcgcacgccaaaaagcaagaggucgugguucuggggucccaggaaggagcuaugcacacggcccugacaggcgccaccgagauccagaauagcgggggcacaucuauuuucgcuggacaucucaagugucgccugaaaauggauaaacuugaacugaaaggcauguccuaugccaugugccucaacaccuuugugcugaagaaagaggucagcgagacccagcacgggacaauccugaucaagguggaauacaagggagaggacgcgccuuguaaaauucccuucuccacggaagauggccaagggaaggcucauaacggaagacuuaucaccgccaauccuguugugaccaagaaggaggagcccgucaacauugaagccgagcccccuuucggcgaaucuaauaucgugauugggaucggcgacaaagcucucaagaucaacugguacaagaaaggaagcuccauuggcaagauguuugaggccaccgcuagaggggccagacgcauggcgauccugggagauacagccugggacuucggcagcgucggcgggguucucaauucucucgggaaaaugguccaccagauuuuuggguccgcuuauaccgcccuguucggcggagugagcuggaucaugaagauuggcaucggggugcuucugacguggauuggacucaacucuaaaaauacaagcauguccuuuucuugcaucgucaucggcauuaucacccuguaccuggggaccgugguucaggcugauaugggaugugugauuaacuggaagggcaaggaacuuaaaugcgggagcggcaucuucgucacaaaugaggugcauaccuggacagagcaguauaaguuucaagccgacuccccgaaacggcucgcgacggccauugcuggagccugggaaaacggcguuugugggaucagaagcaccacacgcauggagaaucugcuguggaagcagaucgcuaacgaacucaauuacauucugugggagaacaauaucaaacuuaccguggucgugggagauauuaucggcguucuggaacaggggaagcggacacucacaccccagccuauggagcugaaauauucuuggaagacguggggaaaggccaaaauugugaccgccgagauccaaaacuccagcuucaucauugacggccccaacacaccugaaugccccucugcuuccagagcguggaaugucugggagguggaagacuacggcuuugggguguucaccacaaacaucuggcugaaacuucgcgaggucuauacccagacaugugaucaccggcucaugagcgccgcuauuaaagacgaaagagccguucacgccgauaugggauacuggaucgagucccagaagaauggcucuuggaaacuggagaaggcuagcuuuauugaagugaagaccugcacguggccgaaaucccauacacuguggucuaacggggugcucgagagcgacaugaucaucccuaagucccuggccggacccauuagccagcacaaucaucgcccuggcuaccacacccaaaccgcggggcccuggcaccuuggaaaacuggaacucgauuucaacuauugcgagggcacaaccgucgugaucacggagaauuguggcacacgggggccuucucugagaaccacaaccguuuccggaaagcugauucaugaauggugcugucgcagcugcacacuucccccgcuccgguacaugggcgaggacggguguugguauggaauggaaaucagaccuauuaacgagaaagaagagaauauggugaagucucuggucuccgcuggcagcgggaagguggauaacuuuaccaugggaguucugugccucgccauccuguucgaggaagugaugcggggcaaauucggcaagaaacacaugauugccgggguccuucugacguuuaugcuccugcugucuggacagaucaccuggcgcgacauggcucauacacuuaucaugauuggcagcaaugccuccgauagaauggggaugggagugaccuaccuggcgcucaucgcuacauucaagauucagcccuuucuggcccucggcuucuuucugcggaaacuuaccagcagagagaaccugcuccuggggguuggacuggccauggcuacgacacuucaacugcccgaagacaucgagcagauggccaauggcauugcucucggccugauggcccucaagcugaucacccaguucgaaacauaucagcuuuggaccgcgcuggugucucucaccuguuccaacacaaucuuuacgcugaccgucgccuggcgcacagcuacccugauucuugccggggugagccugcucccugugugccaauccucuagcaugcggaagacagauuggcugccggucgcuguugccgccaugggagugcccccucucccccuguucaucuuuucccuuaaagacacccugaagagacgcucuuggccucugaaugagggcgugauggcugucgggcucgugagcauucuggcguccucucuucugagaaacgauguucccauggccggaccucucguggcuggcgggcugcucaucgccuguuacgucauuacgggaacaagcgccgaccugaccguggagaaagcugccgacguuaccugggaagaggaagcggagcagacaggcgugucccacaaccuuaugaucaccgucgaugacgauggcacaaugcggaucaaggacgaugaaacggagaauauucugaccgugcugcucaaaacagcucugcuuaucgucagcgggauuuuccccuauucuaucccggccacccugcucguguggcauacauggcagaagcagacccaacgcuccggaguucugugggacgugccuucucccccugagacgcagaaagccgaacucgaggaaggcgucuacagaauuaagcagcaggggaucuuuggaaagacccaagugggcguuggggugcagaaagagggagucuuccacacaauguggcacgugacccggggcgcugugcugacacauuccggcaagcgccuugagcccaacugggccuccguuaaaaaggaucugauuagcuacgggggaggcuggagacugucugcgcaguggcaaaaaggggaagagguccaggugaucgcuguggaaccgggacggaauccuaagaacuuucagaccaugcccggcaucuuccagacaacgaccggggagauuggagccaucgcccucgacuucaagccuggcacauccggcagccccauuaucaaucgcgaagggaaagucgugggacuguauggcaacgggguugugaccaagaauggaggcuacgucuccgggauugcucaagccaacgcugagcccgauggcccuaccccggagcuugaagaggaaauguuuaaaaagagaaaucugacaaucauggaccuccaccccggaagcggcaaaacgcggaaguaucugccugccaucgugcgcgaggcgauuaagagacggcucagaacccugauccuugcccccacacgcguuguggcugccgaaauggaggaggcucugaaagggcugccuauucgguaccagaccacagccaccaagucugaacauacgggaagagagaucgucgaucucaugugccacgccacauucaccaugcgccugcuuagccccgugcggguuccuaacuauaaucugauuaucauggacgaagcucauuuuaccgauccggcguccaucgccgcuagaggcuacauuucuacacgcguggggaugggagaggccgccgcuaucuucaugaccgccacacccccuggcaccgcggaggcuuuuccccagagcaacgccccuauucaggacgaggagcgggacauccccgaaagauccuggaacucugggaacgaguggauuacggauuucgucggcaaaacagugugguuugugccgagcaucaaggccggaaaugacauugcuaacugucuccgcaaaaacggcaagaaggucauccaacugucccggaaaaccuucgauacagaauaucagaagaccaaacugaaugacugggauuuuguugugacgaccgacaucucugagaugggggccaacuucaaggcggauagagugauugacccucggcgcugccucaaacccgucauccuuacagauggacccgagagagugauucuggccggcccuaugcccguuaccgcugccagcgcugcccagcggcgcgggagagugggacggaauccucagaaggaaaacgaccaauacaucuuuacaggccagccgcugaauaacgaugaggaccacgcucacuggaccgaagccaagaugcuccuggacaauauuaacacacccgaggggaucaucccugcgcuuuucgaacccgagagagagaaauccgccgcuauugauggcgaauaccgccugaagggagagagccggaaaaccuucgucgaacucaugagacgcggcgaccugccuguguggcuggcccauaagguugcuucugaggggaucaaauauacggaucggaaguggugcuuugacggagaaagaaauaaccagauucucgaggagaauauggauguggaaaucuggacaaaagagggcgaacgcaagaaacuucggcccagauggcuggacgcccgcaccuacuccgauccgcuggcccucaaagaguucaaggacuuugcugcggggagaaaaagcauugcccuggaucuugucaccgaaaucggacgggugccuucucaccuggcucaucgcacaagaaacgcccucgacaaucuggucaugcugcacaccuccgagcacggcggccgggccuaucgccaugcuguggaggaacuccccgagacaauggaaacgcuucugcugcucgggcugaugauccuucugaccggaggcgccaugcuguuccugauuagcgggaagggaaucggcaaaacauccauugggcugaucuguguuauugugucuagcggaaugcucuggauggcggaugugccucuucaguggaucgccuccgcuauuguccuggaguuuuucaugaugguucugcucauccccgagccugaaaagcaaagaacaccccaggacaaccagcuggccuacguggugaucggcauucuuacacuggcugccaucgucgcggccaaugagaugggccuccuggaaaccacgaagcgggaucuggggaugagcaaagagccgggagugguuucuccuaccuccuaucucgacguggaccuucaccccgcuagcgccuggacacuguacgcugucgccaccacagugauuacccccaugcugagacauacgaucgaaaacucuacagcuaaugucagccucgccgcgauugccaaccaagcugugguucugaugggccuugauaagggguggccuaucuccaaaauggaccugggagugccgcuccuggcccugggcugcuauucucaggucaacccccucacccuuacagcugccgugcugcugcucguuacccacuacgccaucauugggccuggacugcaggcgaaggcuacccgcgaggcccagaaacggacagcugccggcaucaugaagaaucccacgguggauggcauuaugaccaucgaccuugauccugucauuuacgacagcaaguuugagaaacaacugggacaggugaugcuccuggugcugugugccguucagcuccuucugaugagaacauccugggcucugugcgaagcccucacccuggcgacaggacccaucaccacgcuuugggagggcucuccugggaaguucuggaacgccacaaucgcugucagcauggccaauauuuuucgcggauccuaucuggcuggcgccgggcucgcguucagcaucaugaaaucugugggaaccggcaagcggggcaccgggucccagggagaaacacugggcgagaaauggaagaagaaacugaaccaacucagcagacgggaauuugagcuuuacaagaaauccgggauuaccgagguggaucgcacagaagccaaggagggacugaaaagaggcgaaacgacccaucacgcugucucucgggggagcgccaagcugcagugguucguugagcgcaauauggugaucccggaaggaagagugauugaccucggcuguggcagagggggaugguccuauuacugcgcuggccugaaaaaggucacagaggugcgcggguauaccaagggaggccccgggcacgaggaaccuguucccaugucuacauacggauggaacaccgugaaacuuaugagcggcaaggaugucuuuuaucugccucccgagaaaugugacacgcuccugugcgauaucggcgaauccagcccgucuccuaccguggaggaguccagaacaauucggguucugaagaugguggaacccuggcucaaaaauaaccaguucuguaucaagguccuuaaucccuacaugccuaccgugaucgagcaucuggaacgccugcagagaaagcacgggggaaugcucgugcggaacccccugagcagaaauucuacacaugagauguacuggauuuccaacggcaccgggaauaucgucagcucuguuaacauggugagccgccuucugcucaaucgguucacaaugacccacagacgcccuacgauugaaaaagacguggaucugggagccggcacacggcacgucaacgcugagccggagacccccaacauggacgugaucggggaaagaauuaagcgcaucaaagaggaacauuccucuaccuggcacuaugacgaugagaauccuuacaagacaugggccuaucauggaagcuacgaaguuaaagcgacgggcuccgccagcuccaugaucaacggcguggucaagcugcucaccaagcccugggacgugguuccuauggugacacaaauggcuaugaccgauacaacccccuuugggcagcagcgggucuucaaagagaagguggacacaagaaccccgcgcccuaugcccggaacgcggaaaguuauggagauuaccgccgaauggcuguggagaacacuuggccgcaauaagcggccuagacugugcacccgcgaggaauuuaccaagaaggugagaaccaacgcugccaugggggccgucuucacggaggaaaaucaaugggagucugcgcgggcugccguggaggaugaagaguuuuggaagcucgucggacgcgaaagagagcugcacaaacuuggcaagugugggagcugcguguauaacaugaugggcaaacgggagaagaaacugggagaguucggcaaggccaaaggguccagagcuaucugguacauguggcucggagcccgguaucuggaguuugaagcucugggcuuccucaaugaggaccauugguuuucucgcgaaaacagcuacuccgggguugagggagagggccugcacaaacuuggguacauucugagagauaucucuaagauucccggcggagccauguaugcggacgauacagccggcugggacacccggaucacagaagaugaccuccacaaugaggagaagaucacccagcagauggacccugagcaucgccagcuggcuaacgccauuuucaaacuuacguaccaaaauaaaguggucaaggugcagagacccaccccgaaagggacagugauggauaucauuagccggaaggaccagcgcggauccggccagguugggaccuauggacugaacacauuuaccaauauggaagcucaacucaucagacagauggagggcgagggggugcugagcaaggccgaucuggaaaacccucaccuccuggagaaaaagauuacacaguggcuugaaaccaaaggcgucgagcggcugaagcgcauggcgaucucuggagacgauugcgugguuaaacccaucgacgauagauucgccaaugcucuccuggcccuuaacgacaugggcaaggugcggaaggauauuccccaguggcaaccuuccaaaggguggcaugacuggcagcaggucccguuuuguagccaccacuuccaugaacugaucaugaaggauggacgcaaacucgugguccccugcagaccucaggacgagcugauuggccgggcucgcaucucucaaggggccggauggucccugaaggagacggcuugucucggcaaagccuacgcgcagauguggagccugauguauuuccacagacgggaucuuagacuggccucuaacgcuauuugcuccgccgugcccguucauugggugccuacaagccgcaccaccugguccauccacgcccaucaccaguggaugacaaccgaagacaugcucacagucuggaaucggguguggauugaggacaaccccuggauggaagauaagacgccuguuaccacaugggaggacgugcccuaccuggggaagagagaggaucaaugguguggcagccuuaucggacugaccucucgcgcuacaugggcccagaauauccucaccgcgauucagcagguccggagccugaucggcgacgaagaguuucuggauuauaugccguccaugaaaagauuccgcaaggaagaggaaucugagggggcuauuugguga

SEQ ID NO: 20880 - RNA, 9873 nt, Artificial Sequence
  derived and/or modified CDS sequence (opt5) from DENV-3__KJ622195__SS-prME
accagccugugccucaugaugaugcugcccgccacccuugcuuuccaccugacgucccgggacggcgaaccucggaugaucguggggaagaacgaacgcggaaagucucuccuguuuaagaccgccagcggcauuaauauguguacccuuaucgcgauggaucugggggaaaugugcgacgauaccgucacauacaaguguccgcucauugcugaaguugaacccgaagacaucgauugcugguguaaccugaccuccacaugggugaccuauggaacgugcaaucaggccggcgagcaucggcgggacaagcgcucuguggcccuggcuccucacgucgggaugggacucgauacccggacacaaaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuauggcuaugagauguguuggagugggcaaccgggacuuugucgaagggcugagcggagccacauggguggaugugguccuggagcauggcgggugcguuaccaccauggcuaagaauaaacccacacucgacaucgagcugcagaagacggaagccacccaacuugcgacacugcgcaaacucuguauugagggaaagaucaccaacauuacaaccgauuccagaugcccuacgcagggcgaagccauccugccggaggaacaggaccagaauuauguguguaaacacacauacguggaucggggcugggggaacggaugcggccuuuucgggaagggaagccuggugacaugcgcuaaguuucaaugucucgagucuauugagggcaaagugguucagcacgaaaaucugaaguauaccgugacaaucaccguccauacaggggaccagcaccaggugggaaacgacacgcaaggcguuaccgccgagaucacaccccaggcuuccaccguggaagccauucugccugaguacggcacacucgggcuggaaugcagcccccgcaccggacuugauuucaaugagaugauccugcucacgaugaaaaacaaggccuggaugguccauagacagugguuuuucgaccugccucuucccuggaccucuggcgcuauuacagagaccccgacauggaaucggaaagaacugcucgugaccuuuaagaacgcgcacgccaaaaagcaagaggucgugguucuggggucccaggaaggagcuaugcacacggcccugacaggcgccaccgagauccagaauagcgggggcacaucuauuuucgcuggacaucucaagugucgccugaaaauggauaaacuugaacugaaaggcauguccuaugccaugugccucaacaccuuugugcugaagaaagaggucagcgagacccagcacgggacaauccugaucaagguggaauacaagggagaggacgcgccuuguaaaauucccuucuccacggaagauggccaagggaaggcucauaacggaagacuuaucaccgccaauccuguugugaccaagaaggaggagcccgucaacauugaagccgagcccccuuucggcgaaucuaauaucgugauugggaucggcgacaaagcucucaagaucaacugguacaagaaaggaagcuccauuggcaagauguuugaggccaccgcuagaggggccagacgcauggcgauccugggagauacagccugggacuucggcagcgucggcgggguucucaauucucucgggaaaaugguccaccagauuuuuggguccgcuuauaccgcccuguucggcggagugagcuggaucaugaagauuggcaucggggugcuucugacguggauuggacucaacucuaaaaauacaagcauguccuuuucuugcaucgucaucggcauuaucacccuguaccuggggaccgugguucaggcugauaugggaugugugauuaacuggaagggcaaggaacuuaaaugcgggagcggcaucuucgucacaaaugaggugcauaccuggacagagcaguauaaguuucaagccgacuccccgaaacggcucgcgacggccauugcuggagccugggaaaacggcguuugugggaucagaagcaccacacgcauggagaaucugcuguggaagcagaucgcuaacgaacucaauuacauucugugggagaacaauaucaaacuuaccguggucgugggagauauuaucggcguucuggaacaggggaagcggacacucacaccccagccuauggagcugaaauauucuuggaagacguggggaaaggccaaaauugugaccgccgagauccaaaacuccagcuucaucauugacggccccaacacaccugaaugccccucugcuuccagagcguggaaugucugggagguggaagacuacggcuuugggguguucaccacaaacaucuggcugaaacuucgcgaggucuauacccagacaugugaucaccggcucaugagcgccgcuauuaaagacgaaagagccguucacgccgauaugggauacuggaucgagucccagaagaauggcucuuggaaacuggagaaggcuagcuuuauugaagugaagaccugcacguggccgaaaucccauacacuguggucuaacggggugcucgagagcgacaugaucaucccuaagucccuggccggacccauuagccagcacaaucaucgcccuggcuaccacacccaaaccgcggggcccuggcaccuuggaaaacuggaacucgauuucaacuauugcgagggcacaaccgucgugaucacggagaauuguggcacacgggggccuucucugagaaccacaaccguuuccggaaagcugauucaugaauggugcugucgcagcugcacacuucccccgcuccgguacaugggcgaggacggguguugguauggaauggaaaucagaccuauuaacgagaaagaagagaauauggugaagucucuggucuccgcuggcagcgggaagguggauaacuuuaccaugggaguucugugccucgccauccuguucgaggaagugaugcggggcaaauucggcaagaaacacaugauugccgggguccuucugacguuuaugcuccugcugucuggacagaucaccuggcgcgacauggcucauacacuuaucaugauuggcagcaaugccuccgauagaauggggaugggagugaccuaccuggcgcucaucgcuacauucaagauucagcccuuucuggcccucggcuucuuucugcggaaacuuaccagcagagagaaccugcuccuggggguuggacuggccauggcuacgacacuucaacugcccgaagacaucgagcagauggccaauggcauugcucucggccugauggcccucaagcugaucacccaguucgaaacauaucagcuuuggaccgcgcuggugucucucaccuguuccaacacaaucuuuacgcugaccgucgccuggcgcacagcuacccugauucuugccggggugagccugcucccugugugccaauccucuagcaugcggaagacagauuggcugccggucgcuguugccgccaugggagugcccccucucccccuguucaucuuuucccuuaaagacacccugaagagacgcucuuggccucugaaugagggcgugauggcugucgggcucgugagcauucuggcguccucucuucugagaaacgauguucccauggccggaccucucguggcuggcgggcugcucaucgccuguuacgucauuacgggaacaagcgccgaccugaccguggagaaagcugccgacguuaccugggaagaggaagcggagcagacaggcgugucccacaaccuuaugaucaccgucgaugacgauggcacaaugcggaucaaggacgaugaaacggagaauauucugaccgugcugcucaaaacagcucugcuuaucgucagcgggauuuuccccuauucuaucccggccacccugcucguguggcauacauggcagaagcagacccaacgcuccggaguucugugggacgugccuucucccccugagacgcagaaagccgaacucgaggaaggcgucuacagaauuaagcagcaggggaucuuuggaaagacccaagugggcguuggggugcagaaagagggagucuuccacacaauguggcacgugacccggggcgcugugcugacacauaacggcaagcgccuugagcccaauugggccuccguuaaaaaggaucugauuuccuacgggggaggcuggagacugagcgcgcaguggcaaaaaggggaagagguccaggugaucgcuguggaaccgggacggaacccuaagaauuuucagaccaugcccggcaucuuccagacaacgaccggggagauuggagccaucgcccucgacuucaagccuggcacaucuggcucccccauuaucgaucgcgaagggaaagucgugggacuguauggcaacgggguugugaccaagaauggaggcuacgucagcgggauugcucaagccaacgcugagcccgacggcccuaccccggagcuugaagaggaaauguuuaaaaagagaaaucugacaaucauggaucuccaccccggauccggcaaaacgcggaaguaucugccugccaucgugcgcgaggcgauuaagagacggcucagaacccugauccuugcccccacacgcguuguggcugccgaaauggaggaggcucugaaagggcugccuauucgguaccagaccacagccaccaagagcgaacauacgggaagagagaucgucgaccucaugugccacgccacauucaccaugcgccugcuuucucccgugcggguuccuaacuauaaucugauuaucauggaugaagcucauuuuaccgacccggcgagcaucgccgcuagaggcuacauuuccacacgcguggggaugggagaggccgccgcuaucuucaugaccgccacacccccuggcaccgcggaggcuuuuccccagucuaacgccccuauucaggacgaggagcgggauauccccgaaagaagcuggaauagcgggaacgaguggauuacggacuucgucggcaaaacagugugguuugugccgucuaucaaggccggaaaugauauugcuaacugucuccgcaaaaacggcaagaaggucauccaacugagccggaaaaccuucgacacagaauaucagaagaccaaacugaaugauugggacuuuguugugacgaccgauaucuccgagaugggggccaacuucaaggcggacagagugauugauccucggcgcugccucaaacccgucauccuuacagacggacccgagagagugauucuggccggcccuaugcccguuaccgcugccucugcugcccagcggcgcgggagagugggacggaauccucagaaggaaaacgaucaauacaucuuuacaggccagccgcugaauaacgacgaggaccacgcucacuggaccgaagccaagaugcuccuggauaauauuaacacacccgaggggaucaucccugcgcuuuucgaacccgagagagagaaaagcgccgcuauugacggcgaauaccgccugaagggagagucccggaaaaccuucgucgaacucaugagacgcggcgaucugccuguguggcuggcccauaagguugcuagcgaggggaucaaauauacggaccggaaguggugcuuugauggagaaagaaauaaccagauucucgaggagaauauggacguggaaaucuggacaaaagagggcgaacgcaagaaacuucggcccagauggcuggaugcccgcaccuacucuaacccgcuggcccucaaagaguucaaggacuuugcugcggggagaaaauccauugcccuggaucuugucaccgaaaucggacgggugccuagccaccuggcucaucgcacaagaaaugcccucgacaaccuggucaugcugcacaccucugagcacggcggccgggccuaucgccaugcuguggaggaacuccccgagacaauggaaacgcuucugcugcucgggcugaugauccuucugaccggaggcgccaugcuguuccugauuuccgggaagggaaucggcaaaacaagcauugggcugaucuguguuauuguguccucuggaaugcucuggauggcggaugugccucuucaguggaucgccagcgcuauuguccuggaguuuuucaugaugguucugcucauccccgagccugaaaagcaaagaacaccccaggacaaucagcuggccuacguggugaucggcauucuuacacuggcugccaucgucgcggccaacgagaugggccuccuggaaaccacgaagcgggaucuggggauguccaaagagccgggagugguuagcccuaccucuuaucucgacguggaccuucaccccgcuuccgccuggacacuguacgcugucgccaccacagugauuacccccaugcugagacauacgaucgaaaauagcacagcuaacgucucucucgccgcgauugccaaccaagcugugguucugaugggccuugauaagggguggccuaucagcaaaauggaccugggagugccgcuccuggcccugggcugcuauucccaggucaauccccucacccuuacagcugccgugcugcugcucguuacccacuacgccaucauugggccuggacugcaggcgaaggcuacccgcgaggcccagaaacggacagcugccggcaucaugaagaaccccacgguggauggcauuaugaccaucgaccuugauccugucauuuacgacucuaaguuugagaaacaacugggacaggugaugcuccuggugcugugugccguucagcuccuucugaugagaacaagcugggcucugugcgaagcccucacccuggcgacaggacccaucaccacgcuuugggagggcuccccugggaaguucuggaauacaaccaucgccgucucuauggcuaacauuuuucgcggaagcuaucuggccggcgcugggcucgccuucuccaucaugaaaagcgugggaaccggcaagcggggcacagggucucagggagaaacccugggcgagaaauggaagaagaaacugaaucaacucuccagacgggaauuugagcuuuacaagaaaagcgggauuacagagguggaucgcacggaagcgaaggagggacugaaaagaggcgaaaccacacaucacgccgucucccgggggucugcuaagcugcagugguucguugagcgcaacauggugaucccggaaggaagagugauugaccucggcuguggcagagggggauggagcuauuacugcgccggccugaaaaaggucaccgaggugcgcggguauacaaagggaggccccgggcacgaggaaccuguucccauguccaccuacggauggaauacggugaaacuuaugucuggcaaggaugucuuuuaucugccucccgagaaaugugacacccuccugugcgauaucggcgaaagcuccccgagcccuacaguggaggagucuagaaccauucggguucugaagaugguggaacccuggcucaaaaacaaucaguucuguaucaagguccuuaaccccuacaugccuacagugaucgagcaucuggaacgccugcagagaaagcacgggggaaugcucgugcggaauccccuguccagaaacagcacccaugagauguacuggauuucuaauggcacagggaacaucgucuccagcguuaauauggugucucgccuucugcucaaccgguucaccaugacgcacagacgcccuacaauugaaaaagacguggaucugggagcuggcacccggcacgucaacgccgagccggagacccccaauauggacgugaucggggaaagaauuaagcgcaucaaagaggaacauagcuccacauggcacuaugacgaugagaacccuuacaagacgugggcuuaucauggaucuuacgaaguuaaagccaccggcagcgcguccagcaugaucaauggcguggucaagcugcucacaaagcccugggacgugguuccuauggugacccaaauggccaugacagauaccacacccuuugggcagcagcgggucuucaaagagaagguggacaccagaacgccgcgcccuaugcccggaacccggaaaguuauggagauuacagcugaauggcuguggagaacccuuggccgcaacaagcggccuagacugugcacacgcgaggaauuuaccaaaaaggugagaacgaaugccgcuaugggggccgucuucacagaggaaaaccaaugggaguccgcccgggcggcuguggaggaugaagaguuuuggaagcucgucggacgcgaaagagagcugcacaaacuuggcaagugugggucuugcguguauaauaugaugggcaaacgggagaagaaacugggagaguucggcaaggccaaagggagcagagccaucugguacauguggcucggagcucgguaucuggaguuugaagcccugggcuuccucaacgaggaccauugguuuucccgcgaaaauucuuacagcgggguugagggagagggccugcacaaacuuggguacauucugagagauaucuccaagauucccggcggagcuauguaugccgacgauaccgcgggcugggacacacggaucaccgaagaugaccuccacaacgaggagaagaucacgcagcagauggacccugagcaucgccagcuggccaaugcuauuuucaaacuuaccuaccaaaacaaaguggucaaggugcagagacccacaccgaaagggaccgugauggauaucauuucucggaaggaccagcgcggaagcggccagguugggacauauggacugaauaccuuuacaaacauggaagcccaacucaucagacagauggagggcgagggggugcuguccaaggcugaucuggaaaauccucaccuccuggagaaaaagauuacccaguggcuugaaacgaaaggcgucgagcggcugaagcgcauggccaucagcggagacgauugcgugguuaaacccaucgacgauagauucgcgaacgcccuccuggcucuuaacgacaugggcaaggugcggaaggauauuccccaguggcaaccuucuaaaggguggcaugacuggcagcaggucccguuuuguucccaccacuuccaugaacugaucaugaaggauggacgcaaacucgugguccccugcagaccucaggacgagcugauuggccgggcccgcaucagccaaggggcuggauggucucugaaggagacagccugucucggcaaggcuuacgcccagauguggucccugauguauuuccacagacgggaucuuagacuggcgagcaaugccauuugcucugcugugcccguucauugggugccuaccucccgcaccacauggagcauccacgcccaucaccaguggaugaccacagaagacaugcucacggucuggaaccggguguggauugaggacaaucccuggauggaagauaagaccccuguuacaaccugggaggacgugcccuaccuggggaagagagaggaucaaugguguggcucccuuaucggacugacaagccgcgccaccugggcucagaacauccucacggccauucagcagguccggucucugaucggcgacgaagaguuucuggauuauaugccgagcaugaaaagauuccgcaaggaagaggaauccgagggggcgauuugguga

SEQ ID NO: 20881 - RNA, 9873 nt, Artificial Sequence
  derived and/or modified CDS sequence (opt5) from DENV-3__KJ622196__SS-prME
accagccugugccucaugaugaugcugcccgccacccuugcuuuccaccugacgagccgggacggcgaaccucggaugaucguggggaagaacgaacgcggaaagucucuccuguuuaagaccgccagcggcauuaauauguguacccuuaucgcgauggaucugggggaaaugugcgacgauaccgucacauacaaguguccgcucauugcugaaguugaacccgaagacaucgauugcugguguaaccugaccuccacaugggugaccuauggaacgugcaaucaggccggcgagcaucggcgggacaagcgcucuguggcccuggcuccucacgucgggaugggacucgauacccggacacaaaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuauggcuaugagauguguuggagugggcaaccgggacuuugucgaagggcugagcggagccacauggguggaugugguccuggagcauggcgggugcguuaccaccauggcuaagaauaaacccacacucgacaucgagcugcagaagacggaagccacccaacuugcgacacugcgcaaacucuguauugagggaaagaucaccaacauuacaaccgauuccagaugcccuacgcagggcgaagccauccugccggaggaacaggaccagaauuauguguguaaacacacauacguggaucggggcugggggaacggaugcggccuuuucgggaagggaagccuggugacaugcgcuaaguuucaaugucucgagucuauugagggcaaagugguucagcacgaaaaucugaaguauaccgugacaaucaccguccauacaggggaccagcaccaggugggaaacgacacgcaaggcguuaccgccgagaucacaccccaggcuuccaccguggaagccauucugccugaguacggcacacucgggcuggaaugcagcccccgcaccggacuugauuucaaugagaugauccugcucacgaugaaaaacaaggccuggaugguccauagacagugguuuuucgaccugccucuucccuggaccucuggcgcuauuacagagaccccgacauggaaucggaaagaacugcucgugaccuuuaagaacgcgcacgccaaaaagcaagaggucgugguucuggggucccaggaaggagcuaugcacacggcccugacaggcgccaccgagauccagaauagcgggggcacaucuauuuucgcuggacaucucaagugucgccugaaaauggauaaacuugaacugaaaggcauguccuaugccaugugccucaacaccuuugugcugaagaaagaggucagcgagacccagcacgggacaauccugaucaagguggaauacaagggagaggacgcgccuuguaaaauucccuucuccacggaagauggccaagggaaggcucauaacggaagacuuaucaccgccaauccuguugugaccaagaaggaggagcccgucaacauugaagccgagcccccuuucggcgaaucuaauaucgugauugggaucggcgacaaagcucucaagaucaacugguacaagaaaggaagcuccauuggcaagauguuugaggccaccgcuagaggggccagacgcauggcgauccugggagauacagccugggacuucggcagcgucggcgggguucucaauucucucgggaaaaugguccaccagauuuuuggguccgcuuauaccgcccuguucggcggagugagcuggaucaugaagauuggcaucggggugcuucugacguggauuggacucaacucuaaaaauacaagcauguccuuuucuugcaucgucaucggcauuaucacccuguaccuggggaccgugguucaggcugauaugggaugugugauuaacuggaagggcaaggaacuuaaaugcgggagcggcaucuucgucacaaaugaggugcauaccuggacagagcaguauaaguuucaagccgacuccccgaaacggcucgcgacggccauugcuggagccugggaaaacggcguuugugggaucagaagcaccacacgcauggagaaucugcuguggaagcagaucgcuaacgaacucaauuacauucugugggagaacaauaucaaacuuaccguggucgugggagauauuaucggcguucuggaacaggggaagcggacacucacaccccagccuauggagcugaaauauucuuggaagacguggggaaaggccaaaauugugaccgccgagauccaaaacuccagcuucaucauugacggccccaacacaccugaaugccccucugcuuccagagcguggaaugucugggagguggaagacuacggcuuugggguguucaccacaaacaucuggcugaaacuucgcgaggucuauacccagacaugugaucaccggcucaugagcgccgcuauuaaagacgaaagagccguucacgccgauaugggauacuggaucgagucccagaagaauggcucuuggaaacuggagaaggcuagcuuuauugaagugaagaccugcacguggccgaaaucccauacacuguggucuaacggggugcucgagagcgacaugaucaucccuaagucccuggccggacccauuagccagcacaaucaucgcccuggcuaccacacccaaaccgcggggcccuggcaccuuggaaaacuggaacucgauuucaacuauugcgagggcacaaccgucgugaucacggagaauuguggcacacgggggccuucucugagaaccacaaccguuuccggaaagcugauucaugaauggugcugucgcagcugcacacuucccccgcuccgguacaugggcgaggacggguguugguauggaauggaaaucagaccuauuaacgagaaagaagagaauauggugaagucucuggucuccgcuggcagcgggaagguggauaacuuuaccaugggaguucugugccucgccauccuguucgaggaagugaugcggggcaaauucggcaagaaacacaugauugccgggguccuucugacguuuaugcuccugcugucuggacagaucaccuggcgcgacauggcucauacacuuaucaugauuggcagcaaugccuccgauagaauggggaugggagugaccuaccuggcgcucaucgcuacauucaagauucagcccuuucuggcccucggcuucuuucugcggaaacuuaccagcagagagaaccugcuccuggggguuggacuggccauggcuacgacacuucaacugcccgaagacaucgagcagauggccaauggcauugcucucggccugauggcccucaagcugaucacccaguucgaaacauaucagcuuuggaccgcgcuggugucucucaccuguuccaacacaaucuuuacgcugaccgucgccuggcgcacagcuacccugauucuugccggggugagccugcucccugugugccaauccucuagcaugcggaagacagauuggcugccggucgcuguugccgccaugggagugcccccucucccccuguucaucuuuucccuuaaagacacccugaagagacgcucuuggccucugaaugagggcgugauggcugucgggcucgugagcauucuggcguccucucuucugagaaacgauguucccauggccggaccucucguggcuggcgggcugcucaucgccuguuacgucauuacgggaacaagcgccgaccugaccguggagaaagcugccgacguuaccugggaagaggaagcggagcagacaggcgugucccacaaccuuaugaucaccgucgaugacgauggcacaaugcggaucaaggacgaugaaacggagaauauucugaccgugcugcucaaaacagcucugcuuaucgucagcgggauuuuccccuauucuaucccggccacccugcucguguggcauacauggcagaagcagacccaacgcuccggaguucugugggacgugccuucucccccugagacgcagaaagccgaacucgaggaaggcgucuacagaauuaagcagcaggggaucuuuggaaagacccaagugggcguuggggugcagaaagagggagucuuccacacaauguggcacgugacccggggcgcugugcugacacauaacggcaagcgccuugagcccaauugggccuccguuaaaaaggaucugauuuccuacgggggaggcuggagacugagcgcgcaguggcaaaaaggggaagagguccaggugaucgcuguggaaccgggacggaacccuaagaauuuucagaccaugcccggcaucuuccagacaacgaccggggagauuggagccaucgcccucgacuucaagccuggcacaucuggcucccccauuaucaaccgcgaagggaaagucgugggacuguauggcaaugggguugugaccaagaacggaggcuacgucagcgggauugcucaagccaaugcugagcccgauggcccuaccccggagcuugaagaggaaauguuuaaaaagagaaaccugacaaucauggaccuccaccccggauccggcaaaacgcggaaguaucugccugccaucgugcgcgaggcgauuaagagacggcucagaacccugauccuugcccccacacgcguuguggcugccgaaauggaggaggcucugaaagggcugccuauucgguaccagaccacagccaccaagagcgaacauacgggaagagagaucgucgaucucaugugccacgccacauucaccaugcgccugcuuucucccgugcggguuccuaauuauaaccugauuaucauggacgaagcucauuuuaccgauccggcgagcaucgccgcuagaggcuacauuuccacacgcguggggaugggagaggccgccgcuaucuucaugaccgccacacccccuggcaccgcggaggcuuuuccccagucuaaugccccuauucaggacgaggagcgggacauccccgaaagaagcuggaacuccgggaaugaguggauuacggauuucgucggcaaaacagugugguuugugccgucuaucaaggccggaaacgacauugcuaacugucuccgcaaaaauggcaagaaggucauccaacugagccggaaaaccuucgauacagaauaucagaagaccaaacugaacgacugggauuuuguugugacgaccgacaucuccgagaugggggccaauuucaaggcggauagagugauugacccucggcgcugccucaaacccgucauccuuacagauggacccgagagagugauucuggccggcccuaugcccguuaccgcugccucugcugcccagcggcgcgggagagugggacggaacccucagaaggaaaaugaccaauacaucuuuacaggccagccgcugaacaaugaugaggaccacgcucacuggaccgaagccaagaugcuccuggacaacauuaauacacccgaggggaucaucccugcgcuuuucgaacccgagagagagaaaagcgccgcuauugauggcgaauaccgccugaagggagagucccggaaaaccuucgucgaacucaugagacgcggcgaccugccuguguggcuggcccauaagguugcuagcgaggggaucaaauauacggaucggaaguggugcuuugacggagaaagaaacaaucagauucucgaggagaacauggauguggaaaucuggacaaaagagggcgaacgcaagaaacuucggcccagauggcuggacgcccgcaccuacucuaauccgcuggcccucaaagaguucaaggauuuugcugcggggagaaaauccauugcccuggaccuugucaccgaaaucggacgggugccuagccaccuggcucaucgcacaagaaacgcccucgauaaucuggucaugcugcacaccucugagcacggcggccgggccuaucgccaugcuguggaggaacuccccgagacaauggaaacgcuucugcugcucgggcugaugauccuucugaccggaggcgccaugcuguuccugauuuccgggaagggaaucggcaaaacaagcauugggcugaucuguguuauuguguccucuggaaugcucuggauggcggacgugccucuucaguggaucgccagcgcuauuguccuggaguuuuucaugaugguucugcucauccccgagccugaaaagcaaagaacaccccaggauaaccagcuggccuacguggugaucggcauucuuacacuggcugccaucgucgcggccaaugagaugggccuccuggaaaccacgaagcgggaccuggggauguccaaagagccgggagugguuagcccuaccucuuaucucgauguggaccuucaccccgcuuccgccuggacacuguacgcugucgccaccacagugauuacccccaugcugagacauacgaucgaaaacagcacagcuaacgucucucucgccgcgauugccaaucaagcugugguucugaugggccuugacaagggguggccuaucagcaaaauggaucugggagugccgcuccuggcccugggcugcuauucccaggucaacccccucacccuuacagcugccgugcugcugcucguuacccacuacgccaucauugggccuggacugcaggcgaaggcuacccgcgaggcccagaaacggacagcugccggcaucaugaagaaucccacgguggacggcauuaugaccaucgaucuugacccugucauuuacgauucuaaguuugagaaacaacugggacaggugaugcuccuggugcugugugccguucagcuccuucugaugagaacaagcugggcucugugcgaagcccucacccuggcgacaggacccaucaccacgcuuugggagggcuccccugggaaguucuggaacacaaccaucgccgucucuauggcuaauauuuuucgcggaagcuaucuggccggcgcugggcucgccuucuccaucaugaaaagcgugggaaccggcaagcggggcacagggucucagggagaaacccugggcgagaaauggaagaagaaacugaaccaacucuccagacgggaauuugagcuuuacaagaaaagcgggauuacagagguggaccgcacggaagcgaaggagggacugaaaagaggcgaaaccacacaucacgccgucucccgggggucugcuaagcugcagugguucguugagcgcaauauggugaucccggaaggaagagugauugaucucggcuguggcagagggggauggagcuauuacugcgccggccugaaaaaggucaccgaggugcgcggguauacaaagggaggccccgggcacgaggaaccuguucccauguccaccuacggauggaacacggugaaacuuaugucuggcaaggacgucuuuuaucugccucccgagaaaugugauacccuccugugcgacaucggcgaaagcuccccgagcccuacaguggaggagucuagaaccauucggguucugaagaugguggaacccuggcucaaaaauaaccaguucuguaucaagguccuuaaucccuacaugccuacagugaucgagcaucuggaacgccugcagagaaagcacgggggaaugcucgugcggaacccccuguccagaaauagcacccaugagauguacuggauuucuaacggcacagggaauaucgucuccagcguuaacauggugucucgccuucugcucaaccgguucaccaugacgcacagacgcccuacaauugaaaaagauguggaccugggagcuggcacccggcacgucaaugccgagccggagacccccaacauggaugugaucggggaaagaauuaagcgcaucaaagaggaacauagcuccacauggcacuaugacgacgagaauccuuacaagacgugggcuuaucauggaucuuacgaaguuaaagccaccggcagcgcguccagcaugaucaacggcguggucaagcugcucacaaagcccugggaugugguuccuauggugacccacauggccaugacagacaccacacccuuugggcaacagcgggucuucaaagagaagguggauaccagaacgccgcgcccuaugcccggaacccggaaaguuauggagauuacagcugaauggcuguggagaacccuuggccgcaauaagcggccuagacugugcacacgcgaggaauuuaccaaaaaggugagaacgaacgccgcuaugggggccgucuucacagaggaaaaucagugggaguccgcccgggcggcuguggaggacgaagaguuuuggaagcucgucggacgcgaaagagagcugcauaaacuuggcaagugugggucuugcguguauaacaugaugggcaaacgggagaagaaacugggagaguucggcaaggccaaagggagcagagccaucugguacauguggcucggagcucgguaucuggaguuugaagcccugggcuuccucaaugaggaucacugguuuucccgcgaaaacucuuacagcgggguugagggagagggccugcacaaacuuggguacauucugagagacaucuccaagauucccggcggagcuauguaugccgaugacaccgcgggcugggauacacggaucaccgaagacgaucuccauaaugaggagaagaucacgcaacagauggacccugagcaccgccagcuggccaacgcuauuuucaaacuuaccuaccagaauaaaguggucaaggugcaaagacccacaccgaaagggaccgugauggacaucauuucucggaaggaucagcgcggaagcggccagguugggacauauggacugaacaccuuuacaaauauggaagcccagcucaucagacaaauggagggcgagggggugcuguccaaggcugaccuggaaaacccucaucuccuggagaaaaagauuacccaguggcuugaaacgaaaggcgucgagcggcugaagcgcauggccaucagcggagaugacugcgugguuaaacccaucgaugacagauucgcgaacgcccuccuggcucuuaaugauaugggcaaggugcggaaggacauuccccaguggcagccuucuaaaggguggcacgauuggcaacaggucccguuuuguucccaccauuuccacgaacugaucaugaaggacggacgcaaacucgugguccccugcagaccucaggaugagcugauuggccgggcccgcaucagccagggggcuggauggucucugaaggagacagccugucucggcaaggcuuacgcccaaauguggucccugauguauuuccauagacgggaccuuagacuggcgagcaacgccauuugcucugcugugcccguucacugggugccuaccucccgcaccacauggagcauccaugcccaccaccaguggaugaccacagaagauaugcucacggucuggaaucggguguggauugaggacaaccccuggauggaagacaagaccccuguuacaaccugggaggaugugcccuaccuggggaagagagaggaccagugguguggcucccuuaucggacugacaagccgcgccaccugggcucaaaauauccucacggccauucagcagguccggucucugaucggcgaugaagaguuucuggacuauaugccgagcaugaaaagauuccgcaaggaagaggaauccgagggggcgauuugguga

SEQ ID NO: 20882 - RNA, 9873 nt, Artificial Sequence
  derived and/or modified CDS sequence (opt5) from DENV-3__KJ830751__SS-prME
acaagccugugccucaugaugauccugcccgccgcucuugccuuccaccugacaucccgggacggcgagccucggaugauuguggggaagaaugaacgcggaaagucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucauguugggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggugauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccgugggccagcggcgcuacaaccgaaacaccuaccuggaaucggaaagagcuucuggugacguuuaagaacgcgcacgccaaaaagcaagaagucgugguucucgggucucaggagggagcuaugcacacagcccugaccggcgccacagaaauccaaaauuccgggggcaccagcauuuucgcuggacaucugaagugucgccucaaaauggacaagcuggagcuuaaaggcaugucuuacgccaugugcaccaacacauuugugcugaagaaagaggucuccgaaacgcagcacgggaccauccucaucaagguggaguacaagggagaagaugcgcccuguaaaauuccuuucagcacagaggacggccaagggaaggcucauaacggaagacugaucaccgccaaucccguugugaccaagaaggaggaacccgucaacauugaggccgaaccuccguucggcgaguccaauaucgugauugggaucggcgauaacgcucugaaaaucaauugguauaagaagggaucuagcauuggcaaaauguuugaagccaccgcuagaggggccagacgcauggcgauccuuggagacacggccugggauuucggcuccgucgggggaguucucaacagccugggcaagaugguccaccagauuuuugggucugcuuacacagcccuguucuccggcgugagcugggugaugaaaaucggaauuggcguccuccugaccuggaucgggcuuaauucuaagaacaccagcauguccuuuucuugcauugcuaucggaaucauuacacuguaucucggcgccgugguucaggcggacauggggugugugaucaauuggaaaggaaaggagcugaagugcggcagcgggauuuucgucaccaacgaggugcauacauggacggaacaguacaaauuucaagccgauucccccaagcggcuggcuaccgccaucgcuggcgccugggagaauggaguuuguggcauuagaagcacaacccgcauggaaaaccuucucuggaaacagaucgccaaugagcugaacuauauccugugggaaaauaacauuaagcucacaguggucgugggggacaccaucggaguucuggagcagggcaaacggacgcuuaccccucagcccauggagcugaaguacucuuggaaaacaugggggaaggcuaagauugugaccgcggaaacacaaaacuccagcuucaucauugauggaccuaauacccccgagugcccgucugccuccagagcuuggaacgucugggaaguggaggacuauggcuuuggcguguucacaaccaauaucuggcucaaacugcgcgaagucuacacgcagcugugugaccaccggcuuaugagcgccgccguuaaggaugagagagcugugcacgccgacaugggguacuggaucgagucccagaaaaacggaucuuggaagcucgaaaaagcgagccugauugaggugaagacaugcaccuggccuaagucccauacccuguggucuaauggcguccucgaaagcgauaugaucauucccaaaucccuggcugggccuaucagccagcacaacuaucgccccggauaccauacacaaaccgccggcccuuggcaccuugggaagcuggagcucgacuuuaauuauugcgagggaacgacagugguuauuaccgaaucuuguggcacacggggccccucccugagaaccacaaccgugagcgggaaacugauccacgaguggugcugucgcucuugcacgcuuccgccucuccgguacaugggagaagauggcuguugguaugggauggagaucagacccauuuccgaaaaggaggagaacauggucaaaagccuggugucugccggaagcggcaagguugacaauuucaccaugggggugcugugccucgcuauccuguacgaagaggucaugcggggaaaguuuggcaaaaagcauaugauugccggcguguucuucacauuuguucuucugcucuccgggcagaucaccuggcgcaacauggcgcacacacugauuaugaucggaagcaaugcuucugauagaaugggcaugggggugaccuaucuggcccuuauugccacguucaaaauccagcccuuucuggcucucggauucuuucugcggaagcucacauccagagaaaaccugcuucugggcgucgggcucgccauggcuaccacacugcaacugccugacgauaucgagcagauggccaauggaauugcgcuuggccugauggcccucaaacugaucacccaguucgaaaccuaccagcucuggacagcucuggugagccuuacguguuccaacaccauguuuacacugaccguggccuggcgcacagcuacccucauucuggccggcgucucucugcuuccgguuugccaaagcuccucuaugcggaagacggacuggcugcccauggccguggcugcgaugggggugccuccccucccucuguucaucuuuaaucucaaggauacacugaaaagacgcagcuggccccuuaacgagggagucauggccgugggccugguuuccauucuggcuucuagccuccugagaaacgacgugccuauggccgggccccuugucgccggaggccugcucaucgcuuguuacgugaucaccgggaccuccgccgaucugacaguugagaaggcggcugacgugaccugggaagaggaagccgagcagacaggagucagccauaaucucaugauuacgguggacgaugacggcaccaugcggaucaaagaugacgaaauugagaacauccugacaguccuucugaagaccgcccugcucauugugucuggcaucuucccguauuccaucccugcuacacugcuuguuuggcacaccuggcagaaacagacgcaacgcagcggggugcugugggauguccccucuccucccgagacccagaaggccgaacucgaggaaggaguguacagaauuaaacagcagggcaucuuugggaagacacaaguuggagugggcguccagaaggaggggguguuccauaccauguggcacgugacacggggagcgguucugacccacaauggcaaacgccucgagccgaacugggcuuccgucaagaaagaccugauuagcuauggcgggggauggagacuuucugcccaguggcaaaagggcgaagagguccaggugaucgccgucgaaccugggaaaaaucccaagaacuuucagacaaugccuggaacguuccagaccacaaccggcgagauuggggcuaucgcccuggauuucaagcccggaaccuccggcagccccauuaucaaucgggaaggcaaagugguugggcuguacggaaacggcguggucacaaagaaugggggauauguguccggcaucgcucaaacgaacgccgagccugacgggccgacccccgagcucgaagaggaaauguuuaaaaagcgcaaucugacaauuauggaucuucauccuggcagcggaaaaaccagaaaguaccugcccgcgaucguucgggaggccauuaagcgcagacuccggacacugauccucgcuccuaccagaguggucgccgcugaaauggaggaggcccugaaaggccuucccauucgcuaucagacgacagccaccaagucugaacacaccgggcgggagaucguggaccugaugugccaugcuacauucaccaugagacugcucagcccuguucgcgugccgaacuacaaucugaucauuauggaugaagcgcacuuuacagaccccgccuccaucgcugcccggggauacauuucuaccagagucggcaugggggaggccgcugccaucuucaugacggcgacaccucccggaaccgcugaugccuuuccucagagcaacgcccccauucaggacgaggaacgcgacaucccggagcgguccuggaacucuggcaacgaauggaucacagauuucgcugggaaaaccgugugguuugugccuagcauuaaggccggcaacgacaucgcgaauugucuucgcaaaaacggaaagaaggucauucaacuguccagaaaaacguucgauaccgaguaucagaagacaaaacucaaugacugggauuuuguugugaccacagacaucucugaaaugggcgccaacuucaaggcugaucgggugauugaccccagacggugccugaaacccgucauccugaccgaugggccugagcgcgugauucucgccggacccaugccuguuacagcugccagcgcugcccagagacggggccgcguggggagaaauccgcagaaggagaacgaccaauacaucuuuaccggacagccccuuaauaacgaugaagaccaugcgcacuggacggaggccaagaugcugcuggacaauaucaacacaccugaaggcauucuccccgcucuguucgagccugaacgggagaaauccgccgcuaucgauggggaguauagacuuaagggcgaaagccgcaaaaccuucgucgagcugaugcggagaggagaccuccccguguggcuggcccacaagguugccucugaaggcauuaaauacaccgaucgcaaguggugcuuugacgggcagcggaauaaccagauccuggaggaaaauauggauguggagauuuggacaaaagagggagaaaagaagaaacucagaccgcgcuggcuugacgcucggaccuauuccgauccucuggcgcugaaggaguucaaagacuuugccgcuggcagaaagagcaucgcccucgaucuggucacagaaaucgggcgcgugcccucucaucuugcccacagaacgcggaacgcucuggacaaucucgucaugcugcauaccuccgagcacggaggccgcgccuacagacacgcgguggaggaacugccugagacaauggaaacccuccuucugcugggccucaugauucugcuuacagggggagccaugcuguuccucaucagcggcaaagggauuggaaagaccuccaucggccugauuuguguuaucgcuucuagcgggaugcuguggauggccgaggugccccuccaauggaucgcuuccgccauugugcuugaauuuuucaugaugguccugcugaucccugagcccgagaagcagcggacgccgcaggauaaccaacucgcguauguugugauuggaauccugacccuugccgcuauuaucgccgcuaaugaaaugggccugcucgagacaaccaaacgcgaccugggcaugagcaaggaaccugggguggucucucccacauccuaccuggauguggaccuccaucccgccagcgcuuggacccuuuacgccguugcgacgacagugauuaccccuaugcugagacacacaaucgagaacucuaccgccaacgucagccuggcugccaucgcuaaucaggccgugguccucaugggacuggacaaaggcuggccgauuuccaagauggaucuuggggugccccugcucgcccugggaugcuauucucagguuaacccucugacccucacagcggcugugcuucugcugaucacgcauuacgccauuaucggccccgggcuccaggcuaaagccacccgggaagcccaaaagagaacagcugccggaauuaugaagaauccuaccgucgacggcaucaugacaaucgaucuggaccccgugauuuaugauagcaaauuugagaagcagcuuggccagguuaugcugcucgugcugugugcgguccagcugcuccuuaugcgcaccuccugggcccugugcgaggcucugacgcucgccacagggccuaucaccacccugugggaaggaucuccgggcaaauucuggaacacaaccauugcugugagcauggccaauaucuuucggggguccuaccuugcgggagccggccuggcuuucagcauuaugaagucuguggggacaggaaaaagaggcacgggcucccaaggggagacccucggagaaaaguggaagaaaaagcugaaccagcugagccgcaaagaguuugaccucuauaagaaauccggcaucacagaaguugaucggaccgaggccaaggaggggcuuaaaagaggagaaacaacccaccaugcugucucucggggcagcgccaagcugcagugguucguggagcgcaauauggugguccccgaagggagaguuaucgaccugggauguggccggggcgggugguccuacuauugcgcuggacucaagaaagugacggaggugcgcggcuacaccaaagggggaccuggccacgaggaacccgucccuaugucuacauacggguggaacauugugaaacugaugagcggaaaggaugucuuuuaucuucccccggagaaaugugacacccugcucugcgauaucggcgaauccagcccuucucccacaguggaggaauccagaaccauucggguccugaagaugguggagcccuggcugaagaauaaccaguucuguaucaaaguucucaauccuuacaugcccacagugauugagcaccuugaacgccugcaaagaaagcauggcgggaugcugguccggaacccucucagccgcaauucuacccacgagauguauuggaucuccaacggaacgggcaauauugugagcucugugaacauggucagcagacugcuucugaaccgguucacaaugacccauagacgcccgaccaucgaaaaagacguugaucucggggccggaacacggcacgugaaugcggagcccgaaacgccuaacauggacgugaucggcgagagaauuaagcgcaucaaagaggaacacaauuccaccuggcauuacgacgaugagaaccccuauaagacaugggccuaccacgggucuuaugaagucaaggcuaccggaagcgccuccagcaugauuaauggcgugguuaaacugcugacaaagccuugggacgugguccccauggugacccagauggcuaugacagauaccacgccguuuggccagcaacggguuuucaaagagaagguggacaccagaacaccucgccccaugccugggacccggaaagucauggaaaucacagccgaguggcucuggagaacccugggacgcaacaagcggcccagacuuugcacgcgcgaggaauuuacaaagaaagugcggaccaaugccgcgaugggcgcuguuuucacagaggaaaaccagugggauuccgccaaggccgcuguggaggacgaagaguuuuggaaacuggucgauagagagcgcgaacuccauaagcuggggaaauguggaucuugcguguacaauaugaugggcaagagagagaagaaacuuggggaguucggcaaagccaaaggaagccgggcuauuugguacauguggcugggcgcccgcuaucucgaguuugaggcgcugggguuccugaacgaagaccacugguuuuccagagaaaauucuuacagcggagucgaaggcgaggggcuccauaagcugggauauauccuucgggauaucuccaaaauuccuggcggggccauguacgcugacgauaccgccggcugggacacgagaaucaccgaagacgaucugcacaacgaggagaagauuauccagcagauggaccccgaacaccggcaacucgcuaaugccauuuucaaacugacauaucagaacaaggugguuaaggugcagcgcccgaccccuacaggaaccgucauggauaucaucucuagaaaagaccagcggggcagcgggcaagugggaacauacggccuuaauaccuuuacgaacauggaggcgcagcuggugcgccagauggaaggggagggaguucucacaaaggccgaucuggaaaacucccaucugcccgagaaaaagauuacccaguggcucgagaccaaaggcguggaaagacugaagcggauggcuaucagcggggacgauugcgucgugaagcccauugacgaucgcuucgccaaugcucuuguugcccugaacgacaugggcaaagugagaaaggauaucccucaauggcagccgucucggggauggcacgacuggcagcagguccccuuuuguucccaucacuuccacgagcucauuaugaaagauggccgcaagcugguggucccuugcagaccccaagacgaacuuaucgggcgggcucgcaucagccagggagccggcuggucucugagagagacagcgugucucgggaaagccuaugcucagauguggucccugauguacuuccaucggcgcgaccugagacucgccagcaaugccauuugcucugcugugccuguucacugggugcccaccucccggacaacguggagcauccaugcccaccaucaauggaugaccacagaagauaugcugaccgucuggaacagaguguggauugaggagaauccuuggauggaagacaagacacccguuaccacgugggagaacgugccguaccuuggaaagcgcgaagaucagugguguggcucccugaucgggcucaccagccgggcgacaugggcucagaauauuccuaccgccauccagcaagucagaucucugauuggcaacgaggaguuucuugacuauaugcccagcaugaaacgcuuccggaaggaagaggaauccgagggagccaucugguga

SEQ ID NO: 20883 - RNA, 9873 nt, Artificial Sequence
  derived and/or modified CDS sequence (opt5) from DENV-3__KC762681__SS-prME
accagccugugccucaugaugaugcugcccgccacccuugcuuuccaccugacguccagagacggcgaaccucggaugauuguggggaagaaugaacgcgggaagucucuccuguuuaagaccgccagcggcauuaauauguguacccuuaucgcgauggaucugggggagaugugcgacgauaccguuaccuacaaguguccgcucauuaccgaaguugagcccgaagacaucgauugcugguguaaccugacguccaccugggugacguauggaaccugcaaucaggcuggcgagcauagacgggacaagcgcucuguggcccuggccccucacgucgggaugggacucgauacaagaacccagacauggaugagcgcugagggcgccuggcggcaggucgaaaagguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaagcccacccuggacaucgagcuccagaagacagaagccacccaacuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggaguuuaucgagggcaaaguugugcagcacgaaaaucucaaguauaccgucauuaucacagugcauacgggggaccagcaccagguuggaaacgagacccaaggcgugacagccgaaaucacaccccaggcuucuacagucgaggccauucugccugaauacggcacccuggggcucgagugcagcccccgcacgggacuggacuucaaugagaugauccuucugaccaugaaaaacaaggcuuggauggugcauagacagugguuuuucgaucucccucugcccuggacaagcggcgccaccacagaaaccccgacguggaauaaaaaggagcuucuggucacauuuaaaaacgcccacgcuaagaagcaagaagugguugugcucgggucucaggagggagcgaugcacaccgcccugacaggcgcuaccgaaauucagaccuccgggggcacaagcaucuucgccggacaucugaaaugucggcucaagauggacaaacuggagcuuaagggcaugucuuaugccaugugccugaaugcuuucguccucaaaaaggagguguccgaaacgcagcacgggaccauucugaucaagguugaguacaaaggagaagaugccccuuguaagauccccuuuagcacagaggacggccaagggaaagcgcauaacggacgccugauuaccgcuaacccuguggucacaaagaaagaggaacccgugaauaucgaggccgaacccccuuucggcgaguccaacauugugaucgggauuggcgauaaggcccuuaagaucaauugguacaaaaagggaucuagcaucggcaaaauguuugaagcuaccgccagaggggcucggagaauggccauucucggagacacggcgugggauuucggcuccguugggggaguccugaacagccugggcaagauggugcaccagaucuuugggucugccuauacagcucucuucuccggcgugagcuggauuaugaaaaucggaauuggcguccugcuuaccuggaucgggcucaauucuaagaacaccagcauguccuuuucuugcauugugaucggaaucauuacacucuaccugggcgccguugugcaggcugacauggggugugucaucaauuggaagggaaaagagcugaagugcggcagcgggauuuucgugaccaacgagguucauacauggacggaacaguauaaauuucaagccgauuccccgaagcgccuugcgaccgccaucgcuggcgccugggagaauggaguguguggcauucggagcacaaccagaauggaaaaccuccuguggaaacagaucgcuaaugagcugaacuacauccucugggaaaauaacauuaagcugacagucgugguuggggacaucauuggagugcuugagcagggcaaacgcacccugacgccccagccuauggaucucaaguauucuuggaagaccugggggaaagccaagaucgucacagccgagacccaaaauuccagcuucauuaucgacggacccaacacaccugaaugccccucugcuucccgggcguggaacgugugggagguggaagacuacggcuuuggcgucuucaccacaaauaucuggcugaaacugagagagauguauacccagcuuugugaucaccgccucaugagcgccgcuguuaaggacgaacgggccgugcacgccgauaugggguacuggauugagucccagaaaaacggaucuuggaagcuggagaaggcuagccugaucgaagugaaaacgugcacauggccgaagucccauacccucuggucuaauggcguccuggagagcgacaugauuaucccuaaaucccuugccgggcccgugagccagcacaacuacagaccuggauaucauacccaaacagcgggccccuggcaccuggggaagcucgaacuggauuuuaauuacugcgagggaaccacgguugugauuacagagaacuguggcacccgcggcccuucucugcggacaaccacagucuccgggaaacuuauccacgaauggugcuguagaagcugcacccugcccccgcugcgcuauaugggagaggacggcuguugguacgggauggaaauccggccuauuaaugagaaggaagagaacauggugaagucucugguuuccgcuggaagcggcaaaguggauaauuucacgauggggguccucugccuggccauccuuuucgaggaagugaugagaggaaaguuuggcaaaaagcauaugauugccggcguucuguucaccuuugugcuccugcugucugggcagaucacauggcgggacauggcucgcacccuuauuaugaucggaagcaacgccuccgauagaaugggcaugggggucacauaucuggcgcucauugcuaccuucaaaauccagcccuuucuggcccucggauucuuucugcggaaacuuacgagcagagagaaucugcuccugggcguggggcuggccauggcuacaacccuucaacugcccgaagacaucgagcagauggccaacggaauugcucucggccugauggcccucaagcugaucacacaguucgaaaccuaccagcuuuggaccgcgcuggugucucucauguguuccaauacaauguuuacgcugaccgucgccuggcgcacagcuacccugauucuugccggcaucagccugcucccuguuugccaauccucuagcaugcggaaaacagauuggcugccggugaccguggcugccaugggggugcccccucucccccuguucaucuuuucccuuaaggacacgcugaaaagacgcucuuggccucugaacgagggagugauggccguuggccucgugagcauccuggcuuccucucuucugagaaaugauguccccauggcggggccucucguggccggaggccugcucaucgcuuguuauguuauuacagggaccagcgccgaccugaccguggagaaggccgcugacgucaucugggaagaggaagccgagcagacaggagugucccacaaccuuaugauuaccgucgaugacgauggcacaaugcggaucaaagacgaugaaacggagaacauucugaccgugcugcucaagacagcgcugcuuaucguuagcggcaucuuccccuacucuauuccggcuacccugcucguguggcauacauggcagaaacagacccaacgcuccgggguccugugggacgugccuucucccccugagacgcagaaggccgaacucgaggaaggaguuuacagaaucaagcagcagggcauuuuugggaaaacccaagugggagucggcgugcagaaggaggggguguuccacacaauguggcauguuacccggggagccguccugacacacaauggcaaacgccuugagcccaacugggcuuccgugaagaaagaucugaucuccuauggcgggggauggagacugagcgcccaguggcaaaagggcgaagaggugcaggucauugcgguggaaccggggaagaauccuaaaaacuuccagaccaugcccggaaucuuucagacaacgaccggcgagauuggggcuaucgcccucgacuucaagccuggaacaucuggcucccccaucauuaaucgggaaggcaaaguuguggggcuguacggaaacggcgucgugaccaagaaugggggauauguuagcggcaucgcccaaaccaacgcugagcccgaugggccuacaccggagcuugaagaggaaauguuuaaaaagcgcaaucugacgauuauggaccuccaccccggcuccggaaagaccagaaaauaccugccugccaucgugcgggaggcuauuaagcgcagacuccggacacugauccuugcccccaccagagucguggcggccgaaauggaggaggcucugaaaggccugccuauccgcuaucagacaaccgccacaaagagcgcucauacagggaaagaaauuguugaucucaugugccacgccaccuucaccaugcggcugcuuucucccgugagagucccuaacuacaaucugaucauuauggacgaggcccauuuuacagauccggcuagcaucgcggcccgcggauauauuuccacccgggugggcaugggggaagcugccgccaucuucaugacagcuacacccccuggaacggccgacgcguuuccccagucuaacgcuccuauccaggacgaggaaagagauauucccgagcgcagcuggaacuccggcaacgaguggaucacagacuucgccgggaagaccgugugguuugucccgucuauuaaggccggcaaugauaucgcuaacugucuccggaaaaacggaaagaaaguuauucaacugagcagaaagacauucgacaccgaauaccagaaaacgaagcugaaugauugggacuuuguggugaccacagauaucuccgagaugggcgccaacuucaagaccgaccgcgucauugauccucggagaugccucaaacccgugauccuuacagacgggcccgaacggguuauccuggcgggaccuaugcccgugaccgucgccucugcugcccagcgcagaggccggguggggcgcaauccucagaaggagaacgaucaauacauuuucacaggacagccgcugaauaacgacgaggaccacgcucauuggaccgaagccaaaaugcuccuggauaauaucaacacgcccgagggcauuaucccugcucuuuuugaacccgagagagaaaagagcgccgcgauugacggggaguaucggcugaaaggcgaguccagaaagacauucguugaacucaugcgccggggagaucugccuguguggcuggcccacaaagucgcuagcgagggcaucaaguacaccgacagaaaguggugcuuugauggggaacgcaauaaccagauccucgaggaaaauauggacguggagauuuggaccaaagagggagaaaagaagaaacuucggcccagauggcuggaugcccgcacauauucugacccgcuggcucucaaagaguucaaagauuuugccgccggccggaaguccaucgcucuggaccuugucaccgaaauugggagagugccuagccaccuggcgcaucgcacaagaaacgcccucgauaaucugguuaugcugcacacgucugagcauggaggccgggcuuaccgccacgccguggaagaacuccccgagaccauggaaacacuucugcugcucggccugaugauccuucugaccgggggagccaugcuguuccugauuuccggcaaagggaucggaaagacaagcaucggccugauuuguguggucgcuuccucugggaugcucuggauggccgacguuccucuucaguggaucgcgagcgccauugugcuggaguuuuucaugauggugcugcucauccccgaaccugagaaacaaagaacaccccaggauaaccagcuggcuuaugucgugauuggaauccuuacgcuggccgcuauuguugccgcgaaugagaugggccuccuggaaaccacaaagcgggaccugggcauguccaaagagccggggguggucagcccuaccucuuaccucgacguggaucuucaccccgccuccgcuuggacacuguaugccgucgcuaccacggugaucacacccaugcugcgccauaccaucgaaaacagcacagccaauguuucucucgcugccauugcgaaccaagccgugguccugaugggacuugacaagggcuggccuaucagcaagauggaucugggggugccgcuccuggcucugggaugcuacucccagguuaacccccucacccuuaccgccgcugugcugcugcucgucacacacuacgccauuaucggcccugggcugcaggccaaagcgacgagagaggcucagaagcggaccgccgcuggaauuaugaaaaaucccacaguggacggcaucaugaccaucgaucuugacccugugauuuaugauucuaaguuugaaaaacaacugggccagguuaugcuccugguccugugugccgugcagcuccuucugaugagaacaagcugggccuucugcgaggcucugacccucgccacggggcccaucacaacccugugggagggauccccuggcaaguuuuggaacaccacaauugcggugucuauggccaauaucuuccgcgggagcuaccuugcuggagccggccuggcuuuuuccauuaugaaaagcgucgggaccggaaaacggggcacaggcucucagggggaaacgcucggagagaaguggaaaaagaaacugaaccaacuguccagaaaggaguucgaccucuauaaaaagagcggcaucaccgagguugaucgcacagaagccaaggaggggcuuaaacggggagagaucacccaucacgcgguguccagaggcucugccaagcugcagugguucguggaacggaauauggucauuccggaggggcgcgugaucgaccugggauguggcagaggcggguggagcuacuauugcgcuggacucaaaaagguuacagaagugcggggcuacaccaaagggggacccggccaugaggaaccuguccccauguccacguauggguggaacauugugaagcugaugucuggaaaggaugucuuuuaccuuccucccgagaaaugugacacccugcucugcgauaucggcgagagcuccccgagcccuacaguggaagagucucgcaccauuagaguccugaagaugguggaacccuggcugaaaaauaaccaguucuguaucaaggugcucaaucccuacaugccuacagucauugagcaccuugagcggcugcagcgcaaacacggcgggaugcugguuagaaacccccucucccggaauagcacccaugaaauguauuggaucucuaacggaacaggcaauaucguguccagcgugaacauggucucucgccugcuucugaauagauuuaccaugacgcaccggagaccuacaauugagaaggacguggaccucggggccggaacccgccauguuaacgcugaaccggagacccccaacauggaugugaucggcgaacggauuagacgcaucaaggaggagcacagcuccacauggcacuacgacgaagagaauccuuauaaaacgugggccuaccaugggucuuaugaagucaaggcuaccggaagcgccuccagcaugauuaacggcgugguuaaacugcugacaaagcccugggauguggucccuaccgugacacaaauggcgaugaccgacacaacccccuucggccagcagcggguuuuuaaagagaagguggauacgagaaccccgcgcccuaugcccgggacacggaaggccauggaaaucaccgcugaguggcucuggagaacacugggacgcaauaaacggccuagacuuugcacccgcgaggaguucacgaagaaaguccggacaaacgccgcuaugggcgccguguuuaccgaggaaaaucaaugggacuccgccagagcggcugucgaggaugaagaguucuggaagcugguggaccgcgagagagaacuccacaaacuggggaaguguggaucuugcguuuacaacaugaugggcaaacgggagaagaaacuuggggaauuuggcaaagccaagggaagccgcgccaucugguauauguggcugggcgcuagauaccucgaguucgaggcccugggguuucugaaugaagaucauugguucucccgggagaacucuuuuagcggaguggaaggcgaggggcuccacaaacugggauacauucuuagagacaucuccaagauucccggcggggcuauguaugccgaugacacagcgggcugggacacccggaucacggaagaugaccugcauaaugaggagaaaauuacccagcagauggauccugaacaccgccagcucgccaacgcuaucuucaagcugacauaccaaaauaaggucgugaaagugcagagacccaccccgaagggaacaguuauggacaucauuucucggaaagaucagcgcggcagcggacaggugggaaccuauggccuuaacacauucaccaauauggagguccaacugaucagacagauggaaggggagggagugcucuccaaggccgaccuggaaaacccucaccuccucgagaaagagauuacgcaguggcuggaaacaaagggcguugagcggcuuaagcgcauggcuaucagcggggaugacugcguggucaaacccauugaugacagauuugccgaugcgcugcucgcccugaaugacaugggcaaggugcggaaagauaucccccaguggcaaccuucuaagggauggcaugacuggcagcaggucccguucuguucccaccauuuucacgaacuuaucaugaaagacggccgcaagcuggugguucccugcagaccucaggaugagcucauugggcgggcucgcaucagccaaggagccggcuggucucugaaggaaaccgcuugucuggggaaagccuacgcucagaugugggcccucauguauuuccacagacgggaccugcgccuugcguccaacgccauuugcagcgcugugcccguccauugggugccuaccucuagaacaaccugguccauccacgcccaucaccaguggaugacaacggaggauaugcugaccguuuggaaccggguguggauugaggacaaucccuggauggaagauaagacaccugucaccacaugggaggacgugcccuaccucggaaaaagagaagaucaaugguguggcagccugaucgggcuugccucccgcgcuaccugggcccagaacauucugacggcgauccaacaggugcggagccucaucggcaaugaggaguuucuggacuauaugccgucuaugaagagauuccgcaaagaagaggaaagcgagggagcuauuugguga

SEQ ID NO: 20884 - RNA, 9873 nt, Artificial Sequence
  derived and/or modified CDS sequence (opt5) from DENV-3__KC762684__SS-prME
accagccucugccucaugaugaugcugcccgccacccuugcuuuccaccugacgucccgggacggcgaaccucggaugauuguggggaagaacgaacgcggaaagucucuccuguuuaagaccgccagcggcauuaauauguguacacuuaucgcgauggaucugggggagaugugcgacgauaccgugacauacaaauguccgcucauuaccgaaguugagcccgaagacaucgauugcugguguaaccugacauccaccugggugacguauggaaccugcaaucaggcuggcgagcauagacgggacaagcgcucuguggcccuggccccucacguugggaugggacucgauacaagagcucaaaccuggaugagcgccgagggcgcuuggagacagguggaaaaaguugagacaugggccuuccgccaucccggcuuuaccauucuggcgcuuuuccuggcccacuacaucgggacgucccucacacagaaggugguuaucuuuauucugcuuaugcuggugaccccuucuaugacaaugagauguguuggagugggcaaccgggacuucguggaagggcucagcggagcuaccuggguggaugugguccuggagcauggcgggugcguuaccacaauggccaagaauaaacccacgcuggacaucgagcuccagaagaccgaagcuacacaacuggccacccuucgcaaacuguguauugagggaaagaucacaaacgugaccacggauuccagaugcccuacacagggcgaagcgauucucccggaggaacaggaccagaauuauguguguaaacacaccuacgucgaucggggcugggggaacggaugcggccuguuugggaagggaagccuugugaccugcgccaaguuccaaugucuggagcucaucgagggcaaaguugugcagcacgaaaaucugaaguauacagucucuauuaccgugcauacaggggaccagcaccagguuggaaacgagacgcaaggcgugaccgcugaaaucacaccccaggccuccaccgucgaggcuauccugccugaauacggcacacucgggcuggagugcagcccccgcaccggacuugacuuuaaugagaugauucugcucacgaugaaaaacaaggccuggauggugcauagacagugguucuuugaucugccucuucccuggaccucuggcgccacaaccgaaacaccgaccuggaauaaaaaggagcugcucgucacguucaaaaacgcucacgcgaagaagcaagaagugguugugcuggggucccaggagggagccaugcacacagcucugaccggcgccacagaaauccagaccagcgggggcaccucuauuuuugccggacaucucaaaugucggcugaagauggacaaacuugagcugaagggcauguccuaugcuaugugcagcaaugccuucguccucaaaaaggagguguccgaaacacagcacgggacgauccugauuaagguugaguacaaaggagaagaugcgccuuguaagauccccuucucuaccgaggacggccaagggaaagcucauaacggacgccugaucacagccaacccuguggucaccaagaaagaggaacccgugaauauugaggccgaacccccuuuuggcgagagcaacaucauuaucgggauuggcgauaaggcucuuaagaucaauugguacaaaaagggauccagcaucggcaaaauguucgaagccacagcuagaggggcccggagaauggcgauucucggagacaccgccugggauuuuggcucugucggcgggguucugaacucccuggggaagaugguccaccagaucuucgggagcgcuuauacggcccucuuuucuggcgugagcuggauuaugaaaaucggaauuggcgugcugcuuacauggaucgggcucaauagcaagaacaccucuaugagcuucuccugcauugucaucggaaucauuacccucuaccugggcgcugugguucaggccgacauggggugugugaucaauuggaagggaaaagagcugaagugcggcagcgggauuuuugucacaaacgaggugcauaccuggacagaacaguauaaauuccaagcggauucuccgaagcgccuugccacggcuaucgccggcgcuugggagaauggaguuuguggcauucgguccaccacaagaauggaaaaccuccuguggaaacagaucgccaaugagcugaacuacauccucugggaaaauaacauuaagcugaccguggucgugggggacaucauuggaauccuugagcagggcaaacgcacacugacaccccagccuauggagcucaaguauagcuggaagacgugggggaaagccaagauuguuaccgcugaaaugcaaaauucuuccuuuaucaucgauggacccaacacaccugagugccccaacgcgagccgggccuggaaugugugggaagucgaggacuacggcuucggcguguuuaccacaaacauuuggcugaaacugagagaaauguauacccagcuuugugaccaccgccucauguccgcugccaucaaggaugagcgggccgugcacgcugacaugggguacuggauugagucucagaaaaauggaagcuggaagcuggaaaaggccucccugaucgaggucaaaacaugcaccuggccgaagucucauacgcucuggagcaacggcguucuggaauccgauaugauuaucccuaaaagccuugcggggcccaucucucagcacaauuacagaccuggauaucauacacaaaccgcuggccccuggcaccuggggaagcucgagcuggacuucaacuacugcgagggaaccacaguggugauuaccgaaaauuguggcacgcgcggcccuucccugcggacaaccacagucagcgggaaacuuauccacgaguggugcuguagaucuugcacccugcccccgcugcgcuauaugggagaagauggcuguugguacgggauggagauucggccuaucaacgaaagagaggagaauauggugaagucccugguuagcgccggaucuggcaagguggacaacuuuacaauggggguccucugccuggccauucuuuucgaagaggugaugcggggaaaauucggcaagaaacauaugaucgcuggcgucuuuuucaccuuugugcugcuccugagcgggcagauuacguggcgcgauauggccagaacccugaucaugaucggauccaaugcgagcgaccggaugggcaugggggucacauaucuugcucugauugccaccuucaagauccagcccuuucucgcccugggauucuuucucagaaaacugacaucucgcgaaaaccuucugcucggcguggggcuggcuauggccaccacgcugcaacuucccgaggauauugaacagauggcuaauggaaucgcccugggccucauggcgcugaagcucguuacacaguucgagaccuaccagcuguggacagcccuugugucccugauguguagcaacaccauuuuuacccucacagucgcuuggcggacggccacccugauccuggcuggcaucucccuucugccucucugccaaucuagcgggaugagaaagacagacuggcugccgaugaccguggccgccaugggagugcccccucucccccuguucaucuuuucccuuaaagauacacugaagcgcagaucuuggccucugaaugagggcgucauggcuguugggcucgugagcauccuggcguccucucuucugcggaacgacgugcccauggccggaccucucgucgcuggcgggcugcucauugccuguuaugugaucaccggaacgagcgccgaucugacaguugaaaaagcugccgacgugaccugggaggaagaggcggaacagaccggcgucucccacaaccuuaugauuacaguggacgaugacggcaccaugcgcaucaaggaugacgagacagagaauauccugacgguucugcucaaaaccgcucugcuuauugugagcgggaucuuccccuacucuauuccggccacacugcucgucuggcauaccuggcagaagcagacacaaagauccggagugcugugggaugucccuucucccccugaaacccagaaagccgagcucgaagagggcguguaccggaucaagcagcaggggauuuuuggaaagacgcaaguuggcguggggguccagaaagagggaguguuccacaccauguggcauguuacacgcggcgcugugcugaccuauaacggcaagagacuugaacccaauugggccuccgucaaaaaggaccugaucuccuacgggggaggcuggcggcugagcgcgcaguggcaaaaaggggaggaaguccaggugauugcuguugagccgggaaagaacccuaagaauuuccagacaaugcccggcaucuuucagaccacaacgggggaaaucggagccauugcccucgauuucaaaccuggcaccucuggcucccccaucauuaaccgcgaggggaaggucgugggacuguauggcaaugggguggucaccaagaauggaggcuacgugagcgggaucgcucaaaccuccgccgagcccgacggcccuaccccggaacuugaggaagagauguuuaagaaaagaaaucugacaauuauggaucuccaccccggaagcggcaagacgcggaaguaucugccugcuaucguucgcgaagccaucaaaagacggcucagaacccugauucuugcgcccacacgcguggucgccgcugagauggaggaagcccugaaggggcugccuauccgguaccagaccacagcuaccaaaucugagcacacgggaaaggaaauuguggaccucaugugccaugccacauucaccaugagacugcuuagccccguucgcgugccuaacuauaaucugaucauuauggaugaggcccacuuuaccgacccggcuuccaucgcggcccggggcuacaucucuacaagagucgggaugggagaagcugccgccauuuucaugaccgcuacacccccuggcaccgccgaugcguuuccccagagcaacgcuccuauccaggacgaggagcgcgacauucccgaacgguccuggaacucugggaacgauuggaucacggacuucgccggcaaaacagugugguuuguuccgagcauuaaggccggaaaugauaucgcuaacugucucagaaagaacggcaaaaaggugauucaacugucccgcaaaaccuucgacacagaguaccagaagaccaaacugaaugauugggacuuugucgugacgaccgauaucucugaaaugggggccaacuucaaggcggaccgggugaucgauccuagacggugccucaagcccgucauucuuacagacggacccgagcgcguuauccuggccggcccuaugcccgugaccguggcuagcgccgcucagagacgggggcgcgucggaagaaauccucagaaagagaacgaucaauauauuuucacaggccagccgcugaauaacgacgaagaccaugcccacuggaccgaggcuaagaugcuccuggauaauaucaacacacccgaagggauuaucccugcccuuuuugagcccgaacgggagaaauccgcggccaucgacggcgaguacagacugaagggagaaagccgcaaaaccuucguggagcucaugcggagaggcgaucugccuguuuggcuggcucauaagguggccucugaagggauuaaauauacggaccgcaaguggugcuuugauggagagcggaauaaccagauccucgaagagaauauggacgucgagauuuggacaaaggaaggcgagaaaaagaaacuuagaccccgcuggcuggaugcucggaccuacuccgacccgcuggcccucaaggaguucaaagauuuugccgcugggagaaagagcaucgcgcuggaccuugugaccgagauuggacgcguuccuucucaccuggcccacagaacacggaacgcucucgauaaucuggugaugcugcauaccuccgaacacggcggccgcgccuauagacaugccgucgaggagcuccccgaaacaauggagacgcuucugcugcucgggcugaugauccuucugaccggaggcgugaugcuguuccugaucagcgggaagggagucggcaaaacauccauugggcugaucugugugguugcuucuagcuccaugcucuggauggccgacauuccucuucaguggaucgcgagcgccauugugcuggaauuuuucaugauggugcugcucauccccgagccugagaagcaacggacaccccaggauaaccagcuggcuuacgucguuauuggaauccuuacacuggccgcuaucguggccgcgaaugaaaugggccuccuggagaccacgaaacgcgaccugggcaugucuaaggaaccggggguggucuccccuaccagcuaucucgacguggaucuucaccccgccucugcuuggacacuguacgccguugcuaccacagugauuacccccaugcugagacacacgaucgagaacagcacagccaaugucucccucgcugccauugcgaaccaagccgugguccugaugggacuugacaaaggcuggccuaucucuaagauggaucugggggugccgcuccuggcucugggaugcuacagccagguuaacccccucacccuuacagccgcugugcugcugcucgucacccauuaugccauuaucggcccugggcugcaggccaaggcgacccgggaagcucagaaaagaacagccgcuggaaucaugaagaaucccacgguggacggcauuaugaccaucgaucuugacccuguuauuuacgauuccaaauuugagaagcaacugggccaggugaugcuccugguccugugugccgugcagcuccuucugaugcgcacaucuugggccuucugcgaggcucugacccucgccacagggcccaucaccacgcugugggaaggaagcccuggcaaauuuuggaacacaaccauugcgguguccauggccaauaucuuccgggggagcuaucuugcuggagccggccuggcuuuuucuaucaugaaguccguugggaccggaaagagaggcacaggcagccagggggagacccucggagaaaaauggaagaaaaagcugaaccaacugucccgcaaagaguucgaccucuacaagaaaucuggcauuacagaagucgaucggacggaggccaaggaggggcuuaagagaggagaaaucacccaccaugcggugagccggggcuccgccaaacugcagugguucguggagcgcaauauggucauuccggaagggagaguuaucgaccugggauguggccggggcggguggucuuauuacugcgcuggacucaagaaagugacagaggugcgcggcuauaccaaagggggacccggccacgaagaaccuguccccaugagcacauacggguggaacauugugaaacugauguccggaaaggaugucuuuuaccuuccucccgagaagugugacacccugcucugcgauaucggcgaaagcucuccguccccuacgguggaggaaagcagaaccauucggguccugaaaaugguggagcccuggcugaagaauaaccaguucuguaucaaaguucucaaucccuauaugccugccgugaucgagcaucuugaacgccugcagagaaagcacggcgggaugcugguccggaacccccucucucgcaauuccacacacgagauguacuggauuagcaacggaaccggcaauaucgugucuagcgugaacauggucuccagacugcuucugaaucgguuuacaaugaccuauagacgcccuacaauugaaaaagacguugaccucggggcuggaacccggcaugugaacgccgagccggaaacgcccaacauggaugugaucggcgagcgcauuagacggaucaaggaggaacacucuagcacauggcauuacgacgaugagaauccuuauaagaccugggcuuaccacggguccuaugaagucaaagccaccggaagcgcguccucuaugaucaacggcgugguuaagcugcugacaaaacccugggacguggucccuacggugacccaaauggccaugacagauaccacacccuucggccagcagagaguuuuuaaggagaaaguggacacccgcacaccgaagccuaugcccgggacccggaaggucauggaaauuacggcugaguggcucuggagaacccugggacgcaauaaacggccuagacuuugcacacgcgaggaguucaccaagaaagugcggacaaacgccgcuaugggcgccguuuuuaccgaggaaaaucaaugggauagcgccagagcggcuguggaggacgaagaguucuggaagcuggucgaucgcgagagagaacuccacaaacuggggaaguguggauccugcguguacaacaugaugggcaaacgggagaagaaacuuggggaauuuggcaaagccaagggaucucgcgccaucugguacauguggcugggcgcuagauaucucgaguucgaggcccugggguuucugaaugaagaccauugguucagccgggagaacuccuacucuggagucgaaggcgaggggcuccacaaacugggauauauucuuagagauaucagcaagauucccggcggggcuauguacgccgacgacacggcgggcugggauacacggaucaccgaagacgaucugcauaaugaggagaaaaucacacagcagauggacccugaacaccgccagcucgccaacgcuauuuuuaagcugaccuaucaaaauaaggugguuaaagugcagagacccacgccgaagggaaccgucauggauaucauuucccggaaagaccagcgcggcagcggacaggugggaacauacggccuuaacaccuucacaaauauggaggcccaacugaucagacagauggaaggggagggagugcucucuaagaccgaucuggaaaacccucaucugcucgagaaaaagauuacacaguggcuggagaccaagggcguugaacggcuuaaacgcauggcuaucuccggggacgauugcguggucaagcccaucgacgauagauucgccaaugcgcugcucgcccugaacgacaugggcaaagugcggaaggauauuccccaguggcaaccuagcaaaggauggcacgacuggcagcagguuccguuuuguucucaccauuuccacgagcuuaucaugaaggacggccgcaagcuggugguccccugcagaccucaggaugaacucauugggcgggcucgcaucucccaaggagccggcuggagccugaaagagacggcuugucuggggaaggccuaugcucagaugugggcccucauguacuuucauagacgggaccugcgccuugcgucuaacgccauuugcuccgcugugcccguccacugggugccuacaagcagaaccaccugguccauccacgcccaucaccaguggaugacaaccgaagauaugcugacaguuuggaaucggguguggauugaggacaaccccuggauggaggauaaaacgccugucaccacaugggaagacgugcccuaccucggaaagagagaggaucaaugguguggcagccugaucgggcuuaccucucgcgccacaugggcucagaauauccugaccgccauucagcagguucggagccucaucggcaacgaagaguuccuggacuauaugccguccaugaaaagauuucgcaaggaggaagagucugaaggagcgauuugguga

SEQ ID NO: 20885 - RNA, 9873 nt, Artificial Sequence
  derived and/or modified CDS sequence (opt5) from DENV-3__KC762686__SS-prME
accagccucugccucaugaugaugcugcccgccacgcuugcuuuccaccugacgucccgggacggcgagccucggaugaucguggggaagaaugaacgcggaaagucucuccuguuuaagaccgccagcggcauuaauauguguacccuuaucgcgauggaucugggggagaugugcgacgauaccgugacauacaaguguccgcucauuaccgaaguugagcccgaagacaucgauugcugguguaaccugacauccaccugggugacguauggaaccugcaaucaggcuggcgagcauagacgggacaagcgcucuguggcccuggccccucacguggggaugggacucgauacaagagcucagaccuggaugagcgccgagggcgcuuggagacagguggaaaaaguugagacaugggccuuccgccaucccggcuuuaccauucuggcgcuuuuccuggcccacuacaucgggacgucccucacacagaagguggucaucuuuauucugcuuaugcuggugaccccuucuaugacaaugagauguguuggagugggcaaccgggacuucgucgaagggcucagcggagcuaccuggguggaugugguccuggagcauggcgggugcguuaccacaauggccaagaauaaacccacgcuggacaucgagcuccagaagaccgaagcuacacagcuggccacccuucgcaaacuguguauugagggaaagaucacaaacgugaccacggauuccagaugcccuacacagggcgaagcgauucucccggaggaacaggaccagaauuauguguguaaacacaccuacgucgaucggggcugggggaacggaugcggccuguuugggaagggaagccuugugaccugcgccaaguuccaaugucuggaguuuaucgagggcaaaguugugcagcacgaaaaucucaaguauacagucauuaucaccgugcauacaggggaccagcaccagguuggaaacgagacgcaaggcgugaccgcugaaaucacaccccaggccucuaccgucgaggcuauucugccugaauacggcacacuggggcucgagugcagcccccgcaccggacuggacuucaaugagaugauccuucugacgaugaaaaacaaggccuggauggugcauagacagugguuuuucgaucucccucugcccuggaccagcggcgccacaaccgaaacaccgaccuggaauaaaaaggagcuucuggucacguuuaaaaacgcucacgcgaagaagcaagaagugguugugcucgggucucaggagggagccaugcacacagcucugaccggcgccacagaaauucagaccuccgggggcaccagcaucuucgccggacaucugaaaugucggcucaagauggacaaacuggagcuuaagggcaugucuuaugcuaugugccugaaugccuucguccucaaaaaggagguguccgaaacacagcacgggacgauucugaucaagguugaguacaaaggagaagaugcgccuuguaagauccccuuuagcaccgaggacggccaagggaaagcucauaacggacgccugauuacagccaacccuguggucaccaagaaagaggaacccaucaauauugaggccgaacccccuuucggcgaguccaacaucgugauugggaucggcgauaaggcucuuaagaucaauugguacaaaaagggaucuagcauuggcaaaauguuugaagccacagcuagaggggcccggagaauggcgauccucggagacaccgccugggauuucggcuccgucgggggaguucugaacagccugggcaagaugguccaccagauuuuugggucugcuuauacggcccucuucuccggcgugagcuggaucaugaaaauuggaaucggcgugcugcuuacauggauugggcucaauucuaagaacaccagcauguccuuuucuugcaucgucaucggaauuaucacccucuaccugggcgcugugguucaggccgacauggggugugugauuaauuggaagggaaaagagcugaagugcggcagcgggaucuucgucacaaacgaggugcauaccuggacagaacaguauaaauuucaagcggauuccccgaagcgccuugccacgaccauugcuggcgccugggagaauggaguuuguggcauccggagcacaaccagaauggaaaaccuccuguggaaacagaucgcuaaugagcugaacuacauucucugggaaaauaacaucaagcugacaguggucgugggggacauuaucggaguucuugagcagggcaaacgcacccugacgccccagccuauggagcucaaguauucuuggaagaccugggggaaagccaagauugugacagccgaaacccaaaauuccagcuucaucaucgauggacccaacacaccugagugccccucugcuucccgggcguggaacgucugggaaguggaggacuacggcuuuggcguguucaccacaaauauuuggcugaaacugagagaaauguauacccagcuuugugaccaccgccucaugagcgccgcugucaaggaugagcgggccguucacgccgacaugggguacuggaucgagucccagaaaaacggaucuuggaagcuggaaaaggcuagccugauugaggugaaaacgugcacauggccgaagucccauacccucuggucuaauggcgugcuggaaagcgauaugaucauuccuaaaucccuugccgggcccgucagccagcacaaccauagaccuggauaccacacccaaacagcgggccccuggcaccuggggaagcucgagcuggacuuuaauuauugcgagggaaccacggugguuaucacagaaaacuguggcacccgcggcccuucucugcggacaaccacaguguccgggaaacuuauccaugaguggugcuguagaagcugcacccugcccccgcugcgcuacaugggagaagauggcuguugguaugggauggagauucggccuaucaaugaaaaggaggagaacauggucaagucucugguguccgcuggaagcggcaaaguugacaauuucacgaugggggugcucugccuggccauucuuuucgaagaggucaugagaggaaaguuuggcaaaaagcacaugaucgccggcgugcuguucaccuuuguucuccugcugucugggcagauuacauggcgggauauggcucgcacccuuaucaugauuggaagcaacgccuccgacagaaugggcaugggggugacauaccuggcgcucaucgcuaccuucaaaauccagcccuuucuggcccucggauucuuucugcggaaacuuacgagcagagaaaaucugcuccugggcgucgggcuggccauggcuacaacccuucaacugcccgaggauauugaacagauggccaacggaaucgcucucggccugauggcccucaagcugauuacacaguucgagaccuaucagcuuuggaccgcgcuggugucucucauguguuccaauacaaucuuuacgcugaccguggccuggcgcacagcuacccugauucuugccggcaucagccugcucccugucugccaauccucuagcaugcggaaaacagacuggcugccgguuaccguggcugccaugggggugcccccucucccccuguucaucuuuucccuuaaggauacgcugaaaagacgcucuuggccucugaacgagggagucauggccgugggccucguuagcauucuggcuuccucucuucugagaaaugacgugcccauggcggggccucucgucgccggaggccugcucaucgcuuguuacgugauuacagggaccagcgccgaucugaccguugaaaaggccgcugacgugaucugggaggaagaggccgaacagacaggagucucccauaaccuuaugauuaccguggacgaugacggcacaaugcggaucaaagaugacgagacggagaacauccugaccguccugcucaagacagcgcugcuuauugugagcggcaucuuccccuauucuauuccggcuacccugcucguuuggcacacauggcagaaacagacccaacgcuccggggugcugugggaugucccuucucccccugaaacgcagaaggccgagcucgaagagggaguguacagaaucaagcagcagggcauuuuugggaaaacccaaguuggagugggcguccagaaggaggggguguuccauacaauguggcacgugacccggggagccguucugacacacaauggcaaacgccuugaacccaacugggcuuccgucaagaaagaccugaucuccuacggcgggggauggagacugagcgcccaguggcaaaagggcgaggaaguccaggugauugcggucgagccggggaagaauccuaaaaacuuccagaccaugcccggaaucuuucagacaacgaccggcgaaaucggggcuauugcccucgauuucaagccuggaacaucuggcucccccaucauuaaucgggagggcaaagugguugggcuguauggaaacggcguggucaccaagaaugggggauacgugagcggcaucgcccaaaccaacgcugagcccgacgggccuacaccggaacuugaggaagagauguuuaaaaagcgcaaucugacgauuauggaucuccaucccggcuccggaaagaccagaaaauaucugccugccaucguucgggaagcuaucaagcgcagacuccggacacugauucuugcccccaccagaguggucgcggccgagauggaggaagcucugaaaggccugccuauccgcuaccagacaaccgccacaaagagcgcucacacagggaaagagauuguggaccucaugugccaugccaccuucaccaugcggcugcuuucucccguuagagugccuaacuauaaucugaucauuauggaugaagcccacuuuacagacccggcuagcaucgcggcccgcggauacaucuccacccgggucggcaugggggaggcugccgccauuuucaugacagcuacacccccuggaacggccgaugcguuuccccagucuaacgcuccuauccaggacgaagagagagacauucccgagcgcagcuggaacuccggcaacgaauggaucacagauuucgccgggaagaccgugugguuugugccgucuauuaaggccggcaaugacaucgcuaacugucuccggaaaaacggaaagaaagucauucaacugagcagaaagacauucgauaccgaguaucagaaaacgaagcugaaugacugggauuuuguugugaccacagacaucuccgaaaugggcgccaacuucaaggcggaucgcgugaucgacccucggagaugccucaaacccgucauucuuaccgaugggcccgagcgggugauccuggccggaccuaugcccguuacaguggcuucugccgcucagcgcagaggccgggucgggcgcaauccucagaaggagaacgaccaauacauuuucaccggacagccgcugaauaacgaugaagaccaugcccacuggacagaggcuaaaaugcuccuggacaauaucaacacccccgaaggcauuaucccugcccuuuuugagcccgaaagagaaaagagcgcggccaucgauggggaguaccggcugaaaggcgaauccagaaagacguucguggagcucaugcgccggggagaccugccuguuuggcuggcucacaaaguggccagcgaaggcauuaaguauacagauagaaaguggugcuuugacggggagcgcaauaaccagauccucgaagagaauauggaugucgagauuuggaccaaagaaggagagaagaagaaacuucggcccagauggcuggacgcucgcaccuacucugauccgcuggcccucaaagaguucaaagacuuugccgcuggccggaaguccaucgcgcuggaucuugugacagagauugggagagucccuagccaucuggcccaccgcaccagaaacgcucucgacaaucuggugaugcugcauacaucugaacacggaggccgggccuaucgccacgccguugaggagcuccccgaaacgauggagacccuucugcugcucggccugaugauccuucugacagggggagcuaugcuguuccugaucuccggcaaagggauuggaaagaccagcaucggccugauuugugugguggccuccucugggaugcucuggauggcggaugucccucuucaguggaucgccagcgcuauuguucuggaauuuuucaugauggugcugcucauccccgagccugagaaacaaagaacaccccaggacaaccagcuggccuacguggucauuggaauccuuacccuggcugccaucguggcggccaaugaaaugggccuccuggagacgaccaagcgggaucugggcauguccaaagaaccggggguugugagcccuacaucuuaucucgacgucgaccuucaucccgcuuccgccuggacccuguacgcuguggccacaaccgucauuacgcccaugcugcgccacacaaucgagaacagcaccgcuaaugugucucucgccgcgauugccaaccaagcuguugugcugaugggacuugauaagggcuggccuaucagcaagauggaccugggggucccgcuccuggcccugggaugcuauucccaggugaacccccucacacuuaccgcugccguucugcugcucgugacccauuacgccauuaucggcccugggcugcaggcgaaagcuacaagagaagcccagaagcggacggcugccggaaucaugaaaaaucccaccgucgauggcauuaugacaaucgaccuugauccugugauuuacgacucuaaguuugagaaacaacugggccaggugaugcuccugguucugugugccguccagcuccuucugaugagaaccagcugggcuuucugcgaggcccugacacucgcgaccgggcccaucacgacacugugggaaggauccccuggcaaguuuuggaacaccaccauugccgugucuauggcuaauaucuuccgcgggagcuaucuugccggagcuggccuggccuuuuccaucaugaaaagcguggggacaggaaaacggggcaccggcucucagggggagacacucggagaaaaguggaaaaagaaacugaaccaacuguccagaaaggaguucgaucucuacaaaaagagcggcauuacggaagucgaccgcaccgaggcgaaggaggggcuuaaacggggagaaaucacacaccaugccguuuccagaggcucugcuaagcugcagugguucguggagcggaauauggugauuccggaagggcgcgucaucgaucugggauguggcagaggcggguggagcuauuacugcgccggacucaaaaaggugaccgagguucggggcuauacaaaagggggacccggccacgaagaaccugugcccauguccaccuacggguggaacauugucaagcugaugucuggaaaggacguguuuuaucuuccucccgagaaaugugauacgcugcucugcgacaucggcgaaagcuccccgagcccuaccguugaggaaucucgcacaauuagagugcugaagauggucgagcccuggcugaaaaauaaccaguucuguaucaaggugcucaaucccuacaugccuaccgugaucgagcaccuugaacggcugcagcgcaaacauggcgggaugcuggucagaaacccccucucccggaauagcacacacgagauguacuggauuucuaacggaaccggcaauaucguuuccagcgugaacauggugucucgccugcuucugaauagauuuacaaugacccaucggagaccuacgauugaaaaggaugucgaccucggggcuggaacacgccacgugaacgccgagccggaaacccccaacauggacguuaucggcgagcggauuagacgcaucaaggaggaacacagcuccaccuggcauuaugaugaggaaaauccuuacaaaacaugggcuuaucacgggucuuacgaggugaaggccacgggaagcgcguccagcaugaucaacggcgucgugaaacugcugaccaagcccugggacguugugccuacagucacccaaauggccaugacagauaccacacccuucggccagcagcggguguuuaaagaaaagguugacaccagaacgccgcgcccuaugcccgggacccggaaggcuauggagauuacagccgaguggcucuggagaacccugggacgcaauaaacggccuagacuuugcacacgcgaagaguucaccaagaaagugcggacgaacgcugccaugggcgccgucuuuacagaagagaaucaaugggauuccgcgagagcugccguggaagacgaggaguucuggaagcuggucgaucgcgaaagagagcuccauaaacuggggaaguguggaucuugcguguauaacaugaugggcaaacgggaaaagaaacuuggggaguuuggcaaagccaagggaagccgcgcuaucugguacauguggcugggcgccagauaucucgaguucgaagcucugggguuucugaaugaggaccacugguucucccgggaaaacucuuuuagcggaguugagggcgaagggcuccauaaacugggauacauucuuagagauaucuccaagauucccggcggggccauguacgcggacgauaccgccggcugggacacacggaucaccgaggacgaucugcacaaugaggagaagaucacgcagcagauggagccugaacaccgccagcucgcuaacgccauuuucaagcugaccuaucaaaauaagguggucaaagugcagagacccacaccgaagggaaccgugauggacaucauuucucggaaagaucagcgcggcagcgggcagguuggaacauacggccuuaacaccuucacaaauauggaggugcaacugaucagacagauggaaggggagggaguccucuccaaggcugaccuggagaacccucaucugcucgaaaaagagauuacccaguggcuggaaacgaagggcguggagcggcuuaagcgcauggccaucagcggggaugacugcguugugaaacccaucgaugacagauuugcggaugcccugcucgcucugaaugacaugggcaagguccggaaagauauuccccaguggcaaccuucuaagggauggcacgacuggcaacaggugccguucuguucccaucacuuucacgaacuuaucaugaaagauggccgcaagcuggucgugcccugcagaccucaggacgagcucauugggcgggcccgcaucagccaaggagcuggcuggucucugaaggagacagccugucuggggaaggcuuaugcccagaugugggcgcucauguacuuccauagacgggaccugcgccuugccuccaacgcuauuugcagcgccguucccgugcacugggucccuaccucuagaaccacaugguccauccaugcccaccaucaguggaugaccacagaagauaugcugacgguguggaaccggguuuggauugaggacaaucccuggauggaagauaagaccccugugacaaccugggaggacguccccuaucucggaaaaagagaggaucaaugguguggcagccugaucgggcuugcuucccgcgccacaugggcgcagaacauccugaccgcuauucaacaggugcggagccucaucggcaaugaagaguuucuggacuacaugccgucuaugaagagauuccgcaaagaagaggaaagcgagggagccauuugguga

SEQ ID NO: 20886 - RNA, 9873 nt, Artificial Sequence
  derived and/or modified CDS sequence (opt5) from DENV-3__KC762685__SS-prME
accagccugugccucaugaugaugcugcccgccacccuugcuuuccaccugacguccagagacggagagccucggaugaucguggggaagaaugaacgcgggaagucucuccuguuuaagaccgccagcggcauuaauauguguacgcuuaucgcgauggaucugggggagaugugcgacgauaccguuaccuacaaguguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagagcucagaccuggaugagcgccgagggcgcuuggcggcaggucgaaaaaguugagacaugggccuuccgccaucccggcuuuaccauucuggcgcuuuuccuggcccacuacaucgggacgucccucacacagaagguggucaucuuuauucugcuuaugcuggugaccccuucuaugacaaugagauguguuggagugggcaaccgggacuucgucgaagggcucagcggagcuaccuggguggaugugguccuggagcauggcgggugcguuaccacaauggccaagaauaaacccacgcuggacaucgagcuccagaagaccgaagcuacacaacuggccacccuucgcaaacuguguauugagggaaagaucacaaacgugaccacggauuccagaugcccuacacagggcgaagcgauucucccggaggaacaggaccagaauuauguguguaaacacaccuacgucgaucggggcugggggaacggaugcggccuguuugggaagggaagccuugugaccugcacaaaguuccaaugucuggaguuuaucgagggcaaaguugugcagcacgaaaaucucaaguauaccgucauuaucacagugcauacgggggaccagcaccagguuggaaacgagacccaaggcgugacagccgaaaucacaccccaggcuucuacagucgaggccauucugccugaauacggcacccuggggcucgagugcagcccccgcacgggacuggacuucaaugagaugauccuucugaccaugaaaaacaaggcuuggauggugcauagacagugguuuuucgaucucccucugcccuggacaagcggcgccaccacagaaaccccgacguggaauaaaaaggagcuucuggucacauuuaaaaacgcccacgcuaagaagcaagaagugguugugcucgggucucaggagggagcgaugcacaccgcccugacaggcgcuaccgaaauucagaccuccgggggcacaagcaucuucgccggacaucugaaaugucggcucaagauggacaaacuggagcuuaagggcaugucuuaugccaugugccugaaugcuuucguccucaaaaaggagguguccgaaacgcagcacgggaccauucugaucaagguugaguacaaaggagaagaugccccuuguaagauccccuuuagcacagaggacggccaagggaaagcgcauaacggacgccugauuaccgcuaacccuguggucacaaagaaagaggaacccgugaauaucgaggccgaacccccuuucggcgaguccaacauugugaucgggauuggcgauaaggcccuuaagaucaauugguacaaaaagggaucuagcaucggcaaaauguuugaagcuaccgccagaggggcucggagaauggccauucucggagacacggcgugggauuucggcuccguugggggaguccugaacagccugggcaagauggugcaccagaucuuugggucugccuauacagcucucuucuccggcgugagcuggauuaugaaaaucggaauuggcguccugcuuaccuggaucgggcucaauucuaagaacaccagcauguccuuuucuugcauugugaucggaaucauuacacucuaccugggcgccguugugcaggcugacauggggugugucaucaauuggaagggaaaagagcugaagugcggcagcgggauuuucgugaccaacgagguucauacauggacggaacaguauaaauuucaagccgauuccccgaagcgccuugcgaccgccaucgcuggcgccugggagaauggaguguguggcauucggagcacaaccagaauggaaaaccuccuguggaaacagaucgcuaaugagcugaacuacauccucugggaaaauaacauuaagcugacagucgugguuggggacaucauuggagugcuugagcagggcaaacgcacccugacgccccagccuauggagcucaaguauucuuggaagaccugggggaaagccaagaucgucacagccgaaacccaaaauuccagcuucauuaucgauggacccaacacaccugagugccccucugcuucccgggcguggaacgugugggaaguggaggacuacggcuuuggcgucuucaccacaaauaucuggcugaaacugagagaaauguauacccagcuuugugaccaccgccucaugagcgccgcuguuaaggaugagcgggccgugcacgccgacaugggguacuggauugagucccagaaaaacggaucuuggaagcuggaaaaggcuagccugaucgaggugaaaacgugcacauggccgaagucccauacccucuggucuaauggcguccuggaaagcgauaugauuaucccuaaaucccuugccgggcccgugagccagcacaacuacagaccuggauaucauacccaaacagcgggccccuggcaccuggggaagcucgagcuggacuuuaauuacugcgagggaaccacgguugugauuacagaaaacuguggcacccgcggcccuucucugcggacaaccacagucuccgggaaacuuauccacgaguggugcuguagaagcugcacccugcccccgcugcgcuauaugggagaagauggcuguugguacgggauggagauccggccuauuaaugaaaaggaggagaacauggugaagucucugguuuccgcuggaagcggcaaaguggacaauuucacgauggggguccucugccuggccauccuuuucgaagaggugaugagaggaaaguuuggcaaaaagcauaugauugccggcguucuguucaccuuugugcuccugcugucugggcagaucacauggcgggauauggcucgcacccuuauuaugaucggaagcaacgccuccgacagaaugggcaugggggucacauaucuggcgcucauugcuaccuucaaaauccagcccuuucuggcccucggauucuuucugcggaaacuuacgagcagagaaaaucugcuccugggcguggggcuggccauggcuacaacccuucaacugcccgaggauaucgaacagauggccaacggaauugcucucggccugauggcccucaagcugaucacacaguucgagaccuaccagcuuuggaccgcgcuggugucucucauguguuccaauacaauuuuuacgcugaccgucgccuggcgcacagcuacccugauccuugccggcauuagccugcucccuguuugccaauccucuagcaugcggaaaacagacuggcugccggugaccguggcugccaugggggugcccccucucccccuguucaucuuuucccuuaaggauacgcugaaaagacgcucuuggccucugaacgagggagugauggccguuggccucgugagcauccuggcuuccucucuucugagaaaugacguccccauggcggggccucucguggccggaggccugcucauugcuuguuauguuaucacagggaccagcgccgaucugaccguggaaaaggccgcugacgucauuugggaggaagaggccgaacagacaggagugucccacaaccuuaugaucaccgucgacgaugacggcacaaugcggauuaaagaugacgagacggagaacauccugaccgugcugcucaagacagcgcugcuuaucguuagcggcauuuuccccuacucuaucccggcuacccugcucguguggcauacauggcagaaacagacccaacgcuccgggguccugugggaugugccuucucccccugaaacgcagaaggccgagcucgaagagggaguuuacagaauuaagcagcagggcaucuuugggaaaacccaagugggagucggcgugcagaaggaggggguguuccacacaauguggcauguuacccggggagccguccugacacacaauggcaaacgccuugaacccaacugggcuuccgugaagaaagaccugauuuccuauggcgggggauggagacugagcgcccaguggcaaaagggcgaggaagugcaggucaucgcgguggagccggggaagaauccuaaaaacuuccagaccaugcccggaauuuuucagacaacgaccggcgaaaucggggcuaucgcccucgauuucaagccuggaacaucuggcucccccauuaucaaucgggagggcaaaguuguggggcuguacggaaacggcgucgugaccaagaaugggggauauguuagcggcauugcccaaaccaacgcugagcccgacgggccuacaccggaacuugaggaagagauguuuaaaaagcgcaaucugacgaucauggaucuccaccccggcuccggaaagaccagaaaauaccugccugccauugugcgggaagcuaucaagcgcagacuccggacacugauccuugcccccaccagagucguggcggccgagauggaggaagcucugaaaggccugccuauucgcuaucagacaaccgccacaaagagcgcucauacagggaaagagaucguugaccucaugugccacgccaccuucaccaugcggcugcuuucucccgugagagucccuaacuacaaucugauuaucauggaugaagcccauuuuacagacccggcuagcauugcggcccgcggauauaucuccacccgggugggcaugggggaggcugccgccaucuucaugacagcuacacccccuggaacggccgaugcguuuccccagucuaacgcuccuauucaggacgaagagagagacauccccgagcgcagcuggaacuccggcaacgaauggauuacagauuucgccgggaagaccgugugguuugucccgucuaucaaggccggcaaugacauugcuaacugucuccggaaaaacggaaagaaaguuauccaacugagcagaaagacauucgauaccgaguaccagaaaacgaagcugaaugacugggauuuuguggugaccacagacauuuccgaaaugggcgccaacuucaaggcggaucgcgucaucgacccucggagaugccucaaacccgugauccuuaccgaugggcccgagcggguuauucuggccggaccuaugcccgugacagucgcuucugccgcucagcgcagaggccggguggggcgcaauccucagaaggagaacgaccaauacaucuucaccggacagccgcugaauaacgaugaagaccacgcccauuggacagaggcuaaaaugcuccuggacaauauuaacacccccgaaggcaucauuccugcccuuuuugagcccgaaagagaaaagagcgcggccaucgauggggaguaucggcugaaaggcgaauccagaaagacguucguugagcucaugcgccggggagaccugccuguguggcuggcucacaaagucgccagcgaaggcaucaaguacacagauagaaaguggugcuuugacggggagcgcaauaaccagauucucgaagagaauauggauguggagaucuggaccaaagaaggagagaagaagaaacuucggcccagauggcuggacgcucgcaccuauucugauccgcuggcccucaaagaguucaaagacuuugccgcuggccggaaguccauugcgcuggaucuugucacagagaucgggagagugccuagccaccuggcccaucgcaccagaaacgcucucgacaaucugguuaugcugcacacaucugaacauggaggccgggccuaccgccacgccguggaggagcuccccgaaacgauggagacccuucugcugcucggccugaugauucuucugacagggggagcuaugcuguuccugaucuccggcaaagggaucggaaagaccagcauuggccugaucuguguggucgccuccucugggaugcucuggauggcggauguuccucuucaguggauugccagcgcuaucgugcuggaauuuuucaugauggugcugcucauucccgagccugagaaacaaagaacaccccaggacaaccagcuggccuaugucgugaucggcauucuuacccuggcugccaucguugcggccaaugaaaugggccuccuggagacgaccaagcgggaucugggcauguccaaagaaccggggguggucagcccuacaucuuaccucgacguggaccuucaccccgcuuccgccuggacccuguaugcugucgccacaaccgugaucacgcccaugcugcgccauacaauugagaacagcaccgcuaauguuucucucgccgcgaucgccaaccaagcugugguccugaugggacuugauaagggcuggccuauuagcaagauggaccugggggugccgcuccuggcccugggaugcuacucccagguuaacccccucacacuuaccgcugccgugcugcugcucgucacccacuacgccaucauuggcccugggcugcaggcgaaagcuacaagagaagcccagaagcggacggcugccggaaucaugaaaaaucccaccguggauggcaucaugacaauugaccuugauccugugaucuaugacucuaaguuugagaaacaacugggccagguuaugcuccugguccugugugccgugcagcuccuucugaugagaaccagcugggcuuucugcgaggcccugacacucgcgaccgggcccauuacgacacugugggaaggauccccuggcaaguuuuggaacaccaccaucgccgugucuauggcuaauauuuuccgcgggagcuaccuugccggagcuggccuggccuuuuccaucaugaaaagcgucgggacaggaaaacggggcaccggcucucagggggagacacucggagaaaaguggaaaaagaaacugaaccaacuguccagaaaggaguucgaucucuauaaaaagagcggcaucacggaaguugaccgcaccgaggcgaaggaggggcuuaaacggggagaaauuacacaucacgccguguccagaggcucugcuaagcugcagugguucguggagcggaauauggucaucccggaagggcgcgugauugaucugggauguggcagaggcggguggagcuacuauugcgccggacucaaaaagguuaccgaggugcggggcuacacaaaagggggacccggccaugaagaaccuguccccauguccaccuauggguggaacaucgugaagcugaugucuggaaaggacgucuuuuaccuuccucccgagaaaugugauacgcugcucugcgacauuggcgaaagcuccccgagcccuaccguggaggaaucucgcacaaucagaguccugaagaugguggagcccuggcugaaaaauaaccaguucuguauuaaggugcucaaucccuacaugccuaccgucaucgagcaccuugaacggcugcagcgcaaacacggcgggaugcugguuagaaacccccucucccggaauagcacacaugagauguauuggaucucuaacggaaccggcaauauuguguccagcgugaacauggucucucgccugcuucugaauagauuuacaaugacccaccggagaccuacgaucgaaaaggauguggaccucggggcuggaacacgccauguuaacgccgagccggaaacccccaacauggacgugauuggcgagcggaucagacgcauuaaggaggaacacagcuccaccuggcacuacgaugaggaaaauccuuauaaaacaugggcuuaccaugggucuuaugaggucaaggccacgggaagcgcguccagcaugaucaacggcgugguuaaacugcugaccaagcccugggacguggucccuacagugacccaaauggccaugacagauaccacacccuucggccagcagcggguuuuuaaagaaaagguggacaccagaacgccgcgcccuaugcccgggacccggaaggcuauggagaucacagccgaguggcucuggagaacccugggacgcaauaaacggccuagacuuugcacacgcgaagaguucaccaagaaaguccggacgaacgcugccaugggcgccguguuuacagaagagaaucaaugggauuccgcgagagcugccgucgaagacgaggaguucuggaagcugguggaucgcgaaagagagcuccacaaacuggggaaguguggaucuugcguuuacaacaugaugggcaaacgggaaaagaaacuuggggaguuuggcaaagccaagggaagccgcgcuauuugguauauguggcugggcgccagauaccucgaguucgaagcucugggguuucugaaugaggaccauugguucucccgggaaaacucuuuuagcggaguggagggcgaagggcuccacaaacugggauacauccuuagagauauuuccaagauccccggcggggccauguaugcggacgauaccgccggcugggacacacggauuaccgaggacgaucugcauaaugaggagaagaucacgcagcagauggagccugaacaccgccagcucgcuaacgccaucuucaagcugaccuaccaaaauaaggucgugaaagugcagagacccacaccgaagggaaccguuauggacauuaucucucggaaagaucagcgcggcagcggacaggugggaacauauggccuuaacaccuucacaaauauggagguccaacugauuagacagauggaaggggagggagugcucuccaaggcugaccuggagaacccucaccuccucgaaaaagagaucacccaguggcuggaaacgaagggcguugagcggcuuaagcgcauggccauuagcggggaugacugcguggucaaacccaucgaugacagauuugcggaugcccugcucgcucugaaugacaugggcaaggugcggaaagauaucccccaguggcaaccuucuaagggauggcaugacuggcagcaggucccguucuguucccaccauuuucacgaacuuauuaugaaagauggccgcaagcuggugguucccugcagaccucaggacgagcucaucgggcgggcccgcauuagccaaggagcuggcuggucucugaaggagacagccugucuggggaaggcuuacgcccagaugugggcgcucauguauuuccacagacgggaccugcgccuugccuccaacgcuaucugcagcgccgugcccguccauugggugccuaccucuagaaccacaugguccauucacgcccaucaccaguggaugaccacagaagauaugcugacgguuuggaaccggguguggaucgaggacaaucccuggauggaagauaagaccccugucacaaccugggaggacgugcccuaccucggaaaaagagaggaucaaugguguggcagccugauugggcuugcuucccgcgccacaugggcgcagaacauccugaccgcuauccaacaggugcggagccucauuggcaaugaagaguuucuggacuauaugccgucuaugaagagauuccgcaaagaagaggaaagcgagggagccaucugguga

SEQ ID NO: 20887 - RNA, 9873 nt, Artificial Sequence
  derived and/or modified CDS sequence (opt5) from DENV-3__KC762687__SS-prME
accagccugugccucaugaugaugcugcccgccacacuugcuuuccaccugacgucccgggacggcgagccucggaugaucguggggaagaaugaacgcggaaagucucuccuguuuaagaccgccagcggcauuaauauguguacacuuaucgcgauggaucugggggagaugugcgacgauaccgucacauacaaauguccgcucauuaccgaaguugagcccgaagacaucgauugcugguguaaccugacauccaccugggugacguauggaaccugcaaucaggcuggcgagcacagacgggacaagcgcucuguggcccuggccccucacgucgggaugggacucgauacaagagcucaaaccuggaugagcgccgagggcgcuuggagacagguggaaaaaguugagacaugggccuuccgccaucccggcuuuaccauucuggcgcuuuuccuggcccacuacaucgggacgucccucacacagaagguggucaucuuuauucugcuuaugcuggugaccccuucuaugacaaugagauguguuggagugggcaaccgggacuucgucgaagggcucagcggagcuaccuggguggaugugguccuggagcauggcgggugcguuaccacaauggccaagaauaaacccacgcuggacaucgagcuccagaagaccgaagcuacacaacuggccacccuucgcaaacuguguauugagggaaagaucacaaacgugaccacggauuccagaugcccuacacagggcgaagcgauucucccggaggaacaggaccagaauuauguguguaaacacaccuacgucgaucggggcugggggaacggaugcggccuguuugggaagggaagccuugugaccugcgccaaguuccaaugucuggaguuuaucgagggcaaaguugugcagcacgaaaaucucaaguauacagucauuaucaccgugcauacaggggaccagcaccagguuggaaacgagacgcaaggcgugaccgcugaaaucacaccccaggccucuaccgucgaggcuauucugccugaauacggcacacuggggcucgagugcagcccccgcaccggacuggacuucaaugagaugauccuucugacgaugaaaaacaaggccuggauggugcauagacagugguuuuucgaucucccucugcccuggaccagcggcgccacaaccgaaacaccgaccuggaauaaaaaggagcuucuggucacguuuaaaaacgcucacgcgaagaagcaagaagugguugugcucgggucucaggagggagccaugcacacagcucugaccggcgccacagaaauucagaccuccgggggcaccagcaucuucgccggacaucugaaaugucggcucaagauggacaaacuggagcuuaagggcaugucuuaugcuaugugccugaaugccuucguccucaaaaaggagguguccgaaacacagcacgggacgauucugaucaagguugaguacaaaggagaagaugcgccuuguaagauccccuuuagcaccgaggacggccaagggaaagcucauaacggacgccugauuacagccaacccuguggucgugaagaaagaggaacccgugaauaucgaggccgaacccccuuucggcgaguccaacauuguuaucgggauuggcgauaaggcucuuaagaucaauugguacaaaaagggaucuagcaucggcaaaauguuugaagccaccgcuagaggggcccggagaauggcgauucucggagacacagccugggauuucggcuccgucgggggagugcugaacagccugggcaagauggugcaccagaucuuugggucugcuuauaccgcccucuucuccggcgucagcuggauuaugaaaaucggaauuggcgugcugcuuacguggaucgggcucaauucuaagaacacaagcauguccuuuucuugcauuguuaucggaaucauuacccucuaccugggcgcugugguccaggccgacauggggugugugaucaauuggaagggaaaagagcugaagugcggcagcgggauuuucguuaccaacgaggugcauacauggaccgaacaguauaaauuucaagcggauuccccgaagcgccuugccacagcuaucgccggcgcuugggagaauggagucuguggcauucggagcacgaccagaauggaaaaccuccuguggaaacagaucgccaaugagcugaacuacauccucugggaaaauaacauuaagcugacagugguugugggggacaucauuggaguccuugagcagggcaaacgcacccugacaccccagccuauggagcucaaguauucuuggaagaccugggggaaagccaagaucgugacggcugaaacccaaaauuccagcuucauuaucgauggacccaacacaccugagugccccucugcgucccgggccuggaacgugugggaagucgaggacuacggcuuuggcguuuucaccacaaauaucuggcugaaacugagagaaauguauacccagcuuugugaccaccgccucaugagcgcugccgugaaggaugagcgggccgugcacgcugacaugggguacuggauugagucccagaaaaacggaucuuggaagcuggaaaaggccagccugaucgaggucaaaacaugcaccuggccgaagucccauacgcucuggucuaauggcgugcuggaaagcgauaugauuaucccuaaaucccuugcggggcccguuagccagcacaacuacagaccuggauaucauacacaaaccgcuggccccuggcaccuggggaagcucgagcuggacuuuaauuacugcgagggaaccacaguggucauuaccgaaaacuguggcacgcgcggcccuucucugcggacaaccacaguguccgggaaacuuauccacgaguggugcuguagaagcugcacccugcccccgcugcgcuauaugggagaagauggcuguugguacgggauggagauccggccuauuaaugaaaaggaggagaacaugguuaagucucugguguccgccggaagcggcaaagucgacaauuucacaaugggggugcucugccuggccauccuuuucgaagagguuaugagaggaaaguuuggcaaaaagcauaugauugcuggcgugcuguucaccuuuguccuccugcugucugggcagaucacguggcgggauauggcccgcacccuuauuaugaucggaagcaacgcguccgacagaaugggcaugggggugacauaucuggcucucauugccaccuucaaaauccagcccuuucuggcccucggauucuuucugcggaaacuuacaagcagagaaaaucugcuccugggcguggggcuggcuauggccaccacgcuucaacugcccgaggauaucgaacagauggcuaacggaauugcccucggccugauggcgcucaagcugaucacacaguucgagaccuaccagcuuuggacagcccuggucucucucauguguuccaauaccauuuuuacccugacaguugcuuggcgcacggccacccugauccuugcuggcauuagccuguucccugugugccaauccucuagcaugcggaaaacagacuggcucccggugaccgucgccgccaugggggugcccccucugccccucuuuaucuucucccugaaggauacacuuaaaagacgcucuuggccucugaacgagggaguuauggcugugggccuggucagcauccucgcguccucucugcuuagaaaugacgugcccauggccgggccucugguugcuggaggccuccugauugccuguuaugugaucaccgggacgagcgccgaucucacagucgaaaaggcugccgacgugauuugggaggaagaggcggaacagaccggagucucccacaaccugaugaucaccguggacgaugacggcacaaugcggauuaaagaugacgagaccgagaacauccuuacaguucugcugaagacggcucuccugaucgugagcggcauuuuucccuacucuaucccggccacccuucuggucuggcauacauggcagaaacagacccaacgcuccggggugcucugggauguuccuucucccccugaaacacagaaggccgagcuggaagagggaguguacagaauuaagcagcagggcaucuucgggaaaacccaagucggagugggcgugcagaaggaggggguuuuccacacgauguggcaugucacccggggagcugugcucacacacaauggcaaacgccuggaacccaacugggccuccgugaagaaagaccuuauuuccuauggcgggggauggagacugagcgcgcaguggcaaaagggcgaggaaguccaggugaucgcuguugagccggggaagaauccuaaaaacuuucagaccaugcccggaacauuccagaccacaacgggcgaaauuggggccaucgcccuggauuuuaagccuggaaccucuggcucccccaucauuaaucgggagggcaaaguggucgggcucuacggaaacggcgugguuacaaagaaugggggauaugugagcggcaucgcucaaaccaacgccgagcccgacgggccuaccccggaacuggaggaagagauguucaaaaagcgcaaucuuacaauuauggaucugcaccccggcuccggaaagacgagaaaauaccucccugcuaucguccgggaagccauuaagcgcagacugcggacccucauccuggcgcccacaagagugguugccgcugagauggaggaagcccuuaaaggccugccuauccgcuaucagaccacagcuaccaagagcgugcauacggggaaagagauugucgaccugaugugccacgccacauuuaccaugcggcuccugucucccgugagagugccuaacuacaaucuuaucauuauggaugaagcccauuucaccgacccggcuagcaucgcggcccgcggauauauuuccacacgggucggcaugggggaggcugccgccaucuuuaugaccgcuacacccccuggaaccgccgaugcguucccccagucuaacgcuccuauccaggacgaagagagagacauucccgagcgcagcuggaacuccggcaacgaauggaucacggauuuugccgggaagacaguuugguucgugccgucuauuaaggccggcaaugacaucgcuaacugucugcggaaaaacggaaagaaagugauucaacucagcagaaagaccuuugauacagaguaccagaaaaccaagcugaaugacugggauuucgucgugacgaccgacaucuccgaaaugggcgccaacuucaaggcggaucgcguuauugacccucggagaugccugaaacccgugauccucacagaugggcccgagcgggucauccuugccggaccuaugcccgugaccguugcuucugccgcucagcgcagaggccggguggggcgcaauccucagaaggagaacgaccaauacauuuuuacaggacagccgcugaauaacgaugaagaccacgcccauuggaccgaggcuaaaaugcugcucgacaauaucaacacacccgaaggcauuaucccugcccuguucgagcccgaaagagaaaagagcgcggccauugauggggaguaucggcuuaaaggcgaauccagaaagaccuuugucgagcugaugcgccggggagaccucccuguguggcuggcucacaaagucgccagcgaaggcaucaaguacacggauagaaaguggugcuucgacggggagcgcaauaaccagauccuggaagagaauauggauguggagauuuggacaaaagaaggagagaagaaaaagcuccggcccagauggcuugacgcucgcaccuauucugauccgcuggcccugaaagaauuuaaggacuucgccgcuggccggaaguccaucgcgcucgaucugguuaccgagauugggagagugccuagccaccuugcccauaaaacacgcucugcucuggacaaccucgugaugcugcacaccuccgaacauggaggcagagccuaccggcacgccgucgaggagcugcccgaaacaauggagacgcuccuucugcugggccucaugauccugcuuaccgggggagcuaugcuguuucucauuagcggcaaggggaucggaaaaacauccaucggccugauuuguguuguggccucuagcgggaugcuguggauggcggaugugccucuccaguggaucgccuccgcuauuguccuugaguucuuuaugauggugcugcugauccccgagccugagaagcaacgcacaccccaggacaaucagcucgccuauguugugauuggaauccugacacuugcugccauugucgcggccaacgaaaugggccugcucgagaccacgaaaagagaucugggcaugagcaaggaaccggggguggucucuccuaccuccuaccuggacguggaccuccaccccgcuagcgccuggacacuuuaugcuguugccaccacagugaucacccccaugcugcggcauacgaucgaaaauucuacagcuaacgucagccuggccgcgauugccaaucaagcugugguucucaugggacuggauaagggcuggccuaucuccaaaauggaccuuggggugccgcugcucgcccugggaugcuacucucaggucaacccccugacccucacagcugccgugcuucugcuggugacccacuacgccauuaucggcccugggcuccaggcgaaggcuacccgcgaagcccagaaaagaacagcugccggaauuaugaagaaccccacgguugauggcaucaugaccaucgaccuggauccugucauuuaugacagcaaauucgagaagcaacuuggccaggugaugcugcucgugcugugugccguccagcugcuccuuaugcggacauccugggcuuuuugcgaggcccugacccuggcgacagggcccaucaccacgcucugggaaggaucuccuggcaaguucuggaauacaaccauugccguuagcauggcuaacaucuuuagaggguccuaccuggccggagcuggccuugccuucagcauuaugaaaucuguggggaccggaaagcgcggcacaggcucccagggggagacccugggagaaaaauggaagaaaaagcucaaucaacugagccggaaagaguucgaucuguauaagaaguccggcaucacagaaguggacagaacggaggcgaaagaggggcucaagcgcggagaaaucacccaucacgccgucucucggggcagcgcuaaacuucagugguuuguggagagaaacaugguuauuccggaagggcgggugaucgaucugggauguggccgcggcgggugguccuacuauugcgccggacugaagaaagucacagaggugagaggcuacaccaaaggcgggcccgggcaugaagaaccuguucccaugucuacauauggguggaauauugugaagcucaugagcggaaaagacgucuucuaccugccucccgagaagugugauacccuucugugcgacaucggcgaauccagcccgucuccuacgguggaggaaucccggaccauucgcgugcucaaaauggucgagcccuggcugaagaacaaucaguuuuguaucaaaguucugaaccccuacaugccuacagugauugagcaccucgaaagacuucagcggaagcacggcgggaugcuggugcgcaauccccugagcagaaacucuacccaugagauguauuggaucuccaauggaacaggcaacaucgucagcucugugaauaugguuagccggcuccugcuuaaccgcuucaccaugacacacagacggccuaccauugaaaaggauguggaccugggggcuggaacgagacaugucaaugccgagccggaaacacccaacauggacgugaucggcgagcgcauucggagaaucaaagaggaacacuccucuaccuggcacuacgaugaggaaaacccuuauaagaccugggcuuaccaugggagcuaugagguuaaagccacaggauccgcgagcuccaugauuaauggcguggucaagcuccugacgaaacccugggacgugguuccuaccgugacacaaauggccaugaccgauacaacccccuuuggccagcagcgcgucuucaaggaaaagguggacacacggaccccgagaccuaugcccgggacgcgcaaagcuauggagaucaccgccgaguggcuguggcggacacucggaagaaacaagcgcccucggcugugcaccagagaagaguuuaccaagaagguccgcaccaaugcugccaugggcgccguguucacggaagagaaccaaugggauucugcgaaagcugccguugaagacgaggaguuuuggaaacuuguggaucgggaaagagagcugcacaaacucgggaaguguggaagcugcgucuacaauaugaugggcaagcgcgagaagaagcugggggaguucggcaaagccaagggauccagagcuaucugguauauguggcuuggcgcccgguaccuggaguuugaagcucucggguuccugaacgaggaccauugguuuucucgcgaaaauagcuucuccggaguggagggcgaagggcugcacaaacucggauacauucugagagauaucucuaagauucccggcggggccauguaugcggacgauacagccggcugggacacccggaucacagaggacgaucuucauaacgaggaaaagauuacccagcagauggacccugagcacagacagcuggcuaaugccaucuucaaacucacguaccaaaacaaggugguuaaagugcagcggcccaccccgaagggaacagucauggauaucauuagccgcaaagaccagagaggcuccggacaggugggaaccuauggccugaauacauuuaccaacauggaaguucaacuuauccggcagauggagggggaaggagugcugagcaaggcugaucucgagaauccucaucugcuggagaaggaaauuacacaguggcucgagaccaaaggcgucgaacgccugaagagaauggccaucucuggggacgauugcguggucaaacccauugacgaucgguucgcggacgcccuucuggcucucaacgauaugggcaaggugcgcaaagacaucccccaguggcaaccuuccaagggauggcaugauuggcagcagguuccguuuuguagccaccauuuccacgagcugaucaugaaggacggcagaaaacuugugguccccugccggccucaggacgaacugauugggcgcgccagaaucucucaaggagcuggcuggucccuccgggagacggccugucuggggaaggcuuacgcccagaugugggcgcugauguauuuucaccgcagagaucuccggcuggccagcaaugcuauuugcucugccgugcccguucauugggugccuacaucccgcaccaccuggagcauccacgcccaucaccaguggaugacaaccgaggacaugcuuacagucuggaacagaguguggauugaagauaaccccuggauggaggacaaaacgccugugaccacaugggaagauguucccuaccugggaaagcgggaggaccaaugguguggcucccucaucgggcuggcuagcagagccaccugggcgcagaauauucuuacagcuauccagcagguccgcucucugaucggcaacgaggaguuccucgauuauaugccgagcaugaaacgguuuagaaaggaggaagaguccgaaggagccauuugguga

SEQ ID NO: 20888 - RNA, 9873 nt, Artificial Sequence
  derived and/or modified CDS sequence (opt5) from DENV-3__KC762688__SS-prME
accagccugugccucaugaugaugcugcccgcuacccuugcuuuccaccugacguccagagacggcgaaccucggaugauuguggggaagaaugaacgcggaaagucucuccuguuuaagaccgccagcggcauuaauauguguacacuuaucgcgauggaucugggggagaugugcgacgauaccgucacauacaaguguccgcucauuaccgaaguugagcccgaagacaucgauugcugguguaaccugacauccaccugggugacguauggaaccugcaaucaggcuggcgagcacagacgggacaagcgcucuguggcccuggccccucacgucgggaugggacucgauacaagagcucagaccuggaugagcgccgagggcgcuuggcggcaggucgaaaaaguugagacaugggccuuccgccaucccggcuuuaccauucuggcgcuuuuccuggcccacuacaucgggacgucccucacacagaagguggucaucuuuauucugcuuaugcuggugaccccuucuaugacaaugagauguguuggagugggcaaccgggacuucgucgaagggcucagcggagcuaccuggguggaugugguccuggagcauggcgggugcguuaccacaauggccaagaauaaacccacgcuggacaucgagcuccagaagaccgaagcuacacaacuggccacccuucgcaaacuguguauugagggaaagaucacaaacgugaccacggauuccagaugcccuacacagggcgaagcgauucucccggaggaacaggaccagaauuauguguguaaacacaccuacgucgaucggggcugggggaacggaugcggccuguuugggaagggaagccuugugaccugcgccaaguuccaaugucuggaguuuaucgagggcaaaguugugcagcacgaaaaucucaaguauacagucauuaucaccgugcauacaggggaccagcaccagguuggaaacgagacgcaaggcgugaccgcugaaaucacaccccaggccucuaccgucgaggcuauucugccugaauacggcacacuggggcucgagugcagcccccgcaccggacuggacuucaaugagaugauccuucugacgaugaaaaacaaggccuggauggugcauagacagugguuuuucgaucucccucugcccuggaccagcggcgccacaaccgaaacaccgaccuggaauaaaaaggagcuucuggucacguuuaaaaacgcucacgcgaagaagcaagaagugguugugcucgggucucaggagggagccaugcacacagcucugaccggcgccacagaaauucagaccuccgggggcaccagcaucuucgccggacaucugaaaugucggcucaagauggacaaacuggagcuuaagggcaugucuuaugcuaugugccugaaugccuucguccucaaaaaggagguguccgaaacacagcacgggacgauucugaucaagguugaguacaaaggagaagaugcgccuuguaagauccccuuuagcaccgaggacggccaagggaaagcucauaacggacgccugauuacagccaacccuguggucaccaagaaagaggaacccgugaauaucgaggccgaacccccuuucggcgaguccaacauugugaucgggauuggcgauaaggcucuuaagaucaauugguacaaaaagggaucuagcaucggcaaaauguuugaagccacagcuagaggggcccggagaauggcgauucucggagacaccgccugggauuucggcuccguugggggaguccugaacagccugggcaagauggugcaccagaucuuugggucugcuuauacggcccucuucuccggcgugagcuggauuaugaaaaucggaauuggcguccugcuuacauggaucgggcucaauucuaagaacaccagcauguccuuuucuugcauugugaucggaaucauuacccucuaccugggcgcuguugugcaggccgacauggggugugucaucaauuggaagggaaaagagcugaagugcggcagcgggauuuucgugacaaacgagguucauaccuggacagaacaguauaaauuucaagcggauuccccgaagcgccuugccacggcuaucgccggcgcuugggagaauggaguguguggcauucggagcaccacaagaauggaaaaccuccuguggaaacagaucgccaaugagcugaacuacauccucugggaaaauaacauuaagcugaccgucgugguuggggacaucauuggagugcuugagcagggcaaacgcacacugacaccccagccuauggagcucaaguauucuuggaagacgugggggaaagccaagaucgucaccgcugaaacacaaaauuccagcuucauuaucgauggacccaacaccccugagugccccucugcgucccgggccuggaacgugugggaaguggaggacuacggcuuuggcgucuucacaaccaauaucuggcugaaacugagagaaauguauacacagcuuugugaccaccgccucaugagcgcugccguuaaggaugagcgggccgugcacgcugacaugggguacuggauugagucccagaaaaacggaucuuggaagcuggaaaaggccagccugaucgaggugaaaaccugcacguggccgaagucccauacacucuggucuaauggcguccuggaaagcgauaugauuaucccuaaaucccuugcggggcccgugagccagcacaacuacagaccuggauaucauacccaaaccgcuggccccuggcaccuggggaagcucgagcuggacuuuaauuacugcgagggaacaaccguugugauuacggaaaacuguggcacacgcggcccuucucugcggaccacaaccgucuccgggaaacuuauccacgaguggugcuguagaagcugcacacugcccccgcugcgcuauaugggagaagauggcuguugguacgggauggagauccggccuauuaaugaaaaggaggagaacauggugaagucucugguuuccgccggaagcggcaaaguggacaauuucaccauggggguccucugccuggccauccuuuucgaagaggugaugagaggaaaguuuggcaaaaagcauaugauugcuggcguucuguucacguuugugcuccugcugucugggcagaucaccuggcgggauauggcccgcacacuuauuaugaucggaagcaacgcguccgacagaaugggcaugggggucaccuaucuggcucucauugccacauucaaaauccagcccuuucuggcccucggauucuuucugcggaaacuuaccagcagagaaaaucugcuccugggcguggggcuggcuauggccacgacacuucaacugcccgaggauaucgaacagauggcuaacggaauugcccucggccugauggcgcucaagcugaucacccaguucgagacauaccagcuuuggaccgcccuggugucucucauguguuccaauacccuguuuacacugacggucgcuuggcgcaccgccacacuuauucuggcuggcaucagccuccugccuguuugccaauccucuagcaugcggaaaaccgacuggcucccggugacaguggccgccaugggggugcccccucugccccuuuucaucuuuucccugaaggauacccugaaaagacgcucuuggccucucaacgagggagugauggcuguuggccuggugagcauccuugcguccucucugcucagaaaugacguccccauggccgggccucugguggcuggaggccuccugaucgccuguuauguuauuacggggacaagcgccgaucuuaccguggaaaaggcugccgacgucaucugggaggaagaggcggaacagaccggagugucccacaaccugaugauuacagucgacgaugacggcaccaugcggaucaaagaugacgagacagagaacauucugacggugcuccugaagaccgcccuucugaucguuagcggcaucuuccccuacucuauuccggccacacuccugguguggcauaccuggcagaaacagacacaacgcuccgggguccucugggaugugccuucucccccugaaacccagaaggccgagcuggaagagggaguuuacagaaucaagcagcagggcauuuuugggaaaacgcaagugggagucggcgugcagaaggaggggguguuccacaccauguggcauguuacacggggagcuguccuuacccacaauggcaaacgccuggaacccaacugggccuccgugaagaaagaccugaucuccuauggcgggggauggagacucagcgcgcaguggcaaaagggcgaggaagugcaggucauugcuguggagccggggaagaauccuaaaaacuuccagacaaugcccggaaucuuucagaccacaacgggcgaaauuggggccaucgcccuggauuucaagccuggaaccucuggcucccccaucauuaaucgggagggcaaaguuguggggcuuuacggaaacggcgucgugacaaagaaugggggauauguuagcggcaucgcucaaaccaacgccgagcccgacgggccuaccccggaacuggaggaagagauguuuaaaaagcgcaaucucacaauuauggaucugcaccccggcuccggaaagacgagaaaauaccucccugcuaucgugcgggaagccauuaagcgcagacugcggacccuuauccuggcgcccacaagagucguggccgcugagauggaggaagcccugaaaggccucccuauccgcuaucagaccacagcuaccaagagcgcccauacggggaaagagauuguugaccugaugugccacgccacauucaccaugcggcuucugucucccgugagagucccuaacuacaaucucaucauuauggaugaagcucauuuuaccgacccggcgagcaucgccgcucgcggauauauuuccacacgggugggcaugggggaggccgccgcuaucuucaugaccgccacacccccuggaaccgcggaugcuuuuccccagucuaacgccccuauccaggacgaagagagagacauucccgagcgcagcuggaacuccggcaacgaauggaucacggauuucgccgggaagacagugugguuugucccgucuauuaaggcuggcaaugacaucgccaacugucugcggaaaaacggaaagaaaguuauucaacugagcagaaagaccuucgauacagaguaccagaaaaccaagcucaaugacugggauuuuguggugacgaccgacaucuccgaaaugggcgcgaacuucaaggccgaucgcgucauugacccucggagaugccuuaaacccgugauccugacagaugggcccgagcggguuauccuggcuggaccuaugcccgugaccgucgccucugcugcccagcgcagaggccggguggggcgcaauccucagaaggagaacgaccaauacauuuucacaggacagccgcucaauaacgaugaagaccacgcucauuggaccgaggccaaaaugcugcuugacaauaucaacacacccgaaggcauuaucccugcgcuguuugagcccgaaagagaaaagagcgccgcuauugauggggaguaucggcucaaaggcgaauccagaaagaccuucguugagcugaugcgccggggagaccugccuguguggcucgcccacaaagucgcuagcgaaggcaucaaguacacggauagaaaguggugcuuugacggggagcgcaauaaccagauccuugaagagaauauggauguggagauuuggacaaaagaaggagagaagaaaaagcugcggcccagauggcuggacgcccgcaccuauucugauccgcucgcccugaaagaguucaaggacuuugcugcgggccggaaguccaucgcccuugaucuggucaccgagauugggagagugccuagccaccucgcucaucgcacaagaaacgcccuggacaaucugguuaugcuccacaccucugaacauggaggccgggccuaccgccacgcuguggaggaguuccccgaaacaauggagacgcuucugcugcucggccugaugauccuucugaccgggggagccaugcucuuucugauuuccggcaaagggaucggaaagacaagcaucggccugauuuguguggucgcguccucugggaugcucuggauggccgauguuccucuucaguggaucgcuagcgccauugugcuggaguucuuuaugauggugcugcucauccccgagccugagaaacaaagaacaccccaggacaaccagcuggcuuaugucgugauuggaauccuuacacuggccgcgauuguugccgcuaaugaaaugggccuccuggagaccacgaagcgggaucugggcauguccaaagaaccggggguggucagcccuaccucuuaccucgacguggaccuucaccccgccuccgcuuggacacuguaugccgucgcuaccacagugaucacccccaugcugcgccauacgaucgagaacagcacagccaauguuucucucgcggccauugcuaaccaagccgugguccugaugggacuugauaagggcuggccuaucagcaagauggaccugggggugccgcuccuggcucugggaugcuacucccagguuaacccccucacccuuacagccgccgugcugcugcucgucacccacuacgcgauuaucggcccugggcugcaggcuaaagccaccagagaagcucagaagcggacagccgccggaauuaugaaaaaucccacgguggauggcaucaugaccaucgaccuugauccugugauuuaugacucuaaguucgagaaacaacugggccagguuaugcuccugguccugugugcugugcagcuccuucugaugagaacaagcugggccuuuugcgaggcgcugacccucgccacagggcccaucaccacgcugugggaaggauccccuggcaaguucuggaacacaaccauugcugugucuauggccaauaucuuucgcgggagcuaccuugcuggagccggccuggcguucuccauuaugaaaagcgucgggaccggaaaacggggcacaggcucucagggggagacccucggagaaaaguggaaaaagaaacugaaccaacuguccagaaaggaguucgaucucuauaaaaagagcggcaucacagaaguugaccgcacggaggccaaggaggggcuuaaaaagggagaaaucacccaucacgcugugucccggggcucugccaaacugcagugguuuguggagagaaauauggucauuccggaagggcgggugaucgaucugggauguggccgcggcggguggagcuacuauugcgcuggacucaagaaaguuacagaggugagaggcuacaccaaaggcgggcccgggcaugaagaaccuguccccauguccacauauggguggaacauugugaagcugaugucuggaaaagacguuuucuaccuuccucccgagaagugugauacccugcucugcgacaucggcgaaagcuccccgagcccuacgguggaggaaucucggaccauucgcguccugaaaaugguggagcccuggcugaagaauaaccaguuuuguaucaaagugcucaaucccuacaugccuacagucauugagcaccuugaaagacugcagcggaagcacggcgggaugcugguucgcaacccccucuccagaaauagcacccaugagauguauuggaucucuaacggaacaggcaauaucguguccagcgugaacauggucucucggcugcuucugaaucgcuucaccaugacacacagacggccuaccauugaaaaggauguggaccucggggccggaacgagacauguuaacgcugagccggaaacacccaacauggacgugaucggcgagcgcauucggagaaucaaagaggaacacagcuccaccuggcacuacgaugaggaaaauccuuauaagaccugggccuaccaugggucuuaugaggucaaagcgacaggaagcgccuccagcaugauuaacggcgugguuaagcugcugacgaaacccugggacguggucccuaccgugacacaaauggcuaugaccgauacaacccccuuuggccagcagcgcguuuucaaggaaaagguggacacacggaccccgagaccuaugcccgggacgcgcaaagccauggagaucaccgcugaguggcucuggcggacacugggaagaaauaagcgcccucggcuuugcaccagagaagaguuuaccaagaagguccgcaccaacgccgccaugggcgcgguguucacggaagagaaucaaugggauuccgcucgggccgccgucgaagacgaggaguuuuggaaacugguggauagagaacgcgagcuccacaagcuggggaaauguggaucuugcguuuacaacaugaugggcaagagagaaaagaaacuuggggaguucggcaaggcuaaaggaagccgggccaucugguauauguggcugggcgcucgcuaccucgaguuugaagcccugggguuccugaaugaggaccauugguuuuccagagaaaacucuuucagcggaguggagggcgaagggcuccacaagcugggauacauucuucgggauaucuccaaaauucccggcggggcgauguaugccgacgauacagcuggcugggacaccagaaucacagaggacgaucugcauaaugaggaaaagauuacccagcagauggacccugagcaccggcagcucgccaacgcuaucuucaagcugacguaccaaaauaaagucgugaaggugcagcgccccaccccgaaaggaacaguuauggauaucauuucuagaaaggaccagcggggcagcggacaggugggaaccuauggccuuaacacauuuaccaauauggaaguccaacugauccgccagauggagggggaaggagugcucuccaaagccgaucuggagaacccucaucugcucgagaaggaaauuacacaguggcuggagaccaagggcguugaaagacuuaaacggauggcgaucagcggggacgauugcguggucaagcccauugacgaucgcuucgccgacgcucugcucgcccugaaugauaugggcaaagugagaaaggacaucccccaguggcaaccuucuaaaggauggcaugauuggcagcaggucccguuuuguucccaccauuuccacgagcuuaucaugaaggacggccggaagcuggugguucccugccgcccucaggacgaacucauugggagagcucggaucagccaaggagccggcuggucucugaaagagacggcuugucuggggaaggccuacgcgcagaugugggcccucauguauuuucaccgcagagaucugcggcuugcuuccaacgccauuugcagcgccgugcccguccauugggugccuacaucucgcaccaccugguccauccacgcucaucaccaguggaugacaaccgaggacaugcugacaguuuggaacagaguguggauugaagauaaucccuggaucgaggacaaaacgccugucaccacaugggaagaugugcccuaccucggaaagcgggaggaccaaugguguggcagccugauugggcuugccuccagagcgaccugggcucagaacauccugacagccauccaacaggugcgcagccucauuggcaaugaggaguuccuggauuauaugccgucuaugaaacgguuuagaaaggaggaagagagcgaaggagccaucugguga

SEQ ID NO: 20889 - RNA, 9873 nt, Artificial Sequence
  derived and/or modified CDS sequence (opt5) from DENV-3__KC762689__SS-prME
accagccugugccucaugaugaugauccccgccacacuggcuuuccaccuuacguccagagacggcgagccucggaugauuguggggaagaacgaacgcggaaaaucucugcucuuuaagaccgccagcggcaucaauauguguacacugauugcgauggaucuuggggagaugugcgacgauaccgucacauacaaauguccgcugaucaccgaaguugagcccgaagacauugauugcugguguaaccucacauccaccugggugacguauggaaccugcaaucaggcuggcgagcauagacgggacaagcgcucuguggcccuggccccucacgucgggaugggacuggauacaagagcucaaaccuggaugagcgccgagggcgcuuggcggcagguggaaaaaguugagacaugggccuuccgccaucccggcuuuaccauccucgcgcuguuccuugcccacuacaucgggacgucccugacacagaagguggucauuuuuauccuccugaugcuugugaccccuucuaugacaaugagauguguuggagugggcaaccgggacuucgucgaagggcugagcggagcuaccuggguggaugugguccucgagcauggcgggugcguuaccacaauggccaagaauaaacccacgcuggacauugagcugcagaagaccgaagcuacacaacucgccacccugcgcaaacuuuguaucgagggaaagauuacaaacgugaccacggauuccagaugcccuacacagggcgaagcgauccugccggaggaacaggaccagaauuauguguguaaacacaccuacgucgaucggggcugggggaacggaugcggccucuuugggaagggaagccuggugaccugcgccaaguuccaaugucuugaguuuauugagggcaaaguugugcagcacgaaaaucugaaguauacagucaucaucaccgugcauacaggggaccagcaccagguuggaaacgagacgcaaggcgugaccgcugaaauuacaccccaggccucuaccgucgaggcuauccucccugaauacggcacacuggggcuggagugcuccccccgcaccggacucgacuucaaugagaugauucugcuuacgaugaaaaacaaggccuggauggugcauagacagugguuuuucgaucugccucuccccuggaccagcggcgccacaaccgaaacaccgaccuggaauaaaaaggagcugcuugucacguuuaaaaacgcucacgcgaagaagcaagaagugguugugcuggggucucaggagggagccaugcacacagcucucaccggcgccacagaaauccagaccuccgggggcaccagcauuuucgccggacaucugaaaugucggcugaagauggacaaacucgagcugaagggcaugucuuaugcuaugugccuuaaugccuucguccugaaaaaggagguguccgaaacacagcacgggacgauccucaucaagguugaguacaaaggagaagaugcgccuuguaagauucccuuuagcaccgaggacggccaagggaaagcucauaacggacgccugaucacagccaacccuguggucaccaagaaagaggaacccgugaauauugaggccgaacccccuuucggcgaguccaacaucgugauugggaucggcgauaaggcucugaagaucaauugguacaaaaagggaucuagcauuggcaaaauguuugaagccacagcuagaggggcccggagaauggcgauccuuggagacaccgccugggauuucggcuccguugggggaguccucaacagccugggcaagauggugcaccagauuuuugggucugcuuauacggcccuguucuccggcgugagcuggaucaugaaaauuggaaucggcguccuccugacauggauugggcuuaauucuaagaacaccagcauguccuuuucuugcaucgugaucggaauuaucacccuguaccucggcgcuguugugcaggccgacauggggugugucauuaauuggaagggaaaagagcugaagugcggcagcgggaucuucgugacaaacgagguucauaccuggacagaacaguauaaauuucaagcggauuccccgaagcgccuggccacggcuauugccggcgcuugggagaauggaguguguggcauccggagcaccacaagaauggaaaaccuucucuggaaacagaucgccaaugagcugaacuacauucugugggaaaauaacaucaagcucaccgucgugguuggggacauuaucggagugcuggagcagggcaaacgcacacuuaccccccagccuauggagcugaaguauucuuggaagacgugggggaaagccaagauugucaccgcugaaacacaaaauuccagcuucaucaucgauggacccaacaccccugagugccccucugcgucccgggccuggaacgugugggaaguggaggacuacggcuuuggcgucuucacaaccaauauuuggcucaaacugagagaaauguauacacagcugugugaccaccgccuuaugagcgcugccguuaaggaugagcgggccgugcacgcugacaugggguacuggaucgagucccagaaaaacggaucuuggaagcucgaaaaggccagccugauugaggugaaaaccugcacguggccgaagucccauacacuguggucuaauggcguccucgaaagcgauaugaucauuccuaaaucccuggcggggcccgugagccagcacaacuacagaccuggauaucauacccaaaccgcuggccccuggcaccuugggaagcuggagcucgacuuuaauuacugcgagggaacaaccguugugaucacggaaucuuguggcacacgcggcccuucccugcggaccacaaccgucagcgggaaacugauccacgaguggugcuguagaucuugcacacuucccccgcuccgcuauaugggagaagauggcuguugguacgggauggagauucggccuaucaacgaaaaggaggagaauauggugaagucccugguuagcgccggaucuggcaaaguggacaacuucaccauggggguccugugccucgccauucuguucgaagaggugaugagaggaaaguuuggcaaaaagcauaugaucgcuggcguucuuuucacguuugugcugcuccugagcgggcagauuaccuggcgggauauggcccgcacacugaucaugauuggauccaaugcgagcgacagaaugggcaugggggucaccuaucuugcucugaucgccacauucaaaauccagcccuuucucgcccugggauucuuucuccggaagcugaccucuagagaaaaccuucugcucggcguggggcuggcuauggccacgacacugcaacuucccgaggauauugaacagauggcuaauggaaucgcccugggccucauggcgcugaagcucauuacccaguucgagacauaccagcuguggaccgcccuugugucccugauguguagcaacaccaucuuuacacucacggucgcuuggcgcaccgccacacugauucuggcuggcaucucccuucugccuguuugccaaucuagcuccaugcggaaaaccgacuggcucccggugacaguggccgccauggggguccccccucugccccucuucaucuuuucucugaaggauacccuuaaaagacgcagcuggccucugaaugagggagugauggcuguuggccugguguccauucucgcgucuagccugcuuagaaacgacguccccauggccgggccucugguggcuggaggccuccugaucgccuguuauguuauuacggggacauccgccgaucucaccguggaaaaggcugccgacgucaucugggaggaagaggcggaacagaccggagugagccacaaucugaugauuacagucgacgaugacggcaccaugcggaucaaagaugacgagacagagaacauccuuacggugcugcugaagaccgcucuccugauuguuucuggcaucuuccccuacuccauuccggccacacuucugguguggcauaccuggcagaaacagacacaacgcagcgggguccucugggaugugccuucucccccugaaacccagaaggccgagcuggaagagggaguuuacagaaucaagcagcagggcauuuuugggaaaacgcaagugggagucggcgugcagaaggaggggguguuccacaccauguggcauguuacacggggagcuguccucacccacaacggcaaacgccuggaacccaauugggccuccgugaagaaagaccuuaucagcuauggcgggggauggagacugucugcgcaguggcaaaagggcgaggaagugcaggucguggcuguugagccggggaagaacccuaaaaauuuccagacaaugcccggaauuuuucagaccacaacgggcgaaaucggggccaucgcccuggauuucaagccuggaaccuccggcagccccauuaucaaccgggagggcaaaguggucgggcucuacggaaauggcgugguuacaaagaacgggggauauguguccggcauugcucaaaccaaugccgagcccgacgggccuaccccggaucuggaagaggaaauguuuaaaaagcgcaaccuuacaaucauggaccugcaccccggcagcggaaagacgagaaaauaccucccugcuauuguccgggaggccaucaagcgcagacugcggacccucauccuggcgcccacaagagugguugccgcugaaauggaggaggcccuuaaaggccugccuauucgcuaucagaccacagcuaccaagucugugcauacggggaaagaaaucgucgaucugaugugccacgccacauucaccaugcggcuccugagccccgugagagugccuaauuacaaccuuauuaucauggacgaggcccauuuuaccgauccggcuuccauugcggcccgcggauauaucucuacacgggucggcaugggggaagcugccgccaucuucaugaccgcuacacccccuggaaccgccgacgcguuuccccagagcaaugcuccuauucaggacgaggaaagagauauccccgagcgcuccuggaacucuggcaaugaguggauuacggacuucgccgggaagacaguuugguuugugccgagcaucaaggccggcaacgauauugcuaauugucugcggaaaaacggaaagaaagugauccaacucuccagaaagaccuucgacacagaauaccagaaaaccaagcugaacgauugggacuuugucgugacgaccgauauuucugagaugggcgccaauuucaaggcggaccgcguuaucgauccucggagaugccugaaacccgugauccucacagacgggcccgaacgggucauucuugccggaccuaugcccgugaccguugcuagcgccgcucagcgcagaggccggguggggcgcaacccucagaaggagaaugaucaauacaucuucacaggacagccgcugaacaaugacgaggaccacgcccauuggaccgaagcuaaaaugcugcucgauaacauuaauacacccgagggcaucauuccugcccuguuugaacccgagagagaaaaguccgcggccaucgacggggaguaucggcuuaaaggcgagagcagaaagaccuucgucgaacugaugcgccggggagaucucccuguguggcuggcucacaaagucgccucugagggcaucaaguacacggacagaaaguggugcuuugauggggaacgcaacaaucagauucuggaggaaaacauggacguggagaucuggacaaaagagggagaaaagaaaaagcuccggcccagauggcuugaugcucgcaccuauuccgacccgcuggcccugaaagaguucaaggauuuugccgcuggccggaagagcauugcgcucgaccugguuaccgaaaucgggagagugccuucucaccuugccuaccgcacaagaaaugcucuggauaaccucgugaugcugcauaccuccgagcacggaggccgggccuaucgccaugccgucgaagagcugcccgagacaauggaaacgcuccuucugcugggccucaugauucugcuuaccgggggagcuaugcuguuccucaucagcggcaaagggaucggaaagacauccauuggccugaucuguguuguggccucuagcgggaugcuguggauggcggacgugccucuccaguggauugccuccgcuaucguccuugaguuuuucaugauggugcugcugauucccgaaccugagaaacaaagaaccccccaggauaaucagcucgccuacguugugaucggaauucugacacuugcugccaucgucgcggccaacgagaugggccugcucgaaaccacgaagcgggaccugggcaugagcaaagagccggggguggucucuccuaccuccuaucuggacguggaucuccaccccgcuagcgccuggacacuuuacgcuguugccaccacagugaucacccccaugcugcgccacacgauugaaaauucuacagcuaacgucagccuggccgcgaucgccaaucaagcugugguucucaugggacuggacaagggcuggccuauuuccaagguggaucuuggggucccgcugcucgcccugggaugcuacucucaggugaacccccugacccucacagcugccgugcuucugcugguuacccauuaugccaucauuggcccugggcuccaggcgaaagcuaccagagaggcccagaagcggacagcugccggaaucaugaaaaaccccacggucgacggcaucaugaccauugaucuggacccugugaucuacgauagcaaguuugaaaaacaacuuggccaggugaugcugcucguccugugugccguucagcugcuccuuaugagaacauccugggcuuucugcgaggcccugacccuggcgacagggcccauuaccacgcucugggagggaucuccuggcaaguuuuggaauacaaccaucgccgugagcauggcuaacauuuuccgcggguccuaucuggccggagcuggccuugccuuuagcaucaugaagucuguggggaccggaaaacggggcacaggcucccagggggaaacccugggagagaaguggaaaaagaaacucaaucaacugagcagaaaggaauucgaccuguacaaaaaguccggcaucacagaggucgaucgcacggaagcgaaggaggggcucaaacggggagagaccacacaccaugccgugucuagaggcagcgcuaagcuucagugguucguugaacggaacauggugauuccggaggggcgcgucaucgaccugggauguggcagaggcgggugguccuauuacugcgccggacugaaaaaggugaccgaaguucggggcuauacaaaagggggacccggccacgaggaaccugugcccaugucuaccuacggguggaauauugucaagcucaugagcggaaaggauguguuuuaccugccucccgagaaaugugacacgcuucugugcgauaucggcgaguccagcccgucuccuaccguggaagagucccgcacaauuagaguccucaagaugguugaacccuggcugaaaaacaaucaguucuguaucaaggugcugaaccccuauaugccuaccgugauugagcaucucgagcggcuucagcgcaaacacggcgggaugcuggucagaaauccccugagccggaacucuacacacgaaauguacuggaucuccaauggaaccggcaacaucgugagcucuguuaauauggugagccgccuccugcuuaacagauuuacaaugacccaucggagaccuacgauugagaaggacgucgaccugggggcuggaacacgccacgugaaugccgaaccggagacccccaacauggauguuaucggcgaacggauuagacgcaucaaggaggagcauuccucuaccuggcacuaugacgaagagaacccuuacaaaacaugggcuuaucacgggagcuacgaagugaaggccacgggauccgcgagcuccaugauuaauggcgucgugaaacuccugaccaagcccugggauguugugccuacagucacccaaauggccaugacagacaccacacccuucggccagcagcggguguuuaaagagaaggucgauaccagaacgccgcgcccuaugcccgggacccggaaggcuauggaaaucacagccgaguggcuguggagaacccucggacgcaacaaacggccuagacugugcacacgcgaggaauucaccaagaaagugcggacgaaugcugccaugggcgccguuuuuacagaggaaaaccaaugggacucugcgagagcugccguggaggaugaagaguucuggaagcuugucgaccgcgagagagaacugcauaaacucgggaaguguggaagcugcguguauaauaugaugggcaaacgggagaagaagcugggggaauuuggcaaagccaagggaucccgcgcuaucugguacauguggcuuggcgccagauaccuggaguucgaggcucucggguuucugaacgaagaucacugguucucucgggagaauagcuuuuccggaguggaaggcgaggggcugcauaaacucggauauauucugagagacaucucuaagauucccggcggggccauguacgcggaugacaccgccggcugggacacacggaucaccgaagaugaccuucacaacgaggagaaaauuacgcagcagauggauccugaacaucgccagcuggcuaaugccaucuucaagcucaccuaucaaaacaagguugugaaaguccagagacccacaccgaagggaaccgugauggacaucauuagccggaaagaucagcgcggcuccgggcagguuggaacauacggccugaauaccuucacaaacauggaggugcaacuuaucagacagauggaaggggagggaguccugagcaaggcugaccucgaaaauccucaccugcuggagaaagagauuacccaguggcucgaaacgaagggcguggagcggcugaagcgcauggccaucucuggggaugacugcgucgugaaacccauugaugacagauuugcggaugcccuucuggcucucaacgacaugggcaagguucggaaagauaucccccaguggcaaccuuccaagggauggcacgacuggcagcaggugccguucuguagccaucacuuucaugaacugaucaugaaagacggccgcaagcuugucgugcccugcagaccucaggaugagcugauugggcgggcccgcaucucucaaggagcuggcuggucccucaaggaaacagccugucuggggaaagcuuaugcccagaugugggcgcugauguacuuccacagacgggaccuccgccuggccagcaaugcuauuugcucugccguucccgugcacugggucccuaccuccagaaccacauggagcauccaugcccaccaucaguggaugaccacagaggauaugcuuacgguguggaaccggguguggauugaggacaaccccuggauggaagauaagaccccuguuacaaccugggaggacguccccuaucugggaaaaagagaagaucaaugguguggcucccucaucgggcuggcuagccgcgccacaugggcgcagaauauucuuaccgcuauccagcaggugcggucucugaucggcaacgaggaguuucucgacuacaugccgagcaugaagagauuccgcaaagaagaggaauccgagggagccauuugguga

SEQ ID NO: 20890 - RNA, 9873 nt, Artificial Sequence
  derived and/or modified CDS sequence (opt5) from DENV-3__KC762690__SS-prME
accagccugugccucaugaugaugcugcccgccacccuugcuuuccaccugacguccagagacggagagccucggaugaucguggggaagaaugaacgcgggaagucucuccuguuuaagaccgccagcggcauuaauauguguacccuuaucgcgauggaucugggggagaugugcgacgauaccguuacauacaaguguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagagcucagaccuggaugagcgccgagggcgcuuggcggcaggucgaaaagguugagacaugggccuuccgccaucccggcuuuaccauucuggcgcuuuuccuggcccacuacaucgggacgucccucacacagaagguggucaucuuuauucugcuuaugcuggugaccccuucuaugacaaugagauguguuggagugggcaaccgggacuucgucgaagggcucagcggagcuaccuggguggaugugguccuggagcauggcgggugcguuaccacaauggccaagaauaaacccacgcuggacaucgagcuccagaagaccgaagcuacacaacuggccacccuucgcaaacuguguauugagggaaagaucacaaacgugaccacggauuccagaugcccuacacagggcgaagcgauucucccggaggaacaggaccagaauuauguguguaaacacaccuacgucgaucggggcugggggaacggaugcggccuguuugggaagggaagccuugugaccugcgccaaguuccaaugucuggaguuuaucgagggcaaaguugugcagcacgaaaaucucaaguauacagucauuaucaccgugcauacaggggaccagcaccagguuggaaacgagacgcaaggcgugaccgcugaaaucacaccccaggccucuaccgucgaggcuauucugccugaauacggcacacuggggcucgagugcagcccccgcaccggacuggacuucaaugagaugauccuucugacgaugaaaaacaaggccuggauggugcauagacagugguuuuucgaucucccucugcccuggaccagcggcgccacaaccgaaacaccgaccuggaauaaaaaggagcuucuggucacguuuaaaaacgcucacgcgaagaagcaagaagugguugugcucgggucucaggagggagccaugcacacagcucugaccggcgccacagaaauucagaccuccgggggcaccagcaucuucgccggacaucugaaaugucggcucaagauggacaaacuggagcuuaagggcaugucuuaugcuaugugccugaaugccuucguccucaaaaaggagguguccgaaacacagcacgggacgauucugaucaagguugaguacaaaggagaagaugcgccuuguaagauccccuuuagcaccgaggacggccaagggaaagcucauaacggacgccugauuacagccaacccuguggucaccaagaaagaggaacccgugaauaucgaggccgaacccccuuucggcgaguccaacauugugaucgggauuggcgauaaggcucuuaagaucaauugguacaaaaagggaucuagcaucggcaaaauguuugaagccacagcuagaggggcccggagaauggcgauucucggagacaccgccugggauuucggcuccguugggggaguccugaacagccugggcaagauggugcaccagaucuuugggucugcuuauacggcccucuucuccggcgugagcuggauuaugaaaaucggaauuggcguccugcuuacauggaucgggcucaauucuaagaacaccagcauguccuuuucuugcauugugaucggaaucauuacccucuaccugggcgcuguugugcaggccgacauggggugugucaucaauuggaagggaaaagagcugaagugcggcagcgggauuuucgugacaaacgagguucauaccuggacagaacaguauaaauuucaagcggauuccccgaagcgccuugccacggcuaucgccggcgcuugggagaauggaguguguggcauucggagcaccacaagaauggaaaaccuccuguggaaacagaucgccaaugagcugaacuacauccucugggaaaauaacauuaagcugaccgucgugguuggggacaucauuggagugcuugagcagggcaaacgcacacugacaccccagccuauggagcucaaguauucuuggaagacgugggggaaagccaagaucgucaccgcugaaacacaaaauuccagcuucauuaucgauggacccaacaccccugagugccccucugcgucccgggccuggaacgugugggaaguggaggacuacggcuuuggcgucuucacaaccaauaucuggcugaaacugagagaaauguauacacagcuuugugaccaccgccucaugagcgcugccguuaaggaugagcgggccgugcacgcugacaugggguacuggauugagucccagaaaaacggaucuuggaagcuggaaaaggccagccugaucgaggugaaaaccugcacguggccgaagucccauacacucuggucuaauggcguccuggaaagcgauaugauuaucccuaaaucccuugcggggcccgugagccagcacaacuacagaccuggauaucauacccaaaccgcuggccccuggcaccuggggaagcucgagcuggacuuuaauuacugcgagggaacaaccguugugauuacggaaaacuguggcacacgcggcccuucucugcggaccacaaccgucuccgggaaacuuauccacgaguggugcuguagaagcugcacacugcccccgcugcgcuauaugggagaagauggcuguugguacgggauggagauccggccuauuaaugaaaaggaggagaacauggugaagucucugguuuccgccggaagcggcaaaguggacaauuucaccauggggguccucugccuggccauccuuuucgaagaggugaugagaggaaaguuuggcaaaaagcauaugauugcuggcguucuguucacguuugugcuccugcugucugggcagaucaccuggcgggauauggcccgcacacuuauuaugaucggaagcaacgcguccgacagaaugggcaugggggucaccuaucuggcucucauugccacauucaaaauccagcccuuucuggcccucggauucuuucugcggaaacuuaccagcagagaaaaucugcuccugggcguggggcuggcuauggccacgacacuucaacugcccgaggauaucgaacagauggcuaacggaauugcccucggccugauggcgcucaagcugaucacccaguucgagacauaccagcuuuggaccgcccuggugucucucauguguuccaauaccauuuuuacacugacggucgcuuggcgcaccgccacacugauccuugcuggcauuagccugcucccuguuugccaauccucuagcaugcggaaaaccgacuggcugccggugacaguggccgccaugggggugcccccucucccccuguucaucuuuucccuuaaggauacccugaaaagacgcucuuggccucugaacgagggagugauggcuguuggccucgugagcauccuggcguccucucuucugagaaaugacguccccauggccgggccucucguggcuggaggccugcucauugccuguuauguuaucacggggacaagcgccgaucugaccguggaaaaggcugccgacgucauuugggaggaagaggcggaacagaccggagugucccacaaccuuaugaucacagucgacgaugacggcaccaugcggauuaaagaugacgagacagagaacauccugacggugcugcucaagaccgcucugcuuaucguuagcggcauuuuccccuacucuaucccggccacacugcucguguggcauaccuggcagaaacagacacaacgcuccgggguccugugggaugugccuucucccccugaaacccagaaggccgagcucgaagagggaguuuacagaauuaagcagcagggcaucuuugggaaaacgcaagugggagucggcgugcagaaggaggggguguuccacaccauguggcauguuacacggggagcuguccugacccacaauggcaaacgccuugaacccaacugggccuccgugaagaaagaccugauuuccuauggcgggggauggagacugagcgcgcaguggcaaaagggcgaggaagugcaggucaucgcuguggagccggggaagaauccuaaaaacuuccagacaaugcccggaauuuuucagaccacaacgggcgaaaucggggccaucgcccucgauuucaagccuggaaccucuggcucccccauuaucaaucgggagggcaaaguuguggggcuguacggaaacggcgucgugacaaagaaugggggauauguuagcggcauugcucaaaccaacgccgagcccgacgggccuaccccggaacuugaggaagagauguuuaaaaagcgcaaucugacaaucauggaucuccaccccggcuccggaaagacgagaaaauaccugccugcuauugugcgggaagccaucaagcgcagacuccggacccugauccuugcgcccacaagagucguggccgcugagauggaggaagcccugaaaggccugccuauucgcuaucagaccacagcuaccaagagcgcccauacggggaaagagaucguugaccucaugugccacgccacauucaccaugcggcugcuuucucccgugagagucccuaacuacaaucugauuaucauggaugaagcucauuuuaccgacccggcgagcauugccgcucgcggauauaucuccacacgggugggcaugggggaggccgccgcuaucuucaugaccgccacacccccuggaaccgcggaugcuuuuccccagucuaacgccccuauucaggacgaagagagagacauccccgagcgcagcuggaacuccggcaacgaauggauuacggauuucgccgggaagacagugugguuugucccgucuaucaaggcuggcaaugacauugccaacugucuccggaaaaacggaaagaaaguuauccaacugagcagaaagaccuucgauacagaguaccagaaaaccaagcugaaugacugggauuuuguggugacgaccgacauuuccgaaaugggcgcgaacuucaaggccgaucgcgucaucgacccucggagaugccucaaacccgugauccuuacagaugggcccgagcggguuauucuggcuggaccuaugcccgugaccgucgccucugcugcccagcgcagaggccggguggggcgcaauccucagaaggagaacgaccaauacaucuucacaggacagccgcugaauaacgaugaagaccacgcucauuggaccgaggccaaaaugcuccuggacaauauuaacacacccgaaggcaucauuccugcgcuuuuugagcccgaaagagaaaagagcgccgcuaucgauggggaguaucggcugaaaggcgaauccagaaagaccuucguugagcucaugcgccggggagaccugccuguguggcuggcccacaaagucgcuagcgaaggcaucaaguacacggauagaaaguggugcuuugacggggagcgcaauaaccagauucucgaagagaauauggauguggagaucuggacaaaagaaggagagaagaagaaacuucggcccagauggcuggacgcccgcaccuauucugauccgcuggcccucaaagaguucaaagacuuugcugcgggccggaaguccauugcccuggaucuugucaccgagaucgggagagugccuagccaccuggcucaucgcacaagaaacgcccucgacaaucugguuaugcugcacaccucugaacauggaggccgggccuaccgccacgcuguggaggagcuccccgaaacaauggagacgcuucugcugcucggccugaugauucuucugaccgggggagccaugcuguuccugaucuccggcaaagggaucggaaagacaagcauuggccugaucuguguggucgcguccucugggaugcucuggauggccgauguuccucuucaguggauugcuagcgccaucgugcuggaauuuuucaugauggugcugcucauucccgagccugagaaacaaagaacaccccaggacaaccagcuggcuuaugucgugaucggcauucuuacacuggccgcgaucguugccgcuaaugaaaugggccuccuggagaccacgaagcgggaucugggcauguccaaagaaccggggguggucagcccuaccucuuaccucgacguggaccuucaccccgccuccgcuuggacacuguaugccgucgcuaccacagugaucacccccaugcugcgccauacgauugagaacagcacagccaauguuucucucgcggccaucgcuaaccaagccgugguccugaugggacuugauaagggcuggccuauuagcaagauggaccugggggugccgcuccuggcucugggaugcuacucccagguuaacccccucacccuuacagccgccgugcugcugcucgucacccacuacgcgaucauuggcccugggcugcaggcuaaagccaccagagaagcucagaagcggacagccgccggaaucaugaaaaaucccacgguggauggcaucaugaccauugaccuugauccugugaucuaugacucuaaguuugagaaacaacugggccagguuaugcuccugguccugugugcugugcagcuccuucugaugagaacaagcugggccuucugcgaggcgcugacccucgccacagggcccauuaccacgcugugggaaggauccccuggcaaguuuuggaacacaaccaucgcugugucuauggccaauauuuuccgcgggagcuaccuugcuggagccggccuggcguuuuccaucaugaaaagcgucgggaccggaaaacggggcacaggcucucagggggagacccucggagaaaaguggaaaaagaaacugaaccaacuguccagaaaggaguucgaucucuauaaaaagagcggcaucacagaaguugaccgcacggaggccaaggaggggcuuaaacggggagaaauuacccaucacgcuguguccagaggcucugccaagcugcagugguucguggagcggaauauggucaucccggaagggcgcgugauugaucugggauguggcagaggcggguggagcuacuauugcgcuggacucaaaaagguuacagaggugcggggcuacaccaaagggggacccggccaugaagaaccuguccccauguccacauauggguggaacaucgugaagcugaugucuggaaaggacgucuuuuaccuuccucccgagaaaugugauacccugcucugcgacauuggcgaaagcuccccgagcccuacgguggaggaaucucgcaccaucagaguccugaagaugguggagcccuggcugaaaaauaaccaguucuguauuaaggugcucaaucccuacaugccuacagucaucgagcaccuugaacggcugcagcgcaaacacggcgggaugcugguuagaaacccccucucccggaauagcacccaugagauguauuggaucucuaacggaacaggcaauauuguguccagcgugaacauggucucucgccugcuucugaauagauuuaccaugacacaccggagaccuaccaucgaaaaggauguggaccucggggccggaacgcgccauguuaacgcugagccggaaacacccaacauggacgugauuggcgagcggaucagacgcauuaaggaggaacacagcuccaccuggcacuacgaugaggaaaauccuuauaaaaccugggccuaccaugggucuuaugaggucaaggcgacaggaagcgccuccagcaugaucaacggcgugguuaaacugcugacgaagcccugggacguggucccuaccgugacacaaauggcuaugaccgauacaacccccuucggccagcagcggguuuuuaaagaaaagguggacacaagaaccccgcgcccuaugcccgggacgcggaaggccauggagaucaccgcugaguggcucuggagaacacugggacgcaauaaacggccuagacuuugcacccgcgaagaguucacaaagaaaguccggaccaacgccgccaugggcgcgguguuuacggaagagaaucaaugggauuccgcuagagccgccgucgaagacgaggaguucuggaagcugguggaucgcgaaagagagcuccacaaacuggggaaguguggaucuugcguuuacaacaugaugggcaaacgggaaaagaaacuuggggaguuuggcaaagcuaagggaagccgcgccauuugguauauguggcugggcgcuagauaccucgaguucgaagcccugggguuucugaaugaggaccauugguucucccgggaaaacucuuuuagcggaguggagggcgaagggcuccacaaacugggauacauccuuagagauauuuccaagauccccggcggggcgauguaugccgacgauacagcuggcugggacacccggauuacagaggacgaucugcauaaugaggagaagaucacccagcagauggagccugaacaccgccagcucgccaacgcuaucuucaagcugacguaccaaaauaaggucgugaaagugcagagacccaccccgaagggaacaguuauggacauuaucucucggaaagaucagcgcggcagcggacaggugggaaccuauggccuuaacacauucaccaauauggagguccaacugauuagacagauggaaggggagggagugcucuccaaggccgaccuggagaacccucaccuccucgaaaaagagaucacacaguggcuggaaaccaagggcguugagcggcuuaagcgcauggcgauuagcggggaugacugcguggucaaacccaucgaugacagauuugccgaugcucugcucgcccugaaugacaugggcaaggugcggaaagauaucccccaguggcaaccuucuaagggauggcaugacuggcagcaggucccguucuguucccaccauuuucacgaacuuauuaugaaagauggccgcaagcuggugguucccugcagaccucaggacgagcucaucgggcgggcucgcauuagccaaggagccggcuggucucugaaggagacggcuugucuggggaaagccuacgcgcagaugugggcccucauguauuuccacagacgggaccugcgccuugcuuccaacgccaucugcagcgccgugcccguccauugggugccuacaucuagaaccaccugguccauucacgcucaucaccaguggaugacaaccgaagauaugcugacaguuuggaaccggguguggaucgaggacaaucccuggauggaagauaagacgccugucaccacaugggaggacgugcccuaccucggaaaaagagaggaucaaugguguggcagccugauugggcuugccucccgcgcgaccugggcucagaacauccugacagccauccaacaggugcggagccucauuggcaaugaagaguuucuggacuauaugccgucuaugaagagauuccgcaaagaagaggaaagcgagggagccaucugguga

SEQ ID NO: 20891 - RNA, 9873 nt, Artificial Sequence
  derived and/or modified CDS sequence (opt5) from DENV-3__KC762691__SS-prME
accagccugugccucaugaugaugcugcccgccacccuugcuuuccaccugacgucccgggacggagaaccucggaugaucguggggaagaaugaacgcggaaagucucuccuguuuaagaccgccagcggcauuaauauguguacccuuaucgcgauggaucugggggagaugugcgacgauaccgugacauacaaguguccgcucauuaccgaaguugagcccgaagacaucgauugcugguguaaccugacauccaccugggugacguauggaaccugcaaucaggcuggcgagcauagacgggacaagcgcucuguggcccuggccccucacguugggaugggacucgauacaagagcucaaaccuggaugagcgccgagggcgcuuggagacagguggaaaagguugagacaugggccuuccgccaucccggcuuuaccauucuggcgcuuuuccuggcccacuacaucgggacgucccucacacagaagguggucaucuuuauucugcuuaugcuggugaccccuucuaugacaaugagauguguuggagugggcaaccgggacuucgucgaagggcucagcggagcuaccuggguggaugugguccuggagcauggcgggugcguuaccacaauggccaagaauaagcccacgcuggacaucgagcuccagaagaccgaagcuacacaacuggccacccuucgcaaacuguguauugagggaaagaucacaaacgugaccacggauuccagaugcccuacacagggcgaagcgauucucccggaggaacaggaccagaauuauguguguaaacacaccuacgucgaucggggcugggggaacggaugcggccuguuugggaagggaagccuugugaccugcgccaaguuccaaugucuggagcucaucgagggcaaaguugugcagcacgaaaaucugaaguauacagucauuaucaccgugcauacaggggaccagcaccagguuggaaacgagacgcaaggcgugaccgcugaaaucacaccccaggccucuaccgucgaggcuauucugccugaauacggcacacucgggcuggagugcagccccagaaccggacuugacuuuaaugagaugauccugcucacgaugaaagauaaggccuggauggugcauagacagugguucuuugaccugccucuucccuggaccagcggcgccacaaccgaaacaccgaccuggaacaaaaaggagcugcucgucacguucaaaaaugcucacgcgaagaagcaagaagugguugugcuggggucucaggagggagccaugcacacagcucugaccggcgccacagaaauucagaccuccgggggcaccagcaucuuugccggacaucucaaaugucggcugaagauggauaaacuugagcugaagggcaugucuuauacaaugugcuccaacgcuuucguccucaaaaaggaggugagcgaaacgcagcacgggaccauucugaucaagguugaguacaaaggagaagacgccccuuguaagauccccuucuccacagaggauggccaagggaaagcgcauaauggacgccugauuaccgcuaacccuguggucacaaagaaagaggaacccgugaacaucgaggccgaacccccuuuuggcgagucuaauauuaucauugggaucggcgacaaggcccuuaagaucaacugguacaaaaagggaagcuccauuggcaaaauguucgaagcuaccgccagaggggcucggagaauggccauccucggagauacggcgugggacuuuggcagcgucggcgggguucucaauucucuggggaagaugguccaccagauuuucggguccgccuauacagcucucuuuagcggcgugucuuggaucaugaaaauuggaaucggcgugcugcuuaccuggauugggcugaacagcaagaauaccuccaugucuuucagcugcaucgucaucggaauuaucacacucuaccugggcgccgugguucaggcugauauggggugugugauuaacuggaagggaaaagagcugaagugcggcuccgggaucuuugucaccaaugaggugcauacauggacggaacaguauaaauuccaagccgacagcccgcgccggcuugcgaccgccauugcuggcgccugggagaacggaguuuguggcaucagaucuacaacccgcauggaaaaucuccuguggaagcagaucgcuaacgagcugaauuacauucucugggaaaacaauaucaaacugacaguggucgugggggauaccauuggaguucuugagcagggcaagcggacgcugacaccccagccuauggagcucaaauauuccuggaagacaugggggaaggccaaaaucgugaccgccgaaacacaaaacagcucuuuuauuaucgacggacccaauaccccugagugccccaacgcuuccagagcguggaacgucugggaaguggaggacuacggcuucggcguguuuacaaccaauaucuggcugaagcugcgcgaaauguauacgcagcuuugugaucaccggcucaugagcgccgcugucaaagacgagagagccguucacgccgauaugggguacuggauugagucccagaagaacggaucuuggaaacuggaaaaggcuagccugaucgaggugaagacaugcaccuggccgaaaucccauacccucuggucuaauggcgugcuggaaagcgacaugauuaucccuaagucccuugccgggcccauuagccagcacaacuaccgcccuggauaucauacacaaaccgcgggccccuggcaccuggggaaacucgagcuggauuucaauuacugcgagggaacgacagucgugaucaccgaaaacuguggcgcucggggcccuucucugagaacaaccacaguuuccgggaaacuuauccacgaguggugcugucgcagcugcacccugcccccgcugcgguauaugggagaagacggcuguugguacgggauggagauuagaccuaucaaugaaaaagaggagaacauggugaagucucuggucuccgccggaagcggcaagguggauaauuuuacgauggggguucucugccuggccauucuuuucgaagaggugaugcggggaaaauucggcaagaaacauaugaucgcuggcguccuguuuaccuucgugcuccugcugucugggcagauuacauggcgcgacauggccagaacccuuaucaugauuggaagcaacgcguccgaucggaugggcauggggguuacauaucuggcucucaucgccaccuuuaagauccagcccuuccuggcccucggauuuuuccugagaaaacuuacgagccgcgaaaaucugcuccugggcguggggcuggcuauggccacaacccuucaacugcccgaggacauugaacagauggcuaacggaaucgcccucggccugauggcgcucaagcugauuacacaguuugagaccuaccagcuuuggaccgcccuggucucucucauguguuccaauacaaucuucacgcugaccguggcuuggcggacagccacccugauucuugcuggcaucagccuguuuccugugugccaauccucuagcaugagaaagacagauuggcucccgaugaccgucgccgccauggggguucccccucugccccucuucaucuuuucccugaaagacacgcuuaagcgcagaucuuggccucugaacgagggagugauggcugugggccuggucagcauucucgcguccucucugcuucggaaugaugugcccauggccgggccucugguugcuggaggccuccugaucgccuguuaugugauuacagggaccagcgccgaccucaccgucgaaaaagcugccgacgugacaugggaggaagaggcggaacagaccggaguuucccacaaccugaugaucacaguggaugacgauggcacgaugcgcauuaaggacgaugagaccgagaacauccuuacaguccugcugaaaaccgcucuccugaucgugagcggcauuuuccccuacucuaucccggccacacuucuggucuggcauaccuggcagaagcagacgcaaagauccggggugcucugggacguuccuucucccccugaaacccagaaagccgagcuggaagagggaguguaccggauuaagcagcagggcaucuuugggaagacacaagucggagugggcguucagaaagaggggguguuccacaccauguggcaugucacacgcggagcugugcucaccuauaauggcaagagacuggaacccaacugggccuccgugaaaaaggaucuuauuuccuacggcgggggauggcggcugagcgcgcaguggcaaaaaggcgaggaaguucaggucaucgcuguggagccggggaagaauccuaagaacuuccagacaaugcccggaauuuuucagacgaccacaggcgaaaucggggccaucgcccuggacuucaaaccuggaaccucuggcucccccauuaucaaucgcgagggcaagguggucgggcucuauggaaacggcgugguuaccaaaaaugggggauacgugagcggcauugcucaaacaaacgccgagcccgaugggccuacgccggaacuggaggaagagauguuuaagaaaagaaaucuuaccaucauggaccugcaccccggcuccggaaagacacggaaguaucucccugcuauuguccgcgaagccaucaaaagacggcugagaacccucauccuggcgcccacacgcgugguugccgcugagauggaggaagcccuuaagggccugccuauucgguaccagaccacggcuacaaaaagcgagcacaccgggaaggaaaucguggaucugaugugccaugccaccuucacaaugagacuccugucucccguccgcgugccuaacuauaaucuuauuaucauggacgaggcccacuuuaccgauccggcuagcauugcggcccggggauacaucuccacaagaguuggcaugggggaagcugccgccaucuucaugaccgcuacgcccccuggaacagccgacgcguuuccccagucuaacgcuccuauucaggacgaggagcgcgauauccccgaacggagcuggaacuccggcaacgacuggauuaccgauuucgccgggaaaacagugugguuugucccgucuaucaaggccggcaaugacauugcuaacugucugagaaagaacggcaagaaggugauccaacucagccgcaaaaccuucgauacggaguaccagaagaccaaacugaaugacugggauuuuguggucacaaccgacauuuccgaaaugggcgccaacuucaaggcggaucggguuaucgacccuagacggugccugaagcccgugauccucacagaugggcccgagcgcgugauucuugccggaccuaugcccgucaccguggcuucugccgcucagagacggggccgcaucgggagaaauccucagaaagagaacgaccaauauauuuucacaggacagccgcugaauaacgacgaagaucaugcccacuggaccgaggcuaagaugcugcucgacaauaucaacacgcccgaaggcauuaucccugcccuguuugagcccgaacgggagaaaagcgcggccaucgauggggaguacagacuuaagggcgaaucccgcaaaacauucguugagcugaugcggagaggagaccucccuguguggcuggcucauaaggucgccagcgaaggcauuaaauauaccgaucgcaaguggugcuuugacggggagcggaauaaccagauccuggaagagaauauggauguggagauuuggaccaaggaaggagagaaaaagaaacucagaccccgcuggcuugacgcucggacauacucugauccgcuggcccugaaggaguucaaagacuuugccgcuggcagaaaguccaucgcgcucgaucugguuaccgagauugggcgcgugccuagccaccuugcccacagaacacggaacgcucuggacaaucucgucaugcugcauacgucugaacacggaggccgcgccuauagacaugccguggaggagcugcccgaaaccauggagacacuccuucugcugggccucaugauccugcuuaccgggggagcuaugcuguuccucaucuccggcaagggggucggaaaaacaagcauuggccugaucugugugguugccuccucugggaugcuguggauggcggauauuccucuccaguggaucgccagcgcuauugugcuugaauuuuucaugauggugcugcugauccccgagccugagaagcaacggacaccccaggacaaccagcucgccuacgucguuauuggaauccugacgcuugcugccaucguggcggccaaugaaaugggccugcucgagaccacaaaacgcgaccugggcauguccaaggaaccggggguggucagcccuaccucuuaucuggauguggaccuccaccccgcuuccgccuggacacuuuacgcuguugccaccacggugauuacacccaugcugagacacaccaucgagaacagcacagcuaaugucucucuggccgcgauugccaaccaagcugugguccucaugggacuggauaaaggcuggccuaucagcaagauggaccuuggggugccgcugcucgcccugggaugcuacucccagguuaacccccugacccucaccgcugccgugcuucugcuggucacacauuaugccauuaucggcccugggcuccaggcgaaggcuacgcgggaagcccagaaaagaaccgcugccggaaucaugaagaaucccacaguggauggcauuaugaccaucgaccuggauccuguuauuuacgacucuaaauuugagaagcaacuuggccaggugaugcugcucguccugugugccgugcagcugcuccuuaugcgcacaagcugggcuuucugcgaggcccugacccuggcgacggggcccaucacaacccucugggaaggauccccuggcaaauuuuggaacaccacaauugccgugucuauggcuaauaucuuccgggggagcuaucuggccggagcuggccuugccuuuuccaucaugaaaagcguugggaccggaaagagaggcacaggcucucagggggagacgcugggagaaaaauggaagaaaaagcucaaccaacugucccgcaaagaguucgaucuguacaagaaaagcggcauuaccgaagucgaccggacagaggcgaaggaggggcucaagagaggagaaaucacccaccaugccgugucccggggcucugcuaaacuucagugguucguggagcgcaauauggucauuccggaagggagaguuaucgaucugggauguggccggggcggguggagcuauuacugcgccggacugaagaaagugacagaggugcgcggcuauaccaaagggggacccggccacgaagaaccuguccccauguccacguacggguggaacauugugaaacucaugucuggaaaggacgucuuuuaccugccucccgagaagugugauacccuucugugcgacaucggcgaaagcuccccgagcccuacaguggaggaaucuagaaccauucggguccucaaaaugguggagcccuggcugaagaauaaccaguucuguaucaaaguucugaaucccuauaugccuacagugaucgagcaucucgaacgccuucagagaaagcacggcgggaugcugguccggaacccccugucccgcaauagcacccacgagauguacuggauuucuaacggaacaggcaauaucguguccagcgugaacauggucucuagacuccugcuuaaucgguuuaccaugacguauagacgcccuacaauugaaaaagacguugaucugggggcuggaacccggcaugugaacgccgagccggaaacccccaacauggacgugaucggcgagcgcauucgccggaucaaggaggaacacagcuccacauggcauuacgaugacgagaauccuuauaagacgugggcuuaccacgggucuuaugaagucaaagccaccggaagcgcguccagcaugaucaacggcgugguuaagcuccugacaaaacccugggauguggucccuaccgugacacaaauggccaugaccgacacaacccccuucggccagcagagaguuuuuaaggagaaaguggauacgcgcaccccgaagccuaugcccgggacacggaaggucauggaaauuaccgcugaguggcuguggagaacacucggacgcaauaaacggccuagacugugcacccgcgaggaguucacgaagaaagugcggacaaacgccgcuaugggcgccguuuuuaccgaggaaaaucaaugggacuccgccagagcggcuguggaggaugaagaguucuggaaacuugucgaccgcgagagagaacugcacaaacucgggaaguguggaucuugcguguacaacaugaugggcaaacgggagaagaagcugggggaauuuggcaaagccaagggaagccgcgccaucugguacauguggcuuggcgcuagauaucuggaguucgaggcccucggguuucugaaugaagaucauugguucucccgggagaacucuuacagcggagucgaaggcgaggggcugcacaaacucggauauauucugagagacaucuccaagauucccggcggggcuauguacgccgacgauacagcgggcugggacacccggaucacggaagaugaccuucauaaugaggagaaaaucacccagcagauggauccugaacaccgccagcuggccaacgcuauuuuuaagcucacauaucaaaauaaggugguuaaagugcagagacccaccccgaagggaacagucauggacaucauuucucggaaagaucagcgcggcagcggacaggugggaaccuacggccugaacacauucaccaauauggaggcccaacuuaucagacagauggaaggggagggagugcuguccaagacggaccucgaaaacccucaucugcuggagaaaaagauuacacaguggcucgagaccaagggcguugaacggcugaaacgcauggcuaucagcggggaugacugcguggucaagcccaucgaugacagauucgccaaugcgcuucuggcccucaacgauaugggcaaagugcggaaggacauuccccaguggcaaccuucuaaaggauggcacgacuggcagcagguuccguuuuguucccaccauuuccacgagcugaucaugaaggauggccgcaaacuugugguccccugcagaccucaggacgaacugauugggcgggcucgcaucagccaaggagccggcuggucucucaaagagaccgcuugucuggggaaggccuaugcucagaugugggcccugauguacuuucauagacgggaucuccgccuggcguccaacgccauuugcagcgcugugcccguccacugggugccuacaucuagaaccacaugguccauccacgcccaucaccaguggaugacgaccgaagacaugcuuacaguuuggaaucggguguggauugaggauaaccccuggauggaggacaaaaccccugucacaaccugggaagaugugcccuaccugggaaagagagaggaccaaugguguggcagccucaucgggcugacgucccgcgccaccugggcucagaauauccuuacagccauucagcagguucggagccugaucggcaacgaagaguuccucgauuauaugccgucuaugaaaagauuucgcaaggaggaagagagcgaaggagcgauuugguga

SEQ ID NO: 20892 - RNA, 9873 nt, Artificial Sequence
  derived and/or modified CDS sequence (opt5) from DENV-3__KC762692__SS-prME
accagccucugccucaugaugaugcugcccgccacccuugcuuuccaccugacguccagagacggagagccucggaugaucguggggaagaacgaacgcggaaagucucuccuguuuaagaccgccagcggcauuaauauguguacgcuuaucgcgauggaucugggggagaugugcgacgauaccgugaccuacaaguguccgcucauuaccgaaguugagcccgaagacaucgauugcugguguaaccugacauccaccugggugacguauggaaccugcaaucaggcuggcgagcauagacgggacaagcgcucuguggcccuggccccucacguggggaugggacucgauacaagagcucaaaccuggaugagcgccgagggcgcuuggagacagguggaaaagguugagacaugggccuuccgccaucccggcuuuaccauucuggcgcuuuuccuggcccacuacaucgggacgucccucacacagaagguggucaucuuuauucugcuuaugcuggugaccccuucuaugacaaugagauguguuggagugggcaaccgggacuucgucgaagggcucagcggagcuaccuggguggaugugguccuggagcauggcgggugcguuaccacaauggccaagaauaaacccacgcuggacaucgagcuccagaagaccgaagcuacacaacuggccacccuucgcaaacuguguauugagggaaagaucacaaacgugaccacggauuccagaugcccuacacagggcgaagcgauucucccggaggaacaggaccagaauuauguguguaaacacaccuacgucgaucggggcugggggaacggaugcggccuguuugggaagggaagccuugugaccugcgccaaguuccaaugucuggagcucaucgagggcaaaguugugcagcacgaaaaucugaaguauacagucauuaucaccgugcauacaggggaccagcaccagguuggaaacgagacgcaaggcgugaccgcugaaaucacaccccaggccucuaccgucgaggcuauucugccugaauacggcacacucgggcuggagugcagcccccgcaccggacuugacuuuaaugagaugauccugcucacgaugaaaaacaaggccuggauggugcauagacagugguucuuugaucugccucuucccuggaccagcggcgccacaaccgaaacaccgaccuggaauaaaaaggagcugcucgucacguucaaaaacgcucacgcgaagaagcaagaagugguugugcuggggucucaggagggagccaugcacacagcucugaccggcgccacagaaauucagaccuccgggggcaccagcaucuuugccggacaucucaaaugucggcugaagauggacaaacuugagcugaagggcaugucuuaugcuaugugcuccaaugccuucguccucaaaaaggaggugagcgaaacacagcacgggacgauucugaucaagguugaguacaaaggagaagaugcgccuuguaagauccccuucuccaccgaggacggccaagggaaagcucauaacggacgccugauuacagccaacccuguggucaccaagaaagaggaacccgugaauaucgaggccgaacccccuuuuggcgagucuaacauuaucauugggaucggcgauaaggcucuuaagaucaauugguacaaaaagggaagcuccauuggcaaaauguucgaagccacagcuagaggggcccggagaauggcgauccucggagacaccgccugggauuuuggcagcgucgggggaguucugaacucucugggcaagaugguccaccagauuuucggguccgcuuauacggcccucuuuagcggcgugucuuggaucaugaaaauuggaaucggcgugcugcuuacauggauugggcugaauagcaagaacaccuccaugucuuucagcugcaucgucaucggaauuaucacccucuaccugggcgcugugguucaggccgacauggggugugugauuaauuggaagggaaaagagcugaagugcggcuccgggaucuuugucacaaacgaggugcauaccuggacagaacaguauaaauuccaagcggauagcccgaagcgccuugccacggcuauuguuggcgccugggagaauggaguguguggcauccggucuaccacaagaauggaaaaccuccuguggaaacagaucgcuaaugagcugaacuacauucucugggaaaauaacaucaagcugaccgucgugguuggggacauuaucggagugcuugagcagggcaaacgcacacugacaccccagccuauggagcucaaguauuccuggaagacgugggggaaagccaagauugucaccgccgaaauccaaaauagcucuuuuaucauugauggacccaacacaccugagugccccaacgcuucccgggcguggaaugugugggaaguggaggacuacggcuucggcgucuuuaccacaaacaucuggcugaaacugagagaaauguauacccagcuuugugaccaccgccucaugagcgccgcuguuaaggaugagcgggccgugcacgccgacaugggguacuggauugagucccagaaaaauggaucuuggaagcuggaaaaggcuagccugaucgaggugaaaacaugcaccuggccgaagucccauacgcucuggucuaacggcguccuggaaagcgauaugauuaucccuaaaucccuugccgggcccaucagccagcacaauuacagaccuggauaucauacacaaaccgcgggccccuggcaccuggggaagcucgagcuggacuucaacuacugcgagggaaccacagugguuauuaccgaaaauuguggcacgcgcggcccuucucugcggacaaccacaguguccgggaaacuuauccacgaguggugcuguagaagcugcacccugcccccgcugcgcuauaugggagaagauggcuguugguacgggauggagauucggccuaucaacgaaaaggaggagaauauggucaagucucugguguccgcuggaagcggcaaaguugacaacuuuacaaugggggugcucugccuggccauucuuuucgaagaggucaugagaggaaaguucggcaaaaagcauaugaucgccggcgugcuguuuauguucguucuccugcugucugggcagauuaccuggcgggauauggcucgcacgcuuaucaugaucggaagcaaugccuccgacagaaugggcaugggggugaccuaucuggcgcucauugcuacauuuaaaauccagcccuuccuggcccucggauuuuuccugcggaaacuuaccagcagagaaaaccugcuccugggcgucgggcuggccauggcuacaacccuucaacugcccgaggauauugaacagauggccaauggaaucgcucucggccugauggugcucaagcugauuacgcaguuugagacauaccagcuuuggaccgcccuggugucucucacauguuccaacaccaucuucacccugacagucgcguggcgcacggccacccugauccuugcuggcacaagccugcucccuguuugccaauccucuagcaugcggaaaaccgacuggcugccgaugacaguggccgcuaugggggugcccccucucccccuguuuauuuucucccuuaaggauacccugaaaagacgcucuuggccucugaaugagggagucauggccgugggccucguuagcauccuggccuccucucuucugagaaacgacgugcccauggcugggccucucgucgcgggaggccugcucauugccuguuaugugaucacggggacaagcgcugaucugaccguugaaaaggccgccgacgugaccugggaggaagaggcugaacagacaggagucucccacaaccuuaugauuaccguggacgaugacggcacaaugcggaucaaagaugacgagacggagaauauccugaccguccugcucaagacagcccugcuuauugugagcggcaucuuucccuacucuauuccggcgacccugcucguuuggcauacauggcagaaacagacccaacgcuccggggugcugugggaugucccuucucccccugaaacgcagaaggcugagcucgaagagggaguguacagaaucaagcagcagggcauuuucgggaaaacccaaguuggagugggcguccagaaggaggggguguuucacacaauguggcaugugacccggggagccguucugacauauaacggcaaacgccuugaacccaauugggccuccgucaagaaagaccugaucuccuacggcgggggauggagacugagcgcucaguggcaaaagggcgaggaaguccaggugauugccgucgagccggggaagaacccuaaaaauuuccagaccaugcccggaaucuuccagacaaucacgggcgaaauuggggcgaucgcucucgauuuuaagccuggaaccucuggcucccccauuaucaaccgggagggcaaagugguugggcuguauggaaauggcguggucacaaagaacgggggauacgugagcggcauugcccaaaccaaugccgagcccgacgggccuaccccggaacuugaggaagagauguucaaaaagcgcaaccugacaaucauggaucuccaccccggcuccggaaagacgagaaaauaucugccuaccaucguucgggaagcuauuaagcgcagacuccggacacugauccuugcccccaccagaguggucgcugccgagauggaggaagcgcugaaaggccugccuauucgcuaccagacaaccgccacaaagagcgagcacacagggaaagaaaucguggaccucaugugccaugcuaccuuuaccaugcggcugcuuucucccguuagagugccuaauuauaaccugauuaucauggaugaggcccacuucacagacccggcuagcaucgccgcccgcggauacauuuccacccgggucggcaugggggaagcugcggccaucuuuaugacagcuacacccccuggaacggccgaugccuucccccagucuaaugcuccuauucaggacgaggagagagacauccccgaacgcagcuggaacuccggcaaugauuggauuacagacuuugccgggaagaccgugugguucgugccgucuaucaaggcgggcaacgauauugcuaacugucuccggaaaaauggaaagaaagucauccaacugagcagaaagacauuugacaccgaguaccagaaaacgaagcugaacgauugggacuucguugugaccacagauaucuccgaaaugggcgccaauuuuaaggccgaccgcgugauugauccucggagaugccucaaacccgucauccuuaccgacgggcccgagcgggugauucuggcuggaccuaugcccguuacaguggccucugcggcccagcgcagaggccgggucgggcgcaacccucagaaggagaaugaucaauauaucuucaccggacagccgcugaacaaugacgaagaccaugcucacuggacagaggccaaaaugcuccuggauaacauuaauacccccgaaggcaucaucccugcucuuuucgagcccgaaagagaaaagagcgccgcuauugacggggaguaccggcugaaaggcgaauccagaaagacguuuguggagcucaugcgccggggagaucugccuguuuggcuggcccauaaaguggcgagcgaaggcaucaaguauacagacagaaaguggugcuucgauggggagcgcaacaaucagauucucgaagagaacauggacgucgagaucuggaccaaagaaggagagaagaagaaacuucggcccagauggcuggaugcccgcaccuacucugacccgcuggcucucaaagaauuuaaagauuucgccgcuggccggaaguccauugcccuggaccuugugacagagaucgggagagucccuagccaccuggcccaccgcaccagaaaugcucucgauaaccuggugaugcugcauacaucugaacacggaggccgggcguaucgccaugccguugaggagcuccccgaaacgauggagacccuucugcugcucggccugaugauccuucugacagggggagcuaugcucuuucugauuuccggcaaaggggugggaaagaccagcaucggccugauuuguguggucgccuccucugggaugcucuggauggccgacaucccucuucaguggauugcuagcgccaucguucuggaguucuuuaugauggugcugcucauucccgagccugagaaacaaagaacaccccaggauaaucagcuggcguacguggucaucggaauccuuacccuggccgcuauuguggccgcuaacgaaaugggccuccuggagacgaccaagcgggaccugggcauguccaaagaaccggggguugugagcccuacaucuuaucucgacgucgaucuucaccccgccuccgcguggacccuguacgccguggcuacaaccgucaucacgcccaugcugcgccacacaauugagaauagcaccgccaacgugucucucgcugccaucgcuaaccaagccguugugcugaugggacuugacaagggcuggccuauuagcaagauggaucugggggucccgcuccuggcgcugggaugcuacucccaggugaauccccucacacuuaccgccgcuguucugcugcucgugacccauuaugccaucaucggcccugggcugcaggcuaaagccacaagagaagcccagaagcggacggcggcuggaauuaugaaaaaccccaccgucgacggcaucaugacaauugaucuugacccugugaucuacgauucuaaguucgagaaacaacugggccaggugaugcuccugguucugugugccguccagcuccuucugaugagaaccagcugggcuuuuugcgaggcccugacacucgccaccgggcccauuacgacacugugggaaggauccccuggcaaguucuggaauaccaccaucgcugugucuauggccaacaucuuucgcgggagcuaucuugcgggagccggccuggcuuucuccauuaugaaaagcguggggacaggaaaacggggcaccggcucucagggggagacacucggagaaaaguggaaaaagaaacugaaucaacuguccagaaaggaguuugaccucuacaaaaagagcggcaucacggaagucgaucgcaccgaggccaaggaggggcuuaaacggggagaaauuacacaccaugcuguuuccagaggcucugccaagcugcagugguucguggagcggaacauggugaucccggaagggcgcgucauugaccugggauguggcagaggcggguggagcuauuacugcgcgggacucaaaaaggugaccgagguucggggcuauacaaaagggggacccggccacgaggaaccugugcccauguccaccuacggguggaauaucgucaagcugaugucuggaaaggauguguucuaccuuccucccgagaaaugugacacgcugcucugcgauauuggcgaaagcuccccgagcccuaccguugaggaaucucgcacaaucagagugcugaagauggucgagcccuggcugaaaaacaaucaguuuuguaucaaggugcucaaccccuauaugccuaccgugauugagcaucuugaacggcugcagcgcaaacacggcgggaugcuggucagaaauccccucucccggaacagcacacacgagauguacuggaucucuaauggaaccggcaacauuguuuccagcgugaauauggugucucgccugcuucugaacagauucacaaugaccuaucggagaccuacgaucgaaaaggacgucgaccucggggccggaacacgccaugugaacgcugagccggaaacccccaauauggauguuauuggcgagcggaucagacgcaucaaggaggaacacagcuccaccuggcauuacgacgaugagaacccuuauaaaacaugggccuaccacgggucuuaugaagugaaggcuacgggaagcgccuccagcaugauuaauggcgucgugaaacugcugaccaagcccugggacguugugccuacagucacccaaauggcuaugacagauaccacacccuuuggccagcagcggguguucaaagagaagguugacaccagaacgccgaagccuaugcccgggacccgcaaaaucauggaaauuacagccggauggcucuggcggacccugggcagaaacaagcgcccucggcuuugcacaagagaggaguuuaccaaaaaggugcgcacgaaugcggccaugggggcugucuucacagaagagaaccaaugggauuccgcccgggcugccguggaagacgaggaauuuuggaaacuggucgauagagagcgcgagcuccacaagcagggaaaauguggcucuugcguguacaauaugauggggaagagagaaaagaaacugggcgaguucggaaaggccaaaggcagccgggcgaucugguacauguggcuuggggcucgcuaucuggaauuugaggcccucggauuccugaacgaggaccauugguuuuccagagaaaauucuuacagcggcguugagggggaaggacugcacaagcucggcuauauucugcgggauaucuccaaaauccccgggggcgccauguacgcugacgacaccgccggaugggauacaagaauuaccgaggacgaucuucauaacgaagagaagaucacgcagcagauggacccugagcaccggcaacuggcuaaugccauuuucaagcucaccuaucagaacaaaguggucaaggugcagcgccccacaccgaaaggcaccgugauggauaucauuucuagaaaggaccagcgggggagcggacaaguuggcacauacgggcugaauaccuuuacaaacauggaagcgcagcuuauccgccagauggagggagaaggcgugcuguccaaaaccgaucucgagaauccucaucugcuggaaaagaagaucacgcaguggcucgagacaaaaggggucgagagacugaagcggauggccauuagcggcgacgauugcgugguuaaacccaucgacgaucgcuucgcuaacgcccuucuggcucucaacgacaugggaaaggugagaaaagauauuccccaauggcagccuucuaagggcuggcacgacuggcagcaggucccguucuguucccaccauuuucacgaacugaucaugaaggacgggcggaaucuugugguccccugccgcccucaagaugagcugauuggccgggcccggaucagccagggcgcgggguggucucucaaagaaaccgccugucugggaaaggcuuaugcccagaugugggcucugauguacuuccaucgcagagaccuccggcuggccuccaacgcuauuugcagcgccgugcccguucacugggugccuaccucucgcacaaccugguccauccacgcgcaucaccaauggaugacaacggagaauaugcuuaccgucuggaacagaguguggaucgaagauaaucccuggauggaggacaaaacaccuguuaccacaugggaggaugugcccuaccugggcaagcgggaagaccaguggugugggagccucauuggccugaccuccagagccacgugggcucagaacauccuuaccgccauucagcaaguccgcagccugaucggaaaugaggaauuucucgauuauaugccgucuaugaaacgguucagaaaggaggaggaaagcgagggcgccauuugguga

SEQ ID NO: 20893 - RNA, 9873 nt, Artificial Sequence
  derived and/or modified CDS sequence (opt5) from DENV-3__JQ920481__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagaacccaaacauggaugagcgcugagggcgccuggcggcagguggaaaaaguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccaacuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaagccguucagcacgaaaaucucaaguauaccgugauuaucacaguccauacgggggaccagcaccaggugggaaacgagacccaaggcguuacagcugaaaucaccccccaggccuccacaguggaggcuauucugccugaauacggcacccuggggcucgagugcagcccccgcacgggacuggacuuuaaugagaugauccuucugaccaugaaaaacaaggccuggaugguccauagacagugguucuuugaucucccucugcccuggacaucuggcgccaccacagaaaccccgacguggaauaaaaaggagcuucuggugacauucaaaaacgcucacgcgaagaagcaagaagucgugguucucgggucccaggagggagccaugcacaccgcucugacaggcgccaccgaaauucagaccagcgggggcacaucuaucuuugccggacaucugaaaugucggcucaagauggacaaacuggagcuuaagggcauguccuaugcuaugugccugaaugccuucgugcucaaaaaggaggucagcgaaacgcagcacgggaccauucugaucaagguggaguacaaaggagaagaugcgccuuguaagauccccuucuccacagaggacggccaagggaaagcucauaacggacgccugauuaccgccaacccuaucguuacaaagaaagaggaacccgugaauauugaggccgaacccccuuuuggcgagucuaacaucgucauugggaucggcgauaaggcucuuaagaucaauugguacaaaaagggaagcuccauuggcaaaauguucgaagccaccgcuagaggggcccggagaauggcgauccucggagacacggccugggauuuuggcagcguggggggagugcugaacucucugggcaagaugguucaccagauuuucggguccgcuuauacagcccucuuuagcggcgucucuuggaucaugaaaauuggaaucggcgugcugcuuaccuggauugggcugaauagcaagaacaccuccaugucuuucagcugcaucgugaucggaauuaucacacucuaccugggcgcugucgugcaggccgacaugggguguguuauuaauuggaagggaaaagagcugaagugcggcuccgggaucuuugugaccaacgagguccauacauggacggaacaguauaaauuccaagcggauagcccgaagcgccuugccaccgcuauugccggcgcuugggagaauggaguguguggcauccggucuacaaccagaauggaaaaccuccuguggaaacagaucgccaaugagcugaacuacauucucugggaaaauaacaucaagcugacaguuguggucggggacgugauuggaguucuugagcagggcaaacgcacccugacgccccagccuauggagcucaaguauuccuggaagaccugggggaaagccaagaucgugacagcugaaacccaaaauagcucuuuuauuaucgauggacccaacacaccugagugccccuccgcgagccgggccuggaacgucugggaaguggaggacuacggcuucggcguguuuaccacaaauaucuggcugaaacugagagaaauguauacccagcuuugugaccaccgccucauguccgcugccgucaaggaugagcgggccguucacgcugacaugggguacuggauugagucucagaaaaacggaagcuggaagcuggaaaaggccucccugaucgaggugaaaacgugcacauggccgaagucucauacccucuggagcaauggcgugcuggaauccgauaugauuaucccuaaaagccuugcggggcccauuucucagcacaacuacagaccuggauaucauacccaaacagcuggccccuggcaccuggggaagcucgagcuggacuucaauuacugcgagggaaccacggucgugaucacagaaaacuguggcacccgcggcccuucccugcggacaaccacaguuagcgggaaacuuauccacgaguggugcuguagaucuugcacccuccccccgcugcgcuauaugggagaagauggcuguugguacgggauggagauucggccuaucaaugaaaaggaggagaacauggugaagucccuggucagcgccggaucuggcaaagccgacaauuuuacgaugggggugcucugccuggcuauucuuuucgaagagguuaugagaggaaaguucggcaaaaagcauaugaucgccggcgcgcuguuuaccuucgugcuccugcugagcgggcagauuacauggcgggauauggcucacacccuuaucaugauuggauccaacgccagcgaccgcaugggcaugggggucacauaucuggcccucaucgcuaccuuuaaaauccagcccuuccuggcccucggauuuuuccugagaaagcuuacgucucgggaaaaucugcuccugggcguggggcuggcuauggccacaacccuucaacugcccgaggauauugaacagauggcgaacggaaucgcccucggccugauggcucucaagcugauuacacaguuugagaccuaccagcuuuggaccgcccugguuucccucauguguagcaauacaaucuucacgcugaccguggcuuggagaacagccacccugauucuugccgucaucucccugcucccugugugccaaucuagcuccaugcgcaaaacagacuggcugccgaugaccguggcugcgaugggcguccccccucucccccuguuuaucuucucucuuaaggauacgcugaaacggagaagcuggccucugaacgaggggguuauggccgugggacucguguccauucuggcuucuagcuuucuucgcaaugacguccccauggccggcccucugguggccgggggacuccugaucgcuuguuauguuauuacaggcaccuccgccgaucucaccguggaaaaggcggcugacgucacaugggaggaagaggccgaacagaccggggugagccauaaccugaugaucacaguugacgaugacggaacgaugagaauuaaagaugacgagaccgagaacauccuuacagugcugcugaagaccgcccuccugaucgucucuggcauuuuccccuacuccaucccggcuacacuucugguguggcacaccuggcagaaacagacgcaacggagcggcguccucugggaugugccuucucccccugaaacccagaaggccgagcuggaagaggggguuuaccgcauuaagcagcagggaaucuuuggcaaaacacaagugggggucggagugcagaaggagggcguuuuccauaccauguggcacgugacaagaggggcgguccucacccacaauggaaaacggcuggaacccaacugggcuaaugugaagaaagaccuuauuuccuauggcggcggguggaagcugagcgcccaguggcaaaagggagaggaagugcagguuaucgccgucgagccgggcaaaaacccuaagaauuuccagacaaugcccgggauuuuucagacgaccacaggagaaaucggcgcuaucgcccuggauuucaaaccugggaccucuggaucccccauuaucaaccgcgagggcaagguggugggccucuacgggaauggagucgugaccaaaaacggcggguauguuagcggaauugcucaaacaaaugccgagcccgacggcccuacgccggaacuggaggaagagauguuuaagaagagaaaccuuaccaucauggaucugcaucccggguccggcaaaacacggaaguaccucccugcgauugugcgcgaagccaucaaaagacggcugcgcacccucauccuggcucccacaagagucguggccgcugagauggaggaagcccuuaagggacugccuauucgguaucagaccacggccacaaaaagcgagcacaccggcagagaaaucguugaccugaugugccaugcuaccuucacaaugcgccuccugucucccgugcgggucccuaauuacaaccuuauugugauggaugaggcgcacuuuaccgacccggccagcaucgcugccagaggguauauuuccacacgcguuggaaugggcgaagccgcugccaucuucaugaccgcgacgcccccugggacagcugaugccuuuccccagucuaaugccccuauccaggacgaggagcgggacauucccgaaagaagcuggaacuccggaaaugaguggaucaccgauuucgcuggcaagacagugugguuugucccgucuauuaaggccgggaacgacaucgcgaacugucugcgcaaaaauggcaagaaagugauucaacucagccggaagaccuucgauacggaauaccagaaaaccaagcugaacgacugggauuuuguggucacaaccgacaucuccgagaugggagccaauuucaaggcugauagaguuauugacccucgccggugccugaaacccgugauccucacagauggccccgagagagugauccuugccgggccuaugcccgucaccguggcuucugccgcucagcggcgcggaagaguuggccggaacccucagaaggaaaaugaccaauacauuuucacagggcagccgcugaacaaugaugaggaccaugcccacuggaccgaagcgaaaaugcugcucgacaacaucaauacgcccgagggaauuaucccugcccuguuugaacccgagcgcgagaagagcgcugccauugauggcgaauauagacuuaaaggggagucccggaagacauucguggaacugaugagacgcggcgaccucccugucuggcuggcucacaaaguggccagcgagggaaucaaguacaccgaucggaaguggugcuuugacggcgaaagaaacaaucagauccuggaggagaacauggauguugaaauuuggaccaaagagggggaaaagaaaaagcuccgcccccgguggcuugacgccagaacauauucugauccgcuggcucugaaagaguucaaggacuuugcggccggacgcaaguccaucgcucucgaucuggugaccgaaauuggccgggucccuagccaucuugcccacagaacacgcaaugcccuggacaaccucgugaugcugcauacgucugagcacgggggaagagcuuaccggcacgccgucgaggaacugcccgagaccauggaaacacuccuucugcugggccucaugauccugcuuaccggcggggcgaugcuguuccucauuuccggaaaaggcaucgggaagacaagcaucggacugauuugugugguugccuccucuggcaugcuguggauggcugaugugccucuccaguggaucgccagcgcuauugugcuugaguuuuucaugaugguccugcugauccccgagccugaaaaacaacgcaccccccaggacaaucagcucgccuauguugugauugggauccugacgcuugcggccauuguggcugccaacgagaugggacugcucgaaaccacaaagagagaucugggcauguccaaagagccgggcgucgugagcccuaccucuuaccuggacguugaccuccaucccgcuuccgccuggacacuuuaugcuguggccaccacggucaucacacccaugcugcggcacaccaucgaaaauagcacagcgaacgugucucuggccgcuauugccaaccaagcugucgugcucauggggcuggauaagggauggccuaucagcaagauggaccuuggcguuccgcugcucgcccuggggugcuacucccaggugaauccccugacccucaccgccgcgguccuucugcuggugacacauuacgcuauuaucggaccuggccuccaggccaaagcuacgcgcgaggcccagaagagaaccgccgcugggauuaugaaaaaccccacaguugauggaaucaugaccaucgaccuggauccugugauuuaugacucuaaguuugagaaacaacuuggccaggucaugcugcucgugcugugugccgugcagcugcuccuuaugcggacaagcugggcguucugcgaagcccugacccuggcuacgggccccaucacaacccucugggagggguccccuggaaaguuuuggaauaccacaauugccguuucuauggcuaacaucuucagaggcagcuaccuggccggggcgggacuugccuuuuccauuaugaagagcgucggcaccgggaaacgcggaacaggcucucagggcgaaacgcugggggagaaguggaaaaagaaacucaaucaacugucccggaaggaauucgaucuguauaaaaagagcggaaucaccgagguggacagaacagaggcuaaggaaggccucaaacgcggggagaucacccaccaugccgugucccggggaucugcuaagcuucagugguucgucgaaagaaacaugguuauuccggagggccgggugaucgaucugggguguggacgcggcggcuggagcuacuauugcgccgggcugaaaaaggugacagaagucagaggauacaccaaaggcgggcccggacacgaggagccugugcccauguccacguauggcuggaauauuguuaagcucaugucugggaaggacguguuuuaccugccucccgaaaaaugugauacccuucugugcgacaucggagagagcuccccgagcccuacagucgaagagucucggaccauucgcgugcucaagaugguugagcccuggcugaaaaacaaucaguucuguaucaaggugcugaaccccuacaugccuacagucauugaacaccucgagagacuucagcggaaacauggcggcaugcuggugcgcaauccccuguccagaaacagcacccacgaaauguauuggaucucuaaugggacaggaaacaucguguccagcgucaauaugguuucucggcuccugcuuaaccgcuuuaccaugacgcauagacggccuacaauugagaaggauguggaccugggcgcugggaccagacacgugaacgccgaaccggagacccccaauauggacgucaucggagagcgcauucggagaaucaaggaagagcacagcuccacauggcauuacgaugacgaaaacccuuauaaaacgugggcguaccacggcucuuaugaggugaaggccaccgggagcgcuuccagcaugauuaauggaguugugaaacuccugacaaagcccugggaugucgugccuaugguuacccaaauggccaugacagacaccacacccuucggccagcagcgcguguuuaaagaaaaggucgauacccggacgccgagaccuaugcccggcacccgcaaggugauggagaucacagcugaguggcuguggcggacccucgggagaaacaaacgcccucggcugugcacaagagaagaguucaucaagaaaguucgcaccaaugccgccaugggagcgguguuuacggaagagaaccaaugggacuccgcucgggccgccgucgaagaugaggaguucuggaagcuuguggacagagaacgcgagcugcauaaacucggcaagugugggucuugcgucuacaauaugaugggaaaaagagaaaagaagcugggcgaguuugggaaagcuaagggcagccgggccauuugguauauguggcuuggagcucgcuaccuggaguucgaagcccucggcuuucugaacgaggaucacugguucuccagagaaaauucuuacagcgggguggagggagaaggccugcauaaacucggguauauccugcgggacauuuccaagauccccggaggcgcgauguacgccgaugacacagcugggugggacaccagaauuacagaggaugaccuucacaacgaggaaaaaaucacccagcagauggauccugagcaccggcagcuggccaaugcuaucuuuaagcucacguaucaaaacaagguugugaaaguccagcgccccaccccgaagggcacagugauggacauuaucucuagaaaagaucagcggggaagcggccagguggggaccuacggacugaauacauucaccaacauggaagcccaacuuauucgccagauggagggcgaagggguucuguccaaggcggaccucgagaauccucaucugcuggagaaaaaggugacacaguggcucgaaaccaagggagucgagagacugaaacggauggccaucagcggcgaugacugcgugguuaagcccauugaugaccgcuucgcuaacgcccuucuggcucucaacgauauggggaaagugagaaaggacaucccccaguggcaaccuucuaaaggcuggcacgauuggcagcaggucccguuuuguucccaucacuuccacgaacugaucaugaaggacggacggaagcuugugguccccugccgcccucaggacgagcugauuggcagagcccggaucagccaaggggcuggauggucucuccgcgaaacggccugucugggcaaagcguaugcccagaugugggcucugauguacuuucauagacgggaucuccgccuggccuccaaugccauuugcagcgcugugcccguucacugggugccuacaucuagaaccaccugguccauccaugcccaccaucaguggaugacaaccgaggacaugcuuacagucuggaaccggguguggauugaggauaaucccuggauggaagacaagacgccuguuaccacaugggaggaugugcccuaucuggggaaaagagaagaccaaugguguggaagccucaucggccugaccucccgcgcgacaugggcucagaacauucuuaccgccauccagcagguccggagccugaucgggaaugaggaguuccucgauuacaugccgucuaugaagagauuucgcaaagaagaggaaagcgagggcgccauuugguga

SEQ ID NO: 20894 - RNA, 9873 nt, Artificial Sequence
  derived and/or modified CDS sequence (opt5) from DENV-3__JQ920483__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagaacccaaacauggaugagcgcugagggcgccuggcggcagguggaaaaaguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccaacuggcuacacuucgcaaacuguguauugagggaaagaucaccaacgugacgacagauuccagaugcccuacccagggcgaagccauucucccggaggaacagaaucagaacuauguguguaaacacaccuacgucgaccggggcugggggaauggaugcggccuguuugggaagggaagccuugugacaugcgcgaaguuccaaugucuggagucuaucgagggcaaagccguucagcacgaaaaccucaaguauaccgugauuaucacaguccauacgggggaucagcaccaggugggaaaugagacccaaggcguuacagcugaaaucaccccccaggccuccacaguggaggcuauucugccugaauacggcacccuggggcucgagugcagcccccgcacgggacuggacuuuaacgagaugauccuucugaccaugaaaaauaaggccuggaugguccauagacagugguucuuugaccucccucugcccuggacaucuggcgccaccacagaaaccccgacguggaacaaaaaggagcuucuggugacauucaaaaaugcucacgcgaagaagcaagaagucgugguucucgggucccaggagggagccaugcacaccgcucugacaggcgccaccgaaauucagaccagcgggggcacaucuaucuuugccggacaucugaaaugucggcucaagauggauaaacuggagcuuaagggcauguccuaugcuaugugccugaacgccuucgugcucaaaaaggaggucagcgaaacgcagcacgggaccauucugaucaagguggaguacaaaggagaagacgcgccuuguaagauccccuucuccacagaggauggccaagggaaagcucauaacggacgccugauuaccgccaauccuaucguuacaaagaaagaggaacccgugaacauugaggccgaacccccuuuuggcgagucuaauaucgucauugggaucggcgacaaggcucuuaagaucaacugguacaaaaagggaagcuccauuggcaaaauguucgaagccaccgcuagaggggcccggagaauggcgauccucggagauacggccugggacuuuggcagcguggggggagugcugaauucucugggcaagaugguucaccagauuuucggguccgcuuauacagcccucuuuagcggcgucucuuggaucaugaaaauuggaaucggcgugcugcuuaccuggauugggcugaacagcaagaauaccuccaugucuuucagcugcaucgugaucggaauuaucacacucuaccugggcgcugucgugcaggccgauaugggguguguuauuaacuggaagggaaaagagcugaagugcggcuccgggaucuuugugaccaaugagguccauacauggacggaacaguauaaauuccaagcggacagcccgaagcgccuugccaccgcuauugccggcgcuugggagaacggaguguguggcauccggucuacaaccagaauggaaaaucuccuguggaaacagaucgccaacgagcugaauuacauucucugggaaaacaauaucaagcugacaauuguugugggggaugucaucggagugcuugagcagggcaaacgcacccugacgccccagccuauggagcucaaguauuccuggaagaccugggggaaagccaagauuguuacagcugaaacccaaaacagcucuuuuaucaucgacggacccaacacaccugagugccccuccgcgagccgggccuggaaugugugggaagucgaggauuacggcuucggcguguuuaccacaaacauuuggcugaaacugagagaaaaguauacccagcuuugugaccaccgccucauguccgcugccgugaaagacgagcgggccguccacgcugauaugggguacuggaucgagucucagaagaauggaagcuggaagcuggaaaaagccucccugauugagguuaagacgugcacauggccgaaaucucauacccucuggagcaacggcgugcuggaauccgacaugaucauuccuaagagccuugcggggcccaucucucagcacaauuacagaccuggauaucauacccaaacagcuggccccuggcaccuggggaaacucgagcuggauuucaacuacugcgagggaaccacgguggucaucacagaaaauuguggcauucgcggcccuucccugcggaccacaaccgugagcgggaagcuuauccacgaguggugcuguagaucuugcacacuccccccgcugcgcuauaugggagaagacggcuguugguacgggauggagauucggccuaucaacgaaaaggaggagaauaugguuaaaucccuggugagcgccggaucuggcaagaccgauaacuuuacgauggggguccucugccuggccauucuuuucgaagaggugaugagaggaaaauucggcaagaaacauaugaucgcuggcgcccuguuuaccuucguucuccugcugagcgggcagauuacauggcgggacauggcgcacacccuuaucaugaucggauccaaugcuagcgaucgcaugggcaugggggugacauaucuggcccucauugccaccuuuaagauccagcccuuccuggcucucggauuuuuccugagaaagcuuacgucucgggaaaaccugcuccugggcgucgggcuggccauggcuacaacccuucaacugcccgaggacauugaacagauggccaauggaaucgcgcucggccugauggcccucaaacugauuacacaguuugagaccuaccagcuuuggaccgcucugaucucccucauguguagcaacacaaucuucacgcugaccguggccuggagaacagcuacccugauucuugccguuaucucccugcucccugugugccaaucuagcuccaugcgcaagacagauuggcugccgaugaccgucgccgcuaugggcgugcccccucucccccuguuuauuuucucucuuaaagacacgcugaagcggagaagcuggccucugaaugagggggugauggcggucggacucguuuccauccuggccucuagcuuucuucgcaacgaugugcccauggcuggcccucugguggccgggggacuccugauugccuguuaugucaucacaggcaccuccgcugaccucaccguggaaaaagccgcggauguuacaugggaggaagaggcugaacagaccggggugagccauaaccugaugaucacagucgacgacgauggaacgaugagaauuaaggacgaugagaccgagaauauccuuacagugcugcugaaaaccgcccuccugauuguuucuggcaucuuccccuacuccauuccggccacacuucugguguggcacaccuggcagaagcagacgcaacggagcggcguccucugggacgugccuucucccccugaaacccagaaggcugagcuggaagagggggucuaccgcaucaaacagcagggaauuuuuggcaagacacaaguggggguuggagugcagaaagagggcgucuuccauaccauguggcacgugacaagaggggccguucucacccacaacggaaagcggcuggaacccaauugggcgaacgugaaaaaggaucuuaucuccuauggcggcggguggaagcugagcgcucaguggcaaaaaggagaggaaguccaggugaucgccguggagccgggcaagaauccuaaaaacuuccagacaaugcccgggauuuuucagacgaccacaggagaaaucggcgccauugcucuggacuucaagccugggaccucuggaucccccaucauuaaucgcgagggcaaaguugucggccucuacgggaacggaguggugaccaagaauggcggguaugucagcggaaucgcccaaacaaacgcugagcccgauggcccuacgccggaacuggaggaagagauguuuaagaaaagaaaucuuaccaucauggaccugcaucccggguccggcaagacacggaaauaccucccugccauugugcgcgaagcgaucaagagacggcugcgcacccucauucuggcccccacaagaguuguggcugccgagauggaggaagcucuuaaaggacugccuauccgguaucagaccacggccacaaagagcgagcacaccggcagagaaauugucgaucugaugugccaugccaccuucacaaugcgccuccugucucccgugcggguuccuaacuacaaucuuaucgugauggacgaggcucacuuuaccgauccggcgagcaucgccgcuagaggguauauuuccacacgcgucggaaugggcgaagccgccgcuaucuucaugaccgccacgcccccugggacagcggacgcuuuuccccagucuaacgccccuauucaggaugaggagcgggacauccccgaaagaagcuggaauuccggaaacgaguggauuaccgacuucgccggcaagacagugugguuuguuccgucuaucaaagcugggaacgauauugccaauugucugcgcaagaacggcaaaaaggugauccaacucagccggaaaaccuucgacacggaauaccagaagaccaagcugaaugauugggacuuugucgugacaaccgauaucuccgagaugggagcgaacuucaaagccgacagagugauugauccucgccggugccugaagcccgucauccucacagacggccccgagagaguuauucuugcugggccuaugcccgugaccguggccucugcugcccagcggcgcggaagagucggccggaauagccagaaagaaaacgaucaauacaucuucacagggcagccucugaauaacgacgaggaucaugcucacuggaccgaagccaagaugcugcucgacaauauuaacacgccggagggaaucauccccgcgcuguuugaaccugagcgcgagaaauccgccgcuauugacggcgaauauagacuuaagggggagagccggaaaacauucguggaacugaugagacgcggcgaucuccccguuuggcuggcccacaagguggcuucugagggaaucaaguacaccgaccggaaauggugcuuugauggcgaaagaaauaaccagauucuggaggagaauauggacgucgaaaucuggaccaaggagggggaaaaaaagaaacuccgcccucgguggcuugaugccagaacauauuccgacccccuggcccugaaggaguucaaggauuuugcugcgggacgcaaaagcauugcccucgaccuggugaccgaaaucggccggguuccgucucaucuugcucacagaacacgcaacgcccuggauaaucucgugaugcugcauacguccgagcacgggggaagagccuaccggcacgcugucgaggaacugccugagaccauggaaacacuccuucugcugggccucaugauccugcuuaccggcggggccaugcuguuccucauuagcggaaagggcaucgggaaaacauccauuggacugaucuguguggucgcgucuagcggcaugcuguggauggccgacgugccccuccaguggauugcuuccgccaucguucuugaguuuuucaugauggugcugcugauuccugagcccgaaaagcaacgcaccccucaggauaaccagcucgcuuauguggucaucgggauccugacgcuugccgcgauuguugccgcuaaugagaugggacugcucgaaaccacaaaaagagaccugggcaugagcaaggagcccggcguggugucuccgaccuccuaccuggaugucgaccuccauccugccagcgcuuggacacuuuaugccguggcuaccacgguuaucacacccaugcugcggcacaccauugaaaacucuacagccaacgugagccuggcggccaucgcuaaucaagccgucgugcucauggggcuggacaagggauggcccauuuccaaaauggaucuuggcgucccucugcucgcucuggggugcuacucucaggugaacccgcugacccucaccgccgccguucuucugcuggugacacauuacgcgaucaucggacccggccuccaggcuaaggccacgcgcgaggcucagaaaagaaccgccgccgggauuaugaagaauccuacagucgacggaaucaugaccauugaucuggaccccgugaucuaugauagcaaauuugagaagcaacuuggccagguuaugcugcucgugcugugugcuguccagcugcuccuuaugcggacauccugggccuucugcgaagcgcugacccuggccacgggcccuauuacaacccucugggaggggucucccggaaaguuuuggaacaccacaaucgcugugagcauggccaauaucuucagaggcuccuaccuggcuggggccggacuugcguuuagcauuaugaaaucugugggcaccgggaagcgcggaacaggcucccagggcgaaacgcugggggagaaauggaagaaaaagcucaaccaacugagccggaaagaauucgaccuguauaagaaguccggaaucaccgagguugauagaacagaggccaaagaaggccucaagcgcggggagauuacccaccaugcugucucucggggaagcgccaaacuucagugguucguggaaagaaauauggugaucccugagggccgggucauugaccugggguguggacgcggcggcugguccuacuauugcgcugggcugaagaaaguuacagaagugagaggauacaccaagggcgggccgggacacgaggagcccgugccuaugucuacguauggcuggaacaucgucaagcucaugagcgggaaagauguguuuuaccugcccccugaaaagugugacacccuucugugcgauauuggagaguccagccccucuccgacaguugaagagucccggaccauccgcgugcucaaaauggucgagccuuggcugaagaauaaccaguucuguaucaaagugcugaaucccuacaugcccacaguuauugaacaccucgagagacuucagcggaagcauggcggcaugcuggugcgcaacccucugagcagaaauucuacccacgaaauguauuggaucuccaacgggacaggaaauauugucagcucugugaacauggugagccggcuccugcuuaaccgcuuuaccaugacgcauagacggcccacaaucgagaaggacgucgaucugggcgccgggaccagacacguuaaugcugaaccugagaccccgaacauggacgugauuggagagcgcauccggagaaucaaagaagagcacuccucuacauggcauuacgacgaugaaaaucccuauaagacgugggccuaccacggcagcuaugaggugaaagcgaccggguccgccagcuccaugauuaacggagucgugaagcuccugacaaaaccuugggacguugugcccauggucacccaaauggcuaugacagauaccacaccuuucggccagcagcgcguguuuaaggaaaagguugacacccggacgcccagaccgaugccuggcacccgcaaagugauggagaucacagccgaguggcuguggcggacccucgggagaaauaagcgcccccggcugugcacaagagaagaguucauuaaaaagguccgcaccaacgcugccaugggagccguguuuacggaagagaaucaaugggauucugcgcgggcugccguugaagacgaggaguucuggaaacuuguggauagagaacgcgagcugcauaagcucggcaaaugugggagcugcgucuacaacaugaugggaaagagagaaaagaaacugggcgaguuugggaaggccaaaggcucccgggcuaucugguauauguggcuuggagcccgcuaccuggaguucgaagcucucggcuuucugaaugaggaccacugguucucuagagaaaacagccauuccgggguggagggagaaggccugcacaagcucggguacauucugcgggauaucucuaaaaucccuggaggcgccauguaugcggacgauacagccgggugggacaccagaauuacagaggacgaucuucacaaugaggaaaagaucacccagcagauggaccccgagcaucggcagcuggcuaacgccauuuuuaagcucacguaccaaaauaaagucgugaagguucagcgcccuacccccaaaggcacagugauggauaucauuagcagaaaggaccagcggggauccggccaggucgggaccuauggacugaacacauucaccaauauggaagcucaacuuauccgccagauggagggcgaaggggugcugagcaaagccgaucucgagaacccgcaccugcuggagagaaaggugacacaguggcucgaaaccaagggaguugagcggcugaaacgcauggcgaucucuggcgacgauugcguggucaagccuauugacgauagauucgccaacgcucuucuggcccucaaugacauggggaaagugcggaaggauaucccccaguggcaacccuccaaaggcuggcaugacuggcagcagguuccuuuuuguagccaccacuuccaugaacugauuaugaaggauggacgcaagcuuguggucccgugcagaccccaggacgagcugaucggccgggcucgcauuucucaaggggccggauggucccucagagaaacggcuugucugggcaaagccuacgcgcagaugugggcccugauguauuuucaccggcgcgaccucagacuggcuagcaacgccaucugcucugccgugccuguccauugggugcccacaucccggaccaccuggagcauucacgcucaucaccaguggaugacaaccgaggauaugcuuacaguuuggaauagaguguggaucgaggacaacccuuggauggaagauaagacgcccgucaccacaugggaggacgugccuuaccuggggaaacgcgaagaucaaugguguggaucccucaucggccugaccagccgggccacaugggcgcagaauauucuuaccgcuauccagcagguuagaucucugauugggaacgaggaguuccucgacuauaugcccagcaugaagcgcuuucggaaagaagaggaauccgagggcgccaucugguga

SEQ ID NO: 20895 - RNA, 9873 nt, Artificial Sequence
  derived and/or modified CDS sequence (opt5) from DENV-3__JQ920482__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagaacccaaacauggaugagcgcugagggcgccuggcggcagguggaaaaaguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccaacuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaagccguucagcacgaaaaucucaaguauaccgugauuaucacaguccauacgggggaccagcaccaggugggaaacgagacccaaggcguuacagcugaaaucaccccccaggccuccacaguggaggcuauucugccugaauacggcacccuggggcucgagugcagcccccgcacgggacuggacuuuaaugagaugauccuucugaccaugaaaaacaaggccuggaugguccauagacagugguucuuugaucucccucugcccuggacaucuggcgccaccacagaaaccccgacguggaauaaaaaggagcuucuggugacauucaaaaacgcucacgcgaagaagcaagaagucgugguucucgggucccaggagggagccaugcacaccgcucugacaggcgccaccgaaauucagaccagcgggggcacaucuaucuuugccggacaucugaaaugucggcucaagauggacaaacuggagcuuaagggcauguccuaugcuaugugccugaaugccuucgugcucaaaaaggaggucagcgaaacgcagcacgggaccauucugaucaagguggaguacaaaggagaagaugcgccuuguaagauccccuucuccacagaggacggccaagggaaagcucauaacggacgccugauuaccgccaacccuaucguuacaaagaaagaggaacccgugaauauugaggccgaacccccuuuuggcgagucuaacaucgucauugggaucggcgauaaggcucuuaagaucaauugguacaaaaagggaagcuccauuggcaaaauguucgaagccaccgcuagaggggcccggagaauggcgauccucggagacacggccugggauuuuggcagcguggggggagugcugaacucucugggcaagaugguucaccagauuuucggguccgcuuauacagcccucuuuagcggcgucucuuggaucaugaaaauuggaaucggcgugcugcuuaccuggauugggcugaauagcaagaacaccuccaugucuuucagcugcaucgugaucggaauuaucacacucuaccugggcgcugucgugcaggccgacaugggguguguuauuaauuggaagggaaaagagcugaagugcggcuccgggaucuuugugaccaacgagguccauacauggacggaacaguauaaauuccaagcggauagcccgaagcgccuugccaccgcuauugccggcgcuugggagaauggaguguguggcauccggucuacaaccagaauggaaaaccuccuguggaaacagaucgccaaugagcugaacuacauucucugggaaaauaacaucaagcugacaauuguugugggggacgucaucggagugcuugagcagggcaaacgcacccugacgccccagccuauggagcucaaguauuccuggaagaccugggggaaagccaagauuguuacagcugaaacccaaaauagcucuuuuaucaucgauggacccaacacaccugagugccccuccgcgagccgggccuggaacgugugggaagucgaggacuacggcuucggcguguuuaccacaaauauuuggcugaaacugagagaaaaguauacccagcuuugugaccaccgccucauguccgcugccgugaaagaugagcgggccguccacgcugacaugggguacuggaucgagucucagaagaacggaagcuggaagcuggaaaaagccucccugauugagguuaagacgugcacauggccgaaaucucauacccucuggagcaauggcgugcuggaauccgauaugaucauuccuaagagccuugcggggcccaucucucagcacaacuacagaccuggauaucauacccaaacagcuggccccuggcaccuggggaaacucgagcuggacuucaauuacugcgagggaaccacgguggucaucacagaaaacuguggcauucgcggcccuucccugcggaccacaaccgugagcgggaagcuuauccacgaguggugcuguagaucuugcacacuccccccgcugcgcuauaugggagaagauggcuguugguacgggauggagauucggccuaucaaugaaaaggaggagaacaugguuaaaucccuggugagcgccggaucuggcaagaccgacaauuuuacgauggggguccucugccuggccauucuuuucgaagaggugaugagaggaaaauucggcaagaaacauaugaucgcuggcgcccuguuuaccuucguucuccugcugagcgggcagauuacauggcgggauauggcgcacacccuuaucaugaucggauccaacgcuagcgaccgcaugggcaugggggugacauaucuggcccucauugccaccuuuaagauccagcccuuccuggcucucggauuuuuccugagaaagcuuacgucucgggaaaaucugcuccugggcgucgggcuggccauggcuacaacccuucaacugcccgaggauauugaacagauggccaacggaaucgcgcucggccugauggcccucaaacugauuacacaguuugagaccuaccagcuuuggaccgcucugaucucccucauguguagcaauacaaucuucacgcugaccguggccuggagaacagcuacccugauucuugccguuaucucccugcucccugugugccaaucuagcuccaugcgcaagacagacuggcugccgaugaccgucgccgcuaugggcgugcccccucucccccuguuuauuuucucucuuaaagauacgcugaagcggagaagcuggccucugaacgagggggugauggcggucggacucguuuccauccuggccucuagcuuucuucgcaaugacgugcccauggcuggcccucugguggccgggggacuccugauugccuguuaugucaucacaggcaccuccgcugaucucaccguggaaaaagccgcggacguuacaugggaggaagaggcugaacagaccggggugagccauaaccugaugaucacagucgacgaugacggaacgaugagaauuaaggaugacgagaccgagaacauccuuacagugcugcugaaaaccgcccuccugauuguuucuggcaucuuccccuacuccauuccggccacacuucugguguggcacaccuggcagaagcagacgcaacggagcggcguccucugggaugugccuucucccccugaaacccagaaggcugagcuggaagagggggucuaccgcaucaaacagcagggaauuuuuggcaagacacaaguggggguuggagugcagaaagagggcgucuuccauaccauguggcacgugacaagaggggccguucucacccacaauggaaagcggcuggaacccaacugggcgaaugugaaaaaggaccuuaucuccuauggcggcggguggaagcugagcgcucaguggcaaaaaggagaggaaguccaggugaucgccguggagccgggcaagaacccuaaaaauuuccagacaaugcccgggauuuuucagacgaccacaggagaaaucggcgccauugcucuggauuucaagccugggaccucuggaucccccaucauuaaccgcgagggcaaaguugucggccucuacgggaauggaguggugaccaagaacggcggguaugucagcggaaucgcccaaacaaaugcugagcccgacggcccuacgccggaacuggaggaagagauguuuaagaaaagaaaccuuaccaucauggaucugcaucccggguccggcaagacacggaaauaccucccugccauugugcgcgaagcgaucaagagacggcugcgcacccucauucuggcccccacaagaguuguggcugccgagauggaggaagcucuuaaaggacugccuauccgguaucagaccacggccacaaagagcgagcacaccggcagagaaauugucgaccugaugugccaugccaccuucacaaugcgccuccugucucccgugcggguuccuaauuacaaccuuaucgugauggaugaggcucacuuuaccgacccggcgagcaucgccgcuagaggguauauuuccacacgcgucggaaugggcgaagccgccgcuaucuucaugaccgccacgcccccugggacagcggaugcuuuuccccagucuaaugccccuauucaggacgaggagcgggacauccccgaaagaagcuggaacuccggaaaugaguggauuaccgauuucgccggcaagacagugugguuuguuccgucuaucaaagcugggaacgacauugccaacugucugcgcaagaauggcaaaaaggugauccaacucagccggaaaaccuucgauacggaauaccagaagaccaagcugaacgacugggauuuugucgugacaaccgacaucuccgagaugggagcgaauuucaaagccgauagagugauugacccucgccggugccugaagcccgucauccucacagauggccccgagagaguuauucuugcugggccuaugcccgugaccguggccucugcugcccagcggcgcggaagagucggccggaacagccagaaagaaaaugaccaauacaucuucacagggcagccucugaacaaugaugaggaccaugcucacuggaccgaagccaagaugcugcucgacaacauuaauacgccggagggaaucauccccgcgcuguuugaaccugagcgcgagaaauccgccgcuauugauggcgaauauagacuuaagggggagagccggaaaacauucguggaacugaugagacgcggcgaccuccccguuuggcuggcccacaagguggcuucugagggaaucaaguacaccgaucggaaauggugcuuugacggcgaaagaaacaaucagauucuggaggagaacauggaugucgaaaucuggaccaaggagggggaaaaaaagaaacuccgcccucgguggcuugacgccagaacauauuccgauccccuggcccugaaggaguucaaggacuuugcugcgggacgcaaaagcauugcccucgaucuggugaccgaaaucggccggguuccgucucaucuugcucacagaacacgcaaugcccuggacaaccucgugaugcugcauacguccgagcacgggggaagagccuaccggcacgcugucgaggaacugccugagaccauggaaacacuccuucugcugggccucaugauccugcuuaccggcggggccaugcuguuccucauuagcggaaagggcaucgggaaaacauccauuggacugaucuguguggucgcgucuagcggcaugcuguggauggccgaugugccccuccaguggauugcuuccgccaucguucuugaguuuuucaugauggugcugcugauuccugagcccgaaaagcaacgcaccccucaggacaaucagcucgcuuauguggucaucgggauccugacgcuugccgcgauuguugccgcuaacgagaugggacugcucgaaaccacaaaaagagaucugggcaugagcaaggagcccggcguggugucuccgaccuccuaccuggacgucgaccuccauccugccagcgcuuggacacuuuaugccguggcuaccacgguuaucacacccaugcugcggcacaccauugaaaauucuacagccaacgugagccuggcggccaucgcuaaccaagccgucgugcucauggggcuggauaagggauggcccauuuccaaaauggaccuuggcgucccucugcucgcucuggggugcuacucucaggugaauccgcugacccucaccgccgccguucuucugcuggugacacauuacgcgaucaucggacccggccuccaggcuaaggccacgcgcgaggcucagaaaagaaccgccgccgggauuaugaagaacccuacagucgauggaaucaugaccauugaccuggaucccgugaucuaugacagcaaauuugagaagcaacuuggccagguuaugcugcucgugcugugugcuguccagcugcuccuuaugcggacauccugggccuucugcgaagcgcugacccuggccacgggcccuauuacaacccucugggaggggucucccggaaaguuuuggaauaccacaaucgcugugagcauggccaacaucuucagaggcuccuaccuggcuggggccggacuugcguuuagcauuaugaaaucugugggcaccgggaagcgcggaacaggcucccagggcgaaacgcugggggagaaauggaagaaaaagcucaaucaacugagccggaaagaauucgaucuguauaagaaguccggaaucaccgagguugacagaacagaggccaaagaaggccucaagcgcggggagauuacccaccaugcugucucucggggaagcgccaaacuucagugguucguggaaagaaacauggugaucccugagggccgggucauugaucugggguguggacgcggcggcugguccuacuauugcgcugggcugaagaaaguuacagaagugagaggauacaccaagggcgggccgggacacgaggagcccgugccuaugucuacguauggcuggaauaucgucaagcucaugagcgggaaagacguguuuuaccugcccccugaaaagugugauacccuucugugcgacauuggagaguccagccccucuccgacaguugaagagucccggaccauccgcgugcucaaaauggucgagccuuggcugaagaacaaucaguucuguaucaaagugcugaaccccuacaugcccacaguuauugaacaccucgagagacuucagcggaagcauggcggcaugcuggugcgcaauccucugagcagaaacucuacccacgaaauguauuggaucuccaaugggacaggaaacauugucagcucugugaauauggugagccggcuccugcuuaaccgcuuuaccaugacgcauagacggcccacaaucgagaaggaugucgaccugggcgccgggaccagacacguuaacgcugaaccugagaccccgaauauggacgugauuggagagcgcauccggagaaucaaagaagagcacuccucuacauggcauuacgaugacgaaaaccccuauaagacgugggccuaccacggcagcuaugaggugaaagcgaccggguccgccagcuccaugauuaauggagucgugaagcuccugacaaaaccuugggauguugugcccauggucacccaaauggcuaugacagacaccacaccuuucggccagcagcgcguguuuaaggaaaagguugauacccggacgcccagaccgaugccuggcacccgcaaagugauggagaucacagccgaguggcuguggcggacccucgggagaaacaagcgcccccggcugugcacaagagaagaguucauuaaaaagguccgcaccaaugcugccaugggagccguguuuacggaagagaaccaaugggacucugcgcgggcugccguugaagaugaggaguucuggaaacuuguggacagagaacgcgagcugcauaagcucggcaaaugugggagcugcgucuacaauaugaugggaaagagagaaaagaaacugggcgaguuugggaaggccaaaggcucccgggcuaucugguauauguggcuuggagcccgcuaccuggaguucgaagcucucggcuuucugaacgaggaucacugguucucuagagaaaauagccauuccgggguggagggagaaggccugcacaagcucggguacauucugcgggacaucucuaaaaucccuggaggcgccauguaugcggaugacacagccgggugggacaccagaauuacagaggaugaccuucacaacgaggaaaagaucacccagcagauggaucccgagcaucggcagcuggcuaaugccauuuuuaagcucacguaccaaaacaaagucgugaagguucagcgcccuacccccaaaggcacagugauggacaucauuagcagaaaggaucagcggggauccggccaggucgggaccuauggacugaauacauucaccaacauggaagcucaacuuauccgccagauggagggcgaaggggugcugagcaaagccgaccucgagaauccgcaccugcuggagaagaaggugacacaguggcucgaaaccaaaggaguugagagacugaagcggauggcgaucucuggcgaugacugcguggucaaaccuauugaugaccgcuucgccaacgcucuucuggcccucaacgauauggggaaggugagaaaagacaucccccaguggcaacccuccaagggcuggcaugauuggcagcagguuccuuuuuguagccaccacuuccaugaacugauuaugaaggacggacggaaacuuguggucccgugccgcccccaggacgagcugaucggcagagcucggauuucucaaggggccggauggucccuccgcgaaacggcuugucugggcaaggccuacgcgcagaugugggcccugauguauuuucacagacgggaucuccgccuggcuagcaaugccaucugcucugccgugccuguccauugggugcccacauccagaaccaccuggagcauucacgcucaucaccaguggaugacaaccgaggacaugcuuacaguuuggaaccggguguggaucgaggauaauccuuggauggaagacaaaacgcccgucaccacaugggaggaugugccuuaccuggggaagagagaagaccaaugguguggaucccucaucggccugaccagccgcgccacaugggcgcagaacauucuuaccgcuauccagcagguucggucucugauugggaaugaggaguuccucgauuauaugcccagcaugaaaagauuucgcaaggaagaggaauccgagggcgccaucugguga

SEQ ID NO: 20896 - RNA, 9873 nt, Artificial Sequence
  derived and/or modified CDS sequence (opt5) from DENV-3__JQ920484__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagaacccaaacauggaugagcgcugagggcgccuggcggcagguggaaaaaguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccaacuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaagccguucagcacgaaaaucucaaguauaccgugauuaucacaguccauacgggggaccagcaccaggugggaaacgagacccaaggcguuacagcugaaaucaccccccaggccuccacaguggaggcuauucugccugaauacggcacccuggggcucgagugcagcccccgcacgggacuggacuuuaaugagaugauccuucugaccaugaaaaacaaggccuggaugguccauagacagugguucuuugaucucccucugcccuggacaucuggcgccaccacagaaaccccgacguggaauaaaaaggagcuucuggugacauucaaaaacgcucacgcgaagaagcaagaagucgugguucucgggucccaggagggagccaugcacaccgcucugacaggcgccaccgaaauucagaccagcgggggcacaucuaucuuugccggacaucugaaaugucggcucaagauggacaaacuggagcuuaagggcauguccuaugcuaugugccugaaugccuucgugcucaaaaaggaggucagcgaaacgcagcacgggaccauucugaucaagguggaguacaaaggagaagaugcgccuuguaagauccccuucuccacagaggacggccaagggaaagcucauaacggacgccugauuaccgccaacccuaucguuacaaagaaagaggaacccgugaauauugaggccgaacccccuuuuggcgagucuaacaucgucauugggaucggcgauaaggcucuuaagaucaauugguacaaaaagggaagcuccauuggcaaaauguucgaagccaccgcuagaggggcccggagaauggcgauccucggagacacggccugggauuuuggcagcguggggggagugcugaacucucugggcaagaugguucaccagauuuucggguccgcuuauacagcccucuuuagcggcgucucuuggaucaugaaaauuggaaucggcgugcugcuuaccuggauugggcugaauagcaagaacaccuccaugucuuucagcugcaucgugaucggaauuaucacacucuaccugggcgcugucgugcaggccgacaugggguguguuauuaauuggaagggaaaagagcugaagugcggcuccgggaucuuugugaccaacgagguccauacauggacggaacaguauaaauuccaagcggauagcccgaagcgccuugccaccgcuauugccggcgcuugggagaauggaguguguggcauccggucuacaaccagaauggaaaaccuccuguggaaacagaucgccaaugagcugaacuacauucucugggaaaauaacaucaagcugacaauuguugugggggacgccaucggaguccuugagcagggcaaacgcacccugacgccccagccuauggagcucaaguauuccuggaagaccugggggaaagcuaagauugugacagcggaaacccaaaauagcucuuuuaucaucgauggacccaacacaccugagugccccuccgccagccgggcuuggaacguuugggaaguggaggacuacggcuucggcgucuuuaccacaaauauuuggcugaaacugagagaaaaguauacccagcuuugugaccaccgccucauguccgccgccgugaaagaugagcgggcugugcacgccgacaugggguacuggaucgagucucagaagaacggaagcuggaagcuggaaaaagcgucccugauugaggucaagacgugcacauggccgaaaucucauacccucuggagcaauggcguucuggaauccgauaugaucauuccuaagagccuugcugggcccaucucucagcacaacuacagaccuggauaucauacccaaacagccggccccuggcaccuggggaaacucgagcuggacuucaauuacugcgagggaaccacgguggugaucacagaaaacuguggcauucgcggcccuucccugcggaccacaaccgucagcgggaagcuuauccacgaguggugcuguagaucuugcacacuccccccgcugcgcuauaugggagaagauggcuguugguacgggauggagauucggccuaucaaugaaaaggaggagaacauggugaaaucccugguuagcgccggaucuggcaagaccgacaauuuuacgaugggggugcucugccuggcuauucuuuucgaagaggucaugagaggaaaauucggcaagaaacauaugaucgccggcgcgcuguuuaccuucgugcuccugcugagcgggcagauuacauggcgggauauggcucacacccuuaucaugaucggauccaacgccagcgaccgcaugggcauggggguuacauaucuggcccucauugcuaccuuuaagauccagcccuuccuggcccucggauuuuuccugagaaagcuuacgucucgggaaaaucugcuccugggcguggggcuggcuauggccacaacccuucaacugcccgaggauauugaacagauggcgaacggaaucgcccucggccugauggcucucaaacugauuacacaguuugagaccuaccagcuuuggaccgcccugaucucccucauguguagcaauacaaucuucacgcugaccgucgcuuggagaacagccacccugauucuugccgugaucucccugcucccuguuugccaaucuagcuccaugcgcaagacagacuggcugccgaugaccguggcugcgaugggcguccccccucucccccuguuuauuuucucucuuaaagauacgcugaagcggagaagcuggccucugaacgagggggugauggccgugggacucgucuccauccuggcuucuagcuuucuucgcaaugacguucccauggccggcccucugguggccgggggacuccugauugcuuguuaugugaucacaggcaccuccgccgaucucaccgucgaaaaagcggcugacgugacaugggaggaagaggccgaacagaccgggguuagccauaaccugaugaucacaguggacgaugacggaacgaugagaauuaaggaugacgagaccgagaacauccuuacaguccugcugaaaaccgcccuccugauugugucuggcaucuuccccuacuccauuccggcuacacuucugguuuggcacaccuggcagaagcagacgcaacggagcggcgugcucugggaugucccuucucccccugaaacccagaaggccgagcuggaagaggggguguaccgcaucaaacagcagggaauuuuuggcaagacacaagucggggugggaguucagaaagagggcguguuccauaccauguggcacgucacaagaggggcggugcucaccuauaauggaaagcggcuggaacccaacugggcuaauguuaaaaaggaccuuaucuccuacggcggcggguggaagcugagcgcccaguggcaaaaaggagaggaagugcaggucaucgccguggagccgggcaagaacccuaaaaauuuccagacaaugcccgggauuuuucagacgaccacaggagaaaucggcgcuauugcccuggauuucaagccugggaccucuggaucccccaucauuaaccgcgagggcaaagugguuggccucuaugggaauggagucgugaccaagaacggcggguacgugagcggaaucgcucaaacaaaugccgagcccgacggcccuacgccggaacuggaggaagagauguuuaagaaaagaaaccuuaccaucauggaucugcaccccggguccggcaagacacggaaauaucucccugcgauuguccgcgaagccaucaagagacggcugcgcacccucauucuggcucccacaagagugguugccgcugagauggaggaagcccuuaaaggacugccuauccgguaccagaccacggccacaaagagcgagcauaccggcagagaaauuguggaccugaugugccacgcuaccuucacaaugcgccuccugucucccguccgggugccuaauuauaaccuuaucguuauggaugaggcgcauuuuaccgacccggccagcaucgcugccagaggguacauuuccacacgcgugggaaugggcgaagccgcugccaucuucaugaccgcgacgcccccugggacagcugaugccuuuccccagucuaaugccccuauucaggacgaggagcgggacauccccgaaagaagcuggaacuccggaaaugaguggauuaccgauuucgcuggcaagacagucugguuugugccgucuaucaaagccgggaacgacauugcgaacugucugcgcaagaauggcaaaaagguuauccaacucagccggaaaaccuucgauacggaauaccagaagaccaagcugaacgacugggauuuuguggucacaaccgacaucuccgagaugggagccaauuucaaagcugauagagugauugacccucgccggugccugaagcccgugauccucacagauggccccgagagagucauucuugccgggccuaugcccguuaccguggcuucugccgcucagcggcgcggaagagugggccggaacagccagaaagaaaaugaccaauauaucuucacagggcagccucugaacaaugaugaggaccacgcccauuggaccgaagcgaagaugcugcucgacaacauuaauacgccggagggaaucauccccgcccuguuugaaccugagcgcgagaaauccgcugccauugauggcgaauacagacuuaagggggagagccggaaaacauucgucgaacugaugagacgcggcgaccuccccguguggcuggcucacaagguugccucugagggaaucaaguauaccgaucggaaauggugcuuugacggcgaaagaaacaaucagauucuggaggagaacauggauguggaaaucuggaccaaggagggggaaaaaaagaaacuccgcccucgguggcuugacgccagaacauacuccgauccccuggcucugaaggaguucaaggacuuugcggccggacgcaaaagcauugcucucgaucuggucaccgaaaucggccgggugccgucucaccuugcccauagaacacgcaaugcccuggacaaccucguuaugcugcacacguccgagcaugggggaagagcuuaucggcacgccguggaggaacugccugagaccauggaaacacuccuucugcugggccucaugauccugcuuaccggcggggcgaugcuguuccucauuagcggaaagggcaucgggaaaacauccauuggacugaucugugucguggccucuagcggcaugcuguggauggcugaugucccccuccaguggauugccuccgcuaucgugcuugaguuuuucaugaugguucugcugauuccugagcccgaaaagcaacgcaccccucaggacaaucagcucgccuacguggugaucgggauccugacgcuugcggccauugucgcugccaacgagaugggacugcucgaaaccacaaaaagagaucugggcaugagcaaggagcccggcguugugucuccgaccuccuaucuggacguggaccuccacccugcuagcgccuggacacuuuacgcugucgccaccacggugaucacacccaugcugcggcauaccauugaaaauucuacagcgaacguuagccuggccgcuaucgccaaccaagcugugguccucauggggcuggauaagggauggcccauuuccaaaauggaccuuggcgugccucugcucgcccuggggugcuacucucaggucaauccgcugacccucaccgccgcggugcuucugcugguuacacacuaugcuaucaucggacccggccuccaggccaaggcuacgcgcgaggcccagaaaagaaccgccgcugggauuaugaagaacccuacaguggauggaaucaugaccauugaccuggaucccgucaucuacgacagcaaauuugagaagcaacuuggccaggugaugcugcucguucugugugccgugcagcugcuccuuaugcggacauccugggcguucugcgaagcccugacccuggcuacgggcccuauuacaacccucugggaggggucucccggaaaguuuuggaauaccacaaucgccgucagcauggcuaacaucuucagaggcuccuaucuggccggggcgggacuugccuuuagcauuaugaaaucugugggcaccgggaagcgcggaacaggcucccagggcgaaacgcugggggagaaauggaagaaaaagcucaaucaacugagccggaaagaauucgaucuguacaagaaguccggaaucaccgagguggacagaacagaggcuaaagaaggccucaagcgcggggagauuacccaucacgccguuucucggggaagcgcuaaacuucagugguucgucgaaagaaacauggugaucccugagggccgggugauugaucugggguguggacgcggcggcugguccuauuacugcgccgggcugaagaaagucacagaaguuagaggauauaccaagggcgggccgggacaugaggagcccgugccuaugucuacguacggcuggaauaucgugaagcucaugagcgggaaagacgucuuuuaccugcccccugaaaagugugauacccuucugugcgacauuggagaguccagccccucuccgacaguggaagagucccggaccauccgcguucucaaaaugguggagccuuggcugaagaacaaucaguucuguaucaaaguccugaaccccuauaugcccacagugauugaacaccucgagagacuucagcggaagcacggcggcaugcugguucgcaauccucugagcagaaacucuacccaugaaauguacuggaucuccaaugggacaggaaacauugugagcucugucaauauggugagccggcuccugcuuaaccgcuuuaccaugacgcacagacggcccacaaucgagaaggauguggaccugggcgcugggaccagacaugucaacgccgaaccugagaccccgaauauggacguuauuggagagcgcauccggagaaucaaagaagagcacuccucuacauggcacuaugaugacgaaaaccccuacaagacgugggcguaucauggcagcuacgaggugaaagccaccggguccgcuagcuccaugauuaauggaguggucaagcuccugacaaaaccuugggaugugguucccauggugacccaaauggccaugacagacaccacaccuuucggccagcagcgcgucuuuaaggaaaagguggauacccggacgcccagaccgaugccuggcacccgcaaaguuauggagaucacagcugaguggcuguggcggacccucgggagaaacaagcgcccccggcugugcacaagagaagaguucauuaaaaaggugcgcaccaaugccgccaugggagcggucuuuacggaagagaaccaaugggacucugcucgggccgccguggaagaugaggaguucuggaaacuuguugacagagaacgcgagcugcacaagcucggcaaaugugggagcugcguguauaauaugaugggaaagagagaaaagaaacugggcgaguuugggaaggcuaaaggcucccgggccaucugguacauguggcuuggagcucgcuaccuggaguucgaagcccucggcuuucugaacgaggaucauugguucucuagagaaaauagccacuccggggucgagggagaaggccugcauaagcucggguauauucugcgggacaucucuaaaaucccuggaggcgcgauguacgccgaugacacagcugggugggacaccagaauuacagaggaugaccuucacaacgaggaaaagaucacccagcagauggaucccgagcaccggcagcuggccaaugcuauuuuuaagcucacguaucaaaacaaaguggucaaggugcagcgcccuacccccaaaggcacaguuauggacaucauuagcagaaaggaucagcggggauccggccagguggggaccuacggacugaauacauucaccaacauggaagcccaacuuauccgccagauggagggcgaagggguccugagcaaagcggaccucgagaauccgcaucugcuggagaagaaggugacacaguggcucgaaaccaaaggaguggagagacugaagcggauggccaucucuggcgaugacugcguugugaaaccuauugaugaccgcuucgcuaacgcccuucuggcucucaacgauauggggaaggucagaaaagacaucccccaguggcaacccuccaagggcuggcacgauuggcagcaggugccuuuuuguagccaucacuuccacgaacugauuaugaaggacggacggaaacuuguugugccgugccgcccccaggacgagcugaucggcagagcccggauuucucaaggggcuggauggucccuccgcgaaacggccugucugggcaaggcguaugcccagaugugggcucugauguacuuucauagacgggaucuccgccuggccagcaaugccaucugcucugcugucccugugcacuggguccccacauccagaaccaccuggagcauucaugcccaccaucaguggaugacaaccgaggacaugcuuacaguguggaaccggguuuggaucgaggauaauccuuggauggaagacaaaacgcccgugaccacaugggaggaugucccuuaucuggggaagagagaagaccaaugguguggaucccucaucggccugaccagccgcgcgacaugggcucagaacauucuuaccgccauccagcaggugcggucucugauugggaaugaggaguuccucgauuacaugcccagcaugaaaagauuucgcaaggaagaggaauccgagggcgccaucugguga

SEQ ID NO: 20897 - RNA, 9873 nt, Artificial Sequence
  derived and/or modified CDS sequence (opt5) from DENV-3__JQ920486__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagaacccaaacauggaugagcgcugagggcgccuggcggcagguggaaaaaguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccaacuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaagccguucagcacgaaaaucucaaguauaccgugauuaucacaguccauacgggggaccagcaccaggugggaaacgagacccaaggcguuacagcugaaaucaccccccaggccuccacaguggaggcuauucugccugaauacggcacccuggggcucgagugcagcccccgcacgggacuggacuuuaaugagaugauccuucugaccaugaaaaacaaggccuggaugguccauagacagugguucuuugaucucccucugcccuggacaucuggcgccaccacagaaaccccgacguggaauaaaaaggagcuucuggugacauucaaaaacgcucacgcgaagaagcaagaagucgugguucucgggucccaggagggagccaugcacaccgcucugacaggcgccaccgaaauucagaccagcgggggcacaucuaucuuugccggacaucugaaaugucggcucaagauggacaaacuggagcuuaagggcauguccuaugcuaugugccugaaugccuucgugcucaaaaaggaggucagcgaaacgcagcacgggaccauucugaucaagguggaguacaaaggagaagaugcgccuuguaagauccccuucuccacagaggacggccaagggaaagcucauaacggacgccugauuaccgccaacccuaucguuacaaagaaagaggaacccgugaauauugaggccgaacccccuuuuggcgagucuaacaucgucauugggaucggcgauaaggcucuuaagaucaauugguacaaaaagggaagcuccauuggcaaaauguucgaagccaccgcuagaggggcccggagaauggcgauccucggagacacggccugggauuuuggcagcguggggggagugcugaacucucugggcaagaugguucaccagauuuucggguccgcuuauacagcccucuuuagcggcgucucuuggaucaugaaaauuggaaucggcgugcugcuuaccuggauugggcugaauagcaagaacaccuccaugucuuucagcugcaucgugaucggaauuaucacacucuaccugggcgcugucgugcaggccgacaugggguguguuauuaauuggaagggaaaagagcugaagugcggcuccgggaucuuugugaccaacgagguccauacauggacggaacaguauaaauuccaagcggauagcccgaagcgccuugccaccgcuauugccggcgcuugggagaauggaguguguggcauccggucuacaaccagaauggaaaaccuccuguggaaacagaucgccaaugagcugaacuacauucucugggaaaauaacaucaagcugacaauuguugugggggacgccaucggaguccuugagcagggcaaacgcacccugacgccccagccuauggagcucaaguauuccuggaagaccugggggaaagcuaagauugugacagcggaaacccaaaauagcucuuuuaucaucgauggacccaacacaccugagugccccuccgccagccgggcuuggaacguuugggaaguggaggacuacggcuucggcgucuuuaccacaaauauuuggcugaaacugagagaaaaguauacccagcuuugugaccaccgccucauguccgccgccgugaaagaugagcgggcugugcacgucgacaugggguacuggaucgagucucagaagaacggaagcuggaagcuggaaaaagccucccugauugagguuaagacgugcacauggccgaaaucucauacccucuggagcaauggcgugcuggaauccgauaugaucauuccuaagagccuugcggggcccaucucucagcacaacuacagaccuggauaucauacccaaacagcuggccccuggcaccuggggaaacucgagcuggacuucaauuacugcgagggaaccacgguggucaucacagaaaacuguggcauucgcggcccuucccugcggaccacaaccgugagcgggaagcuuauccacgaguggugcuguagaucuugcacacuccccccgcugcgcuauaugggagaagauggcuguugguacgggauggagauucggccuaucaaugaaaaggaggagaacaugguuaaaucccuggugagcgccggaucuggcaagaccgacaauuuuacgauggggguccucugccuggccauucuuuucgaagaggugaugagaggaaaauucggcaagaaacauaugaucgcuggcgcccuguuuaccuucguucuccugcugagcgggcagauuacauggcgggauauggcgcacacccuuaucaugaucggauccaacgcuagcgaccgcaugggcaugggggugacauaucuggcccucauugccaccuuuaagauccagcccuuccuggcucucggauuuuuccugagaaagcuuacgucucgggaaaaucugcuccugggcgucgggcuggccauggcuacaacccuucaacugcccgaggauauugaacagauggccaacggaaucgcgcucggccugauggcccucaaacugauuacacaguuugagaccuaccagcuuuggaccgcucugaucucccucauguguagcaauacaaucuucacgcugaccguggccuggagaacagcuacccugauucuugccguuaucucccugcucccugugugccaaucuagcuccaugcgcaagacagacuggcugccgaugaccgucgccgcuaugggcgugcccccucucccccuguuuauuuucucucuuaaagauacgcugaagcggagaagcuggccucugaacgagggggugauggcggucggacucguuuccauccuggccucuagcuuucuucgcaaugacgugcccauggcuggcccucugguggccgggggacuccugauugccuguuaugucaucacaggcaccuccgcugaucucaccguggaaaaagccgcggacguuacaugggaggaagaggcugaacagaccggggugagccauaaccugaugaucacagucgacgaugacggaacgaugagaauuaaggaugacgagaccgagaacauccuuacagugcugcugaaaaccgcccuccugauuguuucuggcaucuuccccuacuccauuccggccacacuucugguguggcacaccuggcagaagcagacgcaacggagcggcguccucugggaugugccuucucccccugaaacccagaaggcugagcuggaagagggggucuaccgcaucaaacagcagggaauuuuuggcaagacacaaguggggguuggagugcagaaagagggcgucuuccauaccauguggcacgugacaagaggggccguucucacccacaauggaaagcggcuggaacccaacugggcgaaugugaaaaaggaccuuaucuccuauggcggcggguggaagcugagcgcucaguggcaaaaaggagaggaaguccaggugaucgccguggagccgggcaagaacccuaaaaauuuccagacaaugcccgggauuuuucagacgaccacaggagaaaucggcgccauugcucuggauuucaagccugggaccucuggaucccccaucauuaaccgcgagggcaaaguugucggccucuacgggaauggaguggugaccaagaacggcggguaugucagcggaaucgcccaaacaaaugcugagcccgacggcccuacgccggaacuggaggaagagauguuuaagaaaagaaaccuuaccaucauggaucugcaucccggguccggcaagacacggaaauaccucccugccauugugcgcgaagcgaucaagagacggcugcgcacccucauucuggcccccacaagaguuguggcugccgagauggaggaagcucuuaaaggacugccuauccgguaucagaccacggccacaaagagcgagcacaccggcagagaaauugucgaccugaugugccaugccaccuucacaaugcgccuccugucucccgugcggguuccuaauuacaaccuuaucgugauggaugaggcucacuuuaccgacccggcgagcaucgccgcuagaggguauauuuccacacgcgucggaaugggcgaagccgccgcuaucuucaugaccgccacgcccccugggacagcggaugcuuuuccccagucuaaugccccuauucaggacgaggagcgggacauccccgaaagaagcuggaacuccggaaaugaguggauuaccgauuucgccggcaagacagugugguuuguuccgucuaucaaagcugggaacgacauugccaacugucugcgcaagaauggcaaaaaggugauccaacucagccggaaaaccuucgauacggaauaccagaagaccaagcugaacgacugggauuuugucgugacaaccgacaucuccgagaugggagcgaauuucaaagccgauagagugauugacccucgccggugccugaagcccgucauccucacagauggccccgagagaguuauucuugcugggccuaugcccgugaccguggccucugcugcccagcggcgcggaagagucggccggaacagccagaaagaaaaugaccaauacaucuucacagggcagccucugaacaaugaugaggaccaugcucacuggaccgaagccaagaugcugcucgacaacauuaauacgccggagggaaucauccccgcgcuguuugaaccugagcgcgagaaauccgccgcuauugauggcgaauauagacuuaagggggagagccggaaaacauucguggaacugaugagacgcggcgaccuccccguuuggcuggcccacaagguggcuucugagggaaucaaguacaccgaucggaaauggugcuuugacggcgaaagaaacaaucagauucuggaggagaacauggaugucgaaaucuggaccaaggagggggaaaaaaagaaacuccgcccucgguggcuugacgccagaacauauuccgauccccuggcccugaaggaguucaaggacuuugcugcgggacgcaaaagcauugcccucgaucuggugaccgaaaucggccggguuccgucucaucuugcucacagaacacgcaaugcccuggacaaccucgugaugcugcauacguccgagcacgggggaagagccuaccggcacgcugucgaggaacugccugagaccauggaaacacuccuucugcugggccucaugauccugcuuaccggcggggccaugcuguuccucauuagcggaaagggcaucgggaaaacauccauuggacugaucuguguggucgcgucuagcggcaugcuguggauggccgaugugccccuccaguggauugcuuccgccaucguucuugaguuuuucaugauggugcugcugauuccugagcccgaaaagcaacgcaccccucaggacaaucagcucgcuuauguggucaucgggauccugacgcuugccgcgauuguugccgcuaacgagaugggacugcucgaaaccacaaaaagagaucugggcaugagcaaggagcccggcguggugucuccgaccuccuaccuggacgucgaccuccauccugccagcgcuuggacacuuuaugccguggcuaccacgguuaucacacccaugcugcggcacaccauugaaaauucuacagccaacgugagccuggcggccaucgcuaaccaagccgucgugcucauggggcuggauaagggauggcccauuuccaaaauggaccuuggcgucccucugcucgcucuggggugcuacucucaggugaauccgcugacccucaccgccgccguucuucugcuggugacacauuacgcgaucaucggacccggccuccaggcuaaggccacgcgcgaggcucagaaaagaaccgccgccgggauuaugaagaacccuacagucgauggaaucaugaccauugaccuggaucccgugaucuaugacagcaaauuugagaagcaacuuggccagguuaugcugcucgugcugugugcuguccagcugcuccuuaugcggacauccugggccuucugcgaagcgcugacccuggccacgggcccuauuacaacccucugggaggggucucccggaaaguuuuggaauaccacaaucgcugugagcauggccaacaucuucagaggcuccuaccuggcuggggccggacuugcguuuagcauuaugaaaucugugggcaccgggaagcgcggaacaggcucccagggcgaaacgcugggggagaaauggaagaaaaagcucaaucaacugagccggaaagaauucgaucuguauaagaaguccggaaucaccgagguugacagaauugaggccaaagaaggccucaagcgcggggagaucacacaccaugcugucucucggggaagcgccaaacuucagugguucguggaaagaaacauggugauuccugagggccgggucaucgaucugggguguggacgcggcggcugguccuacuauugcgcugggcugaagaaaguuaccgaagugagaggauacacaaagggcgggccgggacacgaggagcccgugccuaugucuaccuauggcuggaauauugucaagcucaugagcgggaaagacguguuuuaccugcccccugaaaagugugauacgcuucugugcgacaucggagaguccagccccucuccgaccguugaagagucccggacaauccgcgugcucaaaauggucgagccuuggcugaagaacaaucaguucuguauuaaagugcugaaccccuacaugcccaccguuaucgaacaccucgagagacuucagcggaagcauggcggcaugcuggugcgcaauccucugagcagaaacucuacacacgaaauguauuggauuuccaaugggaccggaaacaucgucagcucugugaauauggugagccggcuccugcuuaaccgcuuuacaaugacccauagacggcccacgauugagaaggaugucgaccugggcgccgggacaagacacguuaacgcugaaccugagaccccgaauauggacgugaucggagagcgcauccggagaauuaaagaagagcacuccucuaccuggcauuacgaugacgaaaaccccuauaagacaugggccuaccacggcagcuaugaggugaaagcgacgggguccgccagcuccaugaucaauggagucgugaagcuccugaccaaaccuugggauguugugcccauggucacacaaauggcuaugaccgacacaaccccuuucggccagcagcgcguguuuaaggaaaagguugauacacggacccccagaccgaugccuggcacgcgcaaagugauggagauuaccgccgaguggcuguggcggacacucgggagaaacaagcgcccccggcugugcaccagagaagaguucaucaaaaagguccgcacaaaugcugccaugggagccguguuuaccgaagagaaccaaugggacucugcgcgggcugccguugaagaugaggaguucuggaaacuuguggacagagaacgcgagcugcauaagcucggcaaaugugggagcugcgucuacaauaugaugggaaagagagaaaagaaacugggcgaguuugggaaggccaaaggcucccgggcuauuugguauauguggcuuggagcccgcuaccuggaguucgaagcucucggcuuucugaacgaggaucacugguucucuagagaaaauagccauuccgggguggagggagaaggccugcacaagcucggguacauccugcgggacaucucuaaaauuccuggaggcgccauguaugcggaugacacggccgggugggacacaagaaucaccgaggaugaccuucacaacgaggaaaagauuacacagcagauggaucccgagcaucggcagcuggcuaaugccaucuuuaagcucaccuaccaaaacaaagucgugaagguucagcgcccuacgcccaaaggcaccgugauggacauuaucagcagaaaggaucagcggggauccggccaggucgggacauauggacugaauaccuucacaaacauggaagcucaacuuauccgccagauggagggcgaaggggugcugagcaaagccgaccucgagaauccgcaccugcuggagaagaaggugacccaguggcucgaaacaaaaggaguugagagacugaagcggauggcgauuucuggcgaugacugcguggucaaaccuaucgaugaccgcuucgccaacgcucuucuggcccucaacgauauggggaaggugagaaaagacauuccccaguggcaacccuccaagggcuggcaugauuggcagcagguuccuuuuuguagccaccacuuccaugaacugaucaugaaggacggacggaaacuuguggucccgugccgcccccaggacgagcugauuggcagagcucggaucucucaaggggccggauggucccuccgcgaaaccgcuugucugggcaaggccuacgcgcagaugugggcccugauguauuuucacagacgggaucuccgccuggcuagcaaugccauuugcucugccgugccuguccauugggugcccacguccagaacaaccuggagcauccacgcucaucaccaguggaugaccacagaggacaugcuuaccguuuggaaccggguguggaucgaggauaauccuuggauggaagacaaaacacccgucacgaccugggaggaugugccuuaccuggggaagagagaagaccaaugguguggaucccucauuggccugacaagccgcgccaccugggcgcagaacauccuuacagcuauucagcagguucggucucugaucgggaaugaggaguuccucgauuauaugcccagcaugaaaagauuucgcaaggaagaggaauccgagggcgccauuugguga

SEQ ID NO: 20898 - RNA, 9873 nt, Artificial Sequence
  derived and/or modified CDS sequence (opt5) from DENV-3__JQ920485__SS-prME
accagccugugccucaugaugaugcugcccgccacccuugcuuuccaccugacguccagagacggagaaccucggaugaucguggggaagaacgaacgcggaaagucucuccuguuuaagaccgccagcggcauuaauauguguacgcuuaucgcgauggaucugggggagaugugcgacgauaccgucaccuacaaauguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagaacccagacauggaugagcgcugagggcgccuggcggcaggucgaaaaaguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccagcuggcuacacuucgcaaacuguguauugagggaaagaucaccaacauuacgacagauuccagaugcccuacccagggcgaagccauccucccggaggaacaggaccagaauuauguguguaaacacaccuacguggaucggggcugggggaacggaugcggccuguuugggaagggaagccuugucacaugcgcgaaguuccaaugucuggagucuauugagggcaaagccgugcagcacgaaaaucucaaguauaccguuaucaucacagugcauacgggggaccagcaccaggucggaaacgagacccaaggcgugacagcugaaauuacaccccaggccuccacaguugaggcuauccugccugaauacggcacccuggggcucgagugcagcccccgcacgggacuggacuuuaaugagaugauucuucugaccaugaaaaacaaggccuggauggugcauagacagugguucuuugaucucccucugcccuggacaucuggcgccaccacagaaaccccgacguggaauaaaaaggagcuucuggucacauucaaaaacgcucacgcgaagaagcaagaaguggucgugcucgggucccaggagggagccaugcacaccgcucugacaggcgccaccgaaauccagaccagcgggggcacaucuauuuuugccggacaucugaaaugucggcucaagauggacaaacuggagcuuaagggcauguccuaugcuaugugccugaaugccuucguucucaaaaaggaggugagcgaaacgcagcacgggaccauccugaucaaggucgaguacaaaggagaagaugcgccuuguaagauucccuucuccacagaggacggccaagggaaagcucauaacggacgccugaucaccgccaacccuauugugacaaagaaagaggaacccguuaauaucgaggccgaacccccuuuuggcgagucuaacauugugaucgggaucggcgauaaggcucuuaagauuaauugguacaaaaagggaagcuccaucggcaaaauguucgaagccaccgcuagaggggcccggagaauggcgauucucggagacacggccugggauuuuggcagcgucgggggagugcugaacucucugggcaagauggugcaccagaucuucggguccgcuuauacagcccucuuuagcggcguuucuuggauuaugaaaaucggaauuggcguccugcuuaccuggaucgggcugaauagcaagaacaccuccaugucuuucagcugcaucgugauuggaaucauuacacucuaccugggcgcugugguccaggccgacauggggugugugaucaauuggaagggaaaagagcugaagugcggcuccgggauuuuuguuaccaacgaggugcauacauggacggaacaguauaaauuccaagcggauagcccgaagcgccuugccaccgcuaucgccggcgcuugggagaauggagucuguggcauccggucuacaaccagaauggaaaaccuccuguggaaacagauugccaaugagcugaacuacauccucugggaaaauaacauuaagcugacaaucgugguuggggacgugauuggaguccuugagcagggcaaacgcacccugacgccccagccuauggagcucaaguauuccuggaagaccugggggaaagccaagaucgugacagcugaaacccaaaauagcucuuuuaucauugauggacccaacacaccugagugccccuccgcgagccgggccuggaacguuugggaaguggaggacuacggcuucggcgucuuuaccacaaauaucuggcugaaacugagagaaaagcacacccagcuuugugaccaccgccucauguccgcugccgugaaagaugagcgggccgugcaugcugacaugggguauuggauugagucucagaagaacggaagcuggaagcuggaaaaagccucccugaucgaggucaagacgugcacauggccgaaaucucacacccucuggagcaauggcguucuggaauccgauaugauuaucccuaagagccuugcggggcccaucucucagcauaacuacagaccuggauaccacacccaaacagcuggccccuggcaccuggggaaacucgagcuggacuucaauuauugcgagggaaccacgguggugauuacagaaaacuguggcauccgcggcccuucccugcggaccacaaccgucagcgggaaacuuauucaugaguggugcuguagaucuugcacacugcccccgcugcgcuacaugggagaagauggcuguugguaugggauggagauccggccuauuaaugaaaaggaggagaacauggugaaaucccugguuagcgccggaucuggcaagaccgacaauuuuacgaugggggugcucugccuggccauccuuuucgaagaggucaugagaggaaaauucggcaagaaacacaugauugcuggcgcccuguuuaccuucgugcuccugcugagcgggcagaucacauggcgggauauggcgcauacccuuaucaugauuggauccaacgcuagcgaccgcaugggcauggggguuacauaccuggcccucaucgccaccuuuaagauucagcccuuccuggcucucggauuuuuccugagaaaacuuacgucucgggaaaaucugcuccugggcguggggcuggccauggcuacaacccuucaacugcccgaggauaucgaacagauggccaacggaauugcgcucggccugauggcccucaaacugaucacacaguuugagaccuaucagcuuuggaccgcucugaucucccucauguguagcaauacaauuuucacgcugaccgucgccuggagaacagcuacccugauccuugccgugauuucccugcucccuguuugccaaucuagcuccaugcgcaagacagacuggcugccgaugaccguggccgcuaugggcgugcccccucucccccuguuuaucuucucucuuaaagauacgcugaagcggagaagcuggccucugaacgagggggugauggcggugggacucgucuccauucuggccucuagcuuucuucgcaaugacguucccauggcuggcccucugguggccgggggacuccugaucgccuguuacgugaucacaggcaccuccgcugaucucaccgucgaaaaagccgcggacgugacaugggaggaagaggcugaacagaccgggguuagccacaaccugaugauuacaguggacgaugacggaacgaugagaaucaaggaugacgagaccgagaacauucuuacaguccugcugaaaaccgcccuccugaucgugucuggcauuuuccccuauuccaucccggccacacuucugguuuggcauaccuggcagaagcagacgcaacggagcggcgugcucugggaugucccuucucccccugaaacccagaaggcugagcuggaagaggggguguaccgcauuaaacagcagggaaucuuuggcaagacacaagucggggugggaguucagaaagagggcguguuccacaccauguggcacgucacaagaggggccgugcucacccauaauggaaagcggcuggaacccaacugggcgaauguuaaaaaggaccuuaucuccuacggcggcggguggaagcugagcgcucaguggcaaaaaggagaggaagugcaggucauugccguggagccgggcaagaacccuaaaaauuuccagacaaugcccgggaucuuucagacgaccacaggagaaauuggcgccaucgcucuggauuucaagccugggaccucuggaucccccauuaucaaccgcgagggcaaagugguuggccucuaugggaauggagucgugaccaagaacggcggguacgugagcggaaucgcccaaacaaaugcugagcccgacggcccuauuccggaacuggaggaagagauguuuaagaaaagaaaccuuacgaucauggaucugcaccccggguccggcaagacccggaaauaucucccugccauuguccgcgaagcgaucaagagacggcugcgcacacucauucuggcccccaccagagugguugcugccgagauggaggaagcucuuaaaggacugccuauccgguaccagacaaccgccacaaagagcgagcauacaggcagagaaaucguggaccugaugugccacgccaccuucaccaugcgccuccugucucccguccgggugccuaauuauaaccuuauuguuauggaugaggcucauuuuacagacccggcgagcaucgccgcuagaggguacauuuccacccgcgugggaaugggcgaagccgccgcuaucuucaugacagccacacccccugggacggcggaugcuuuuccccagucuaaugccccuauucaggacgaggagcgggacauccccgaaagaagcuggaacuccggaaaugaguggauuacagauuucgccggcaagaccgucugguuugugccgucuaucaaagcugggaacgacaucgccaacugucugcgcaagaauggcaaaaagguuauucaacucagccggaaaacauucgauaccgaauaucagaagacgaagcugaacgacugggauuuuguggucaccacagacaucuccgagaugggagcgaauuucaaagccgauagagugauugacccucgccggugccugaagcccgugauccucaccgauggccccgagagagucauucuugcugggccuaugcccguuacaguggccucugcugcccagcggcgcggaagagugggccggaacagccagaaagaaaaugaccaauacaucuucaccgggcagccucugaacaaugaugaggaccacgcucacuggacagaagccaagaugcugcucgacaacaucaauaccccggagggaauuauccccgcgcuguuugaaccugagcgcgagaaauccgccgcuauugauggcgaauacagacuuaagggggagagccggaaaacguucgucgaacugaugagacgcggcgaccuccccguguggcuggcccauaagguugcuucugagggaaucaaguauacagaucggaaauggugcuuugacggcgaaagaaacaaucagauucuggaggagaacauggauguggaaaucuggaccaaggagggggagaagaagaaacuccgcccucgguggcuugacgccagaaccuacuccgauccccuggcccugaaggaguucaaggacuuugcugcgggacgcaaaagcaucgcccucgaucuggucacagaaauuggccgggugccgucucaccuugcucauagaacccgcaaugcccuggacaaccucguuaugcugcacacauccgagcacgggggcagagccuaucggcaugcuguggaggaacugccugagacgauggaaacccuccuucugcugggccucaugauccugcuuacaggcggggccaugcuguuccucauuagcggaaagggcaucgggaaaaccuccauuggacugaucugugucguggcgucuagcggcaugcuguggauggccgaugucccccuccaguggauugcuuccgccaucgugcuugaguuuuucaugaugguucugcugaucccugagcccgaaaagcaacgcacaccucaggacaaucagcucgcuuacguggugauugggauccugacccuugccgcgauugucgccgcuaacgagaugggacugcucgaaacgaccaaaagagaucugggcaugagcaaggagcccggcguugugucuccgacauccuaucuggacguggaccuccacccugccagcgcuuggacccuuuacgccgucgcuacaaccgugaucacgcccaugcugcggcauacaauugaaaauucuaccgccaacguuagccuggcggccaucgcuaaccaagccgugguccucauggggcuggauaagggauggcccaucuccaaaauggaccuuggcgugccucugcucgcucuggggugcuauucucaggucaauccgcugacacucaccgccgccgugcuucugcugguuacccacuacgcgauuaucggacccggccuccaggcuaaggccacacgcgaggcucagaaaagaacggccgccgggauuaugaagaacccuaccguggauggaaucaugacaauugaccuggaucccgucaucuacgacagcaaauuugagaagcaacuuggccaggugaugcugcucguucugugugcugugcagcugcuccuuaugcggaccuccugggccuucugcgaagcgcugacacuggccaccggcccuaucacgacacucugggaggggucucccggaaaguuuuggaauaccaccauugcugucagcauggccaacaucuucagaggcuccuaucuggcuggggccggacuugcguuuagcauuaugaaaucugugggcacagggaagcgcggaaccggcucccagggcgaaacacugggggagaaauggaagaaaaagcucaaucaacugagccggaaagaguucgaucuguacaagaaguccggaaucacggagguggacagaauugaggccaaagaaggccucaagcgcggggagaucacccaucacgcuguuucucggggaagcgccaaacuucagugguucgucgaaagaaacauggugauuccugagggccgggugaucgaucugggguguggacgcggcggcugguccuauuacugcgcugggcugaagaaagucacagaaguuagaggauauaccaagggcgggccgggacacgaggagcccgugccuaugucuacauacggcuggaauaucgugaagcucaugagcgggaaagacgucuuuuaucugcccccugaaaagugugauacccuucugugcgacauuggagaguccagccccucuccgacgguggaagagucccggaccauccgcguucucaaaaugguggagccuuggcugaagaacaaucaguucuguauuaaaguccugaaccccuacaugcccacagugaucgaacaucucgagagacuucagcggaagcacggcggcaugcugguucgcaauccucugagcagaaacucuacccaugaaauguacuggauuuccaaugggacaggaaacaucgugagcucugucaauauggugagccggcuccugcuuaaccgcuuuaccaugacacacagacggcccaccaucgagaaggauguggaccugggcgccgggacgagacacgucaacgcugaaccugagacaccgaauaugaacguuauuggagagcgcauccggagaauuaaagaagaacauuccucuaccuggcacuaugacgaugaaaaucccuacaagaccugggccuaucauggcagcuacgaggugaaagcgacaggguccgccagcuccaugaucaacggaguggucaagcuccugacgaaaccuugggacgugguucccauggugacccaaauggcuaugacagauaccacaccuuucggccagcagcgcgucuuuaaggaaaagguggacacccggacacccagaccgaugccuggcacccgcaaaguuauggagauuacggccgaguggcuguggcggacccucgggagaaauaagcgcccccggcugugcacaagagaagaguucaucaaaaaggugcgcaccaacgcugccaugggagccgucuuuacagaagagaaucaaugggauucugcgcgggcugccguggaagacgaggaguucuggaaacuuguugauagagaacgcgagcugcacaagcucggcaaaugugggagcugcguguauaacaugaugggaaagagagaaaagaaacugggcgaguuugggaaggccaaaggcucccgggcuaucugguacauguggcuuggagcccgcuaucuggaguucgaagcucucggcuuucugaaugaggaccauugguucucuagagaaaacagccacuccggggucgagggagaaggccugcacaagcucggguacauucugcgggauaucucuaaaauuccuggaggcgccauguacgcggacgauaccgccgggugggacacgagaaucacagaggacgaucuucauaaugaggaaaagauuacccagcagauggaccccgagcaccggcagcuggcuaacgccaucuuuaagcucacauaucaaaauaaaguggucaaggugcagcgcccuacccccaaaggcacgguuauggauaucauuagcagaaaggaccagcggggauccggccagguggggaccuacggacugaacacauucaccaauauggaagcucaacuuauccgccagauggagggcgaagggguccugagcaaagccgaucucgagaacccgcaucugcuggagaagaaggugacacaguggcucgaaaccaaaggaguggagagacugaagcggauggcgauuucuggcgacgauugcguugugaaaccuaucgacgaucgcuucgccaacgcccuucucgcucucaaugacauggggaaggucagaaaagauauuccccaguggcaacccuccaagggcuggcacgacuggcaacaggugccuuuuuguagccaccauuuccacgaacugaucaugaaggauggacggaaacuuguugugccgugccgcccccaggacgagcugauuggcagagcucggaucucucaaggggccggauggucccuccgcgaaacagcuugucugggcaaggccuaugcgcagaugugggcccugauguacuuucauagacgggaccuccgccuggcuagcaacgccaucugcucugccgucccugugcacuggguccccaccuccagaacgacauggagcauucaugcucaccaccaguggaugaccaccgaggauaugcuuacaguguggaaucggguuuggaucgaggacaacccuuggauggaagauaaaacccccgugacaacgugggaggacgucccuuaucuggggaagagagaagaucaaugguguggaucccucauuggccugaccagccgcgccacaugggcgcagaauauccuuaccgcuauucaacaggugcggucucugaucgggaacgaggaguuccucgacuacaugcccagcaugaaaagauuucgcaaggaagaggaaccggagggcgccaucugguga

SEQ ID NO: 20899 - RNA, 9873 nt, Artificial Sequence
  derived and/or modified CDS sequence (opt5) from DENV-3__FJ644564__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggcccggggggcuagacgcauggccauccuuggagacacagcgugggauuucggcuccguggggggaguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacagcuaucgccggcgcuugggagaauggaguuuguggcauuagaagcaccacacgcauggaaaaccuucucuggaaacagaucgccaaugagcugaacuauauccugugggaaaauaacauuaagcucaccguggucgugggggacacgaucggaguucuggagcagggcaaacggacccuuacaccucagcccauggagcugaaguacucuuggaaaaccugggggaaggccaagauugugacagcugaaacccaaaacuccagcuucaucauugauggaccuaauacacccgagugcccgucugcguccagagccuggaacgucugggaaguggaggacuauggcuuuggcguguucaccacgaauaucuggcucaaacugcgcgaagucuacacacagaugugugaccaccggcugaugagcgcugccguuaaggaugagagagccgugcacgcugacaugggguacuggaucgagucccagaaaaacggaucuuggaagcuugaaaaagccagccucauugaggugaagaccugcaccuggccuaagucccauacacuguggucuaauggcguccuggaaagcgauaugaucauucccaaaucccucgcggggccuaucagccagcacaaccaucgccccggauaucacacccaaacggcuggcccuuggcaccuggagaaucuugagcuggacuuuacauacugcgaagggaccacagugguuauuaccgagaacuguggaacacggggccccucucucagaaccacgaccguguccggcaagcugauccaugaauggugcugucgcagcugcacacugccgccucuucgguauaugggggaggauggauguugguacggcauggaaaucagacccauuucugagaaagaggaaaauauggucaagucccucgugagcgccgggucuggaaaaguugacaacuucaccaugggcauccugugccuggccauucucuuugaggaagugaugcgggggaaguucggaaagaaacacaugaucgcuggcgucuucuuuacauucgugcugcuucugagcggccagauuaccuggcgcgauauggcccauacgcucaucaugauuggguccaaugcgagcgacagaaugggaaugggcguuacauaucuggcucugaucgccaccuuuaagauccagcccuuccuugcccugggguuuuuccuccggaaacugacaucuagagagaaccuccugcuuggagugggccuggcuauggccaccacccuccaacugccugaagauauugagcagauggcuaaugggaucgcccugggacuuauggcgcugaagcucauuacacaguuugagacguaccagcuguggaccgcccucaucucccugacauguagcaacaccauuuucacacuuaccgucgcuuggcgcacggccacacugauccucgcuggcgugucccugcugccggugugccaaucuagcuccaugcggaaaaccgacuggcuucccaugaccgucgccgccaugggcguuccuccccugccucucuuuaucuucucucugaaggauacacucaagagacgcagcuggccccugaaugaaggggugauggcugugggacuugucuccauucuggcgucuagccugcucagaaacgacgugccuauggccggcccccugguugcugggggacuucugaucgccuguuaugugauuaccggcacauccgccgaucucacggucgagaaagcugccgacgugaccugggaagaggaagcggagcagacagggguuagccacaaccugaugaucaccguggacgaugacggaacaaugcggauuaaggaugacgagaccgaaaauauccucacgguccugcuuaaaaccgcucugcugaucgugucuggcauuuuuccguacuccaucccugccacacuccuggucuggcauaccuggcagaagcagacacaacgcagcggcgugcuuugggauguucccucuccucccgagacccagaaagccgaacuggaggaggggguguacagaauuaagcagcagggaauccucggcaaaacacaagucggggugggaguucagaaggaaggcguguuccacacgauguggcacgucacccggggggcugugcugacacauaacggaaagcgccucgagccgaauugggccuccgugaaaaaggaccugauuagcuauggcggcggguggagacuuucugcgcaguggcaaaaaggagaagagguucaggucaucgcuguggaaccuggcaagaaccccaaaaauuuucagaccaugccugggaccuuccagacaacgaccggagagauuggcgccaucgcccuggauuucaagcccgggacauccggaagccccaucauuaaccgggagggcaagguggucggccuguacgggaauggagugguuaccaaaaacggcggguauguguccggaaucgcucaaacaaaugccgaaccugacggcccgacccccgagcucgaagaggaaauguuuaagaaacgcaaccugacgauuauggaucuucacccugggagcggcaagacaagaaaauaccugcccgcuaucguccgggaggccauuaagcgcagacuccggacccugauccucgcgccuaccagagugguugccgcugagauggaagaggcccugaagggacuucccauccgcuaucagacaaccgcuacaaaaucugaacauaccggccgggagauuguggaccugaugugccacgccacguucacaaugagacugcucagcccuguccgcgugccgaauuacaaccugaucauuauggaugaagcccauuuuaccgaccccgcuuccaucgcggcccggggguauauuucuacaagaguuggaaugggcgaggcugccgccaucuucaugagcgcuaccccucccgggacggccgaugcguuuccucaguccaaugcucccauccaggacgaggaacgcgacauuccggagcggucuuggaacagcggaaaugaauggaucaccgauuucgccggcaagacagugugguuugucccuuccauuaaagccgggaacgacaucgcuaacugucuuagaaagaauggcaaaaaggugauucaacugucucgcaagaccuucgauacagaguaccagaaaaccaagcucaacgacugggauuuuguggucacaaccgacaucagcgagaugggagccaauuucaaagcggaucggguuauugaccccagacggugccugaagcccgugauccugacggauggcccugaacgcgugauccucgccgggcccaugccugucacagcugccuccgcugcccagagacggggacgcgugggcagaaacccgcagaaagagaaugaccaauacauuuuuaccgggcagccccuuaacaaugaugaagaccacgcucacuggaccgaggccaagaugcugcuggacaacaucaauacaccugaaggaauuauccccgcgcucuucgagccugagcgggaaaagagcgccgcuauugauggcgaguauagacugaaaggggaaucucgcaagaccuucguugagcuuaugcggagaggcgaccugcccguguggcucgcccauaaagucgcuuccgaaggaaucaaguacacagaucgcaaauggugcuuugacggccagcggaacaaucagauccuggaggagaacauggauguggaaauuuggacgaaggagggggaaaaaaagaagcugagaccgcgcuggcucgacgcccggaccuauagcgauccucuugcccugaaagaguucaaggacuuugcugcgggaagaaaaucuaucgcccuggaucucguuacagaaauuggccgcgugcccucccaccuggcucauagaacccggaaugcccuugacaaccuggucaugcuccacacaagcgagcacgggggacgcgccuacagacaugcuguggaggaacugccugagaccauggaaacgcugcuccuucugggccugaugauccuccugaccggcggggccaugcuuuuccugauuuccggaaagggcaucgggaaaacaucuaucggacucauuugugucaucgcgagcuccggcaugcuguggauggccgagauuccccugcaauggaucgcuagcgccauugugcucgaguuuuucaugaugguucuucugaucccugaacccgagaagcagcggaccccgcaggauaaucaacuggcuuauguggugauugggauccucacacuggccgcgaucauugccgcuaacgaaaugggacuucuggagaccacgaagcgcgaccucggcaugucuaaagaaccuggcgucguuucccccacaagcuaccuggauguggaccugcaccccgccucugcuuggacccucuaugccguggcuacaaccgucaucaccccuaugcuuagacauacaauugagaauagcacggccaacgugucccuggcggccaucgcuaaccaggccguugugcugauggggcucgacaagggauggccgauuucuaaaauggaucugggcgucccccuucuggcucucgggugcuacagccaggugaauccucugacccugacagccgccguccuccuucugaucacccacuacgcgaucauuggacccggccugcaggcuaaggccacacgggaggcucaaaaaagaaccgccgccgggaucaugaagaacccuacgguggacggaauuaucacaauugaucucgaccccguuaucuaugauuccaaguuugaaaaacagcugggccaggugaugcuucugguccucugugcugugcagcugcugcucaugcgcaccucuugggcccuuugcgaggcgcugacccuggccacaggcccuaucaccacacucugggaagggagcccgggaaaguucuggaauacgaccauugcuguuuccauggccaacaucuuucggggcagcuaccuggcuggggccggacuugcguucucuauuaugaaauccgugggcacagggaagagaggaaccggcagccaaggcgagacacugggggaaaaauggaagaagaaacucaaucagcugucccgcaaggaguuugaccuguauaaaaagucuggaaucaccgaggucgaucggacggaagccaaagagggccucaagagaggggaaaccacacaucacgcugugagccggggauccgccaaacuucaguggcugguggagcgcaacaugguuauucccgaaggcagagucaucgaccugggguguggacggggcggcuggucuuacuauugcgcugggcucaagaaggugaccgaggugcgcggauacacaaaaggcgggccuggacacgaggaacccgucccuaugagcaccuauggcuggaauauuguuaagcugauguccgggaaagauguguucuaccuucccccggagaagugugacacacugcucugcgauaucggagaaagcucuccuucccccaccguggaggagagcagaacgauccggguccugaaaaugguggaacccuggcugaagaacaaucaguuuuguauuaagguucucaacccuuacaugcccgccgugaucgagcaucuugaacgccugcaaagaaaacacggcggcaugcugguccggaauccucucucucgcaacuccacacaugagauguauuggauuagcaaugggaccggaaacaucgugucuagcguuaauaugguguccagacugcuucugaaccgguucaccaugacacacagacgcccgacgauugaaaaggacgucgaucucggcgcugggacccggcacgugaacgccgagcccgagacaccuaauauggacgugaucggagaaagaaucaaacgcauuaaggaggaacauaacucuaccuggcacuacgacgaugagaaucccuauaaaacaugggcguaccauggcagcuaugaagucaaggccaccggguccgcuagcuccaugaucaacggaguugugaagcugcugacaaaaccuugggacgugguccccauggugacccagauggccaugacggauaccacaccguucggccagcaacggguuuuuaaggagaaaguggacaccagaacaccucgccccaugccuggcacccggaaggucauggagauuacggcugaauggcucuggagaacacuggggcgcaauaaacggcccagacuuugcacccgcgaggaauucacaaagaaggugcggaccaacgccgccaugggagcgguuuuuacggaggaaaaucagugggauucugcuaaagccgccguggaggacgaggaauucuggaagcuggucgauagagagcgcgaacuccacaaacugggcaagugugggagcugcguguacaacaugaugggaaaaagagagaagaaacuuggcgaguuugggaaggcuaagggcucccgggccaucugguauauguggcugggaucucgcuaccucgaauucgaggcucugggcuuucugaaugaagaccauugguucagcagagagaacuccuacucugggguugaaggagagggccuccacaaacugggguauauucuucgggauaucagcaagaucccuggaggcgccauguacgcggacgauaccgccgggugggacacaagaauuaccgaggacgaucugcacaaugaagagaaaaucacacagcagauggaccccgaacaucggcuccuggcuaacgccauuuuuaagcuuaccuaucaaaauaaaguggucaaggugcagcgcccgacaccuaccggcacggucauggauaucauuuccagaaaggaccagcggggaagcggccagguggggacauacggacugaacaccuucaccaauauggaggcucaacucguucgccagauggaaggcgagggggugcugucuaaagccgaucuggagaacccccaccuccccgaaaagaaaaucacacaguggcuggagaccaagggagucgaaagacuuaaacggauggcgaucuccggcgacgauugcguggugaagccuauugacgaucgcuuugccaacgcucugcucgcccugaaugacauggggaagguuagaaaagauaucccgcaguggcaacccagcaagggcuggcaugacuggcagcaggugccuuucuguucucaccacuuucaugagcuuauuaugaaagauggacggaagcuggucgugcccugccgcccucaggacgaacucaucggcagagcucggauuucccaaggggccggauggagccugcgcgagacagcuugucugggcaaagccuaugcgcagauguggucucucauguacuuccacagacgggaccugcgccuugccuccaacgcuaucugcagcgccguucccgugcauugggucccuacguccagaaccacauggagcauucacgcccaucaccaguggaugaccacagaggauaugcugaccguguggaaucgggucuggaucgaagacaaccccuggauggaggauaagacgccggugaccacaugggaaaauguuccuuaucucgggaagagagaggaccaaugguguggaucucugaucggccuuaccagccgcgcuacaugggcccagaacauucccaccgcgauccagcaggugcggucccugauugggaaugaggaauuccucgauuacaugccuucuaugaaaagauuucgcaaggaggaagagagcgaaggcgcuaucugguga

SEQ ID NO: 20900 - RNA, 9873 nt, Artificial Sequence
  derived and/or modified CDS sequence (opt5) from DENV-3__HQ235027__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaucgaaauucagaauuccgggggcaccagcaucuucgccggacaucugaagugucgccucaaaauggacaagcuggagcuuaaaggcaugucuuacgcuaugugcaccaagacauuugugcugaaaaaggaggucuccgaaacgcagcacgggaccauccucauuaagguggaguacaaaggagaagaugcccccuguaagaucccuuucagcacagaggacggccaagggaaagcguauaacggaagacugauuaccgcuaaccccguugugacaaagaaagaugagcccgucaauaucgaagccgagccuccguucggcgaauccaacauugugaucgggaucggcgacaaugcccugaagauuaacugguacaagaaaggaucuagcaucggcaagauguuugaggcuaccgcccggggggcuagacgcauggccauucuuggagauacggcgugggacuucggcuccguggggggaguucucaauagccugggcaaaaugguccaucagaucuuugggucugccuauacagcucuguucuccggcgugagcugggugaugaagauuggaaucggcguccuccugaccuggauugggcuuaacucuaaaaauaucagcauguccuuuucuugcaucgccauuggaaucauuacccuguaccucggcgcugugguucaggccgauauggggugugugaucaacuggaagggaaaggaacugaaaugcggcagcgggauuuucgucacaaaugaggugcacaccuggacagagcaguauaaguuucaagcggacucccccaaacggcuggccacggcuaucgccggcgcuugggaaaacggaguuuguggcaucagaagcaccacacgcauggagaaucuucucuggaagcagauugccaacgaacugaauuacauccugugggagaacaauauuaaacucaccguggucgugggggauacaaucggaguucuggaacagggcaagcggacccuuacgccucagcccauggagcugaaauauucuuggaagaccugggggaaggccaaaauugugacagcugagacccaaaacuccagcuucaucaucgacggaccuaacacacccgaaugcccgucugcguccagagccuggaaugucugggagguggaagacuacggcuuuggcguguucaccacaaacauuuggcucaagcugcgcgaggucuacacccagcugugugaucaucggcuuaugagcgcugccguuaaagacgaaagagccgugcacgcugauaugggguauuggaucgagucccagaagaauggaucuuggaaacucgagaaggccagccugauugaagugaagacgugcacauggccuaaaucccacacccuguggucuaacggcguccucgagagcgacaugaucauucccaagucccuggcggggccuaucagccagcauaaucaccgccccggauaccauacccaaacagcuggcccuuggcaccuugggaaacuggaacucgauuuuaacuauugcgagggaaccacggugguuaucacagagaauuguggcacccggggccccucucugagaacaaccacaguguccgggaagcugauucacgaauggugcugucgcagcugcacccuuccgccucuccgguacaugggagaggacggcuguugguaugggauggaaaucagacccauuucugagaaagaagagaacauggucaagucccuggugagcgccggaucuggcaagguugauaauuucacgaugggggugcugugccucgccauccuguuugaggaagucaugcggggaaaauucggcaagaaacauaugauugcuggcguguucuuuaccuucguucuucugcucagcgggcagaucacauggcgcgacauggcccacacccugauuaugaucggauccaacgcgagcgauagaaugggcaugggggugacauaccuggcucuuaucgccaccuuuaagauucagcccuuccuggcccucggauuuuuccugcggaaacucacgucuagagagaaucugcuucugggcgucgggcucgcuauggccacaacccugcaacugccugaagacaucgagcagauggcuaacggaauugcccuuggccugauggcgcucaagcugaucacacaguuugaaaccuaucagcucuggaccgcccugauuucccuuacauguagcaauacgauguucacccugacaguggcuuggcgcaccgccacacucauccuggcuggcgugucccugcuuccggucugccaaucuagcuccaugcggaagaccgauuggcugcccauggccguugccgcuaugggggugccuccccucccucuguuuaucuucucucucaaagacacgcugaagagacgcagcuggccccuuaacgagggagugauggcggucggccugguguccauucuggccucuagccuccugagaaaugauguuccuauggcugggccccuuguggccggaggccugcucaucgccuguuacgucauuacagggaccuccgcugaccugaccguggagaaagccgcggacaucacaugggaagaggaagcugagcagaccggaguuagccauaaccucaugauuacaguggaugacgauggcacgaugcggaucaaggacgaugaaaccgagaacauccugacaguccuucugaaaaccgcccugcucguggucucuggcguguuuccguacuccauuccugccacacugcuuguuuggcacaccuggcagaagcagacgcaacgcagcggggugcugugggacguccccucuccucccgagacccagaaagcugaacucgaggaaggaguguauagaaucaagcagcagggcauuuucgggaagacacaaguuggagugggcguccagaaagaggggguguuucauaccauguggcacgugacacggggagccguucugaccuacaauggcaagcgccucgagccgaacugggcguccgucaaaaaggaucugaucagcuauggcgggggauggagacuuucugcucaguggcaaaaaggcgaagaggugcaggugauugccgucgaaccugggaagaaucccaagaacuuccagacaaugccuggaacguuccagaccacaaccggcgagaucggggccauugcucuggacuuuaaacccggaaccuccggcagccccaucaucaaucgggaaggcaaggugguugggcuguacggaaacggcguggucacaaaaaaugggggauauguguccggcauugcccaaacgaacgcugagccugaugggccgacccccgagcucgaagaggaaauguucaagaaacgcaaucugacaaucauggaccuucacccuggcagcggaaagaccagaaaguaccugcccgccauuguucgggaggcgaucaaacgcagacuccggacacugauucucgccccuaccagaguggucgcugccgaaauggaggaggcucugaagggccuucccauccgcuaucagacgacagccaccaaaucugaacauaccgggcgggagaucguggaucugaugugccacgccacauuuaccaugagacugcucagcccuguucgcgugccgaacuacaaucugauuaucauggacgaagcucauuucacagaucccgcguccauugccgcucggggauacaucucuaccagagucggcaugggggaggccgccgcuauuuuuaugacggccacaccucccggaaccgcggacgcuuucccucagagcaacgcccccauccaggacgaagagcgcgauaucccggagcgguccuggaauucuggcaacgaauggauuacagacuuugccgggaagaccgugugguucgugccuagcaucaaagcuggcaaugauauugccaacugucuuagaaagaacggaaagaaagucauccaacugucccgcaagacguuugacaccgaguaucagaaaacaaagcucaaugauugggacuucguugugaccacagauauuucugaaaugggcgcgaacuuuaaagccgaccgggugaucgaucccagacggugccugaagcccgucauucugaccgacgggccugagcgcgugauccucgcuggacccaugccuguuacagccgcuagcgccgcucagagacggggccgcguggggagaaauccgcagaaggagaacgaucaauacaucuucaccggacagccccuuaauaacgacgaagaccacgcccauuggacggaggcgaaaaugcugcuggauaauauuaacacaccugaaggcaucauucccgcccucuucgagccugaacgggagaaguccgcugccaucgacggggaguauagacugaaaggcgaaagccgcaagaccuuugucgagcuuaugcggagaggagaucugcccguguggcucgcucacaaaguugccucugaaggcauuaaguacaccgaccgcaaauggugcuucgaugggcagcggaauaaccagauccuggaggaaaauauggacguggagaucuggacaaaggagggagaaaagaaaaagcugagaccgcgcuggcucgaugcccggaccuauuccgacccucuugcucugaaagaguuuaaggauuucgcggccggcagaaaaagcauugcucuggaccucgucacagaaaucgggcgcgugcccucucaccuggcccauagaacgcggaacgcccuugauaaucuggucaugcuccacaccuccgagcauggaggccgcgcuuacagacacgccguggaagagcugccugagacaauggaaacccugcuccuucugggccugaugauucuccugacagggggagcgaugcuuuuucugaucagcggcaaggggauuggaaagaccuccaucggccucaucuguguuauugccucuagcgggaugcuguggauggcugagaucccccugcaauggauugccuccgcuaucgugcucgaauucuuuaugauggugcuucugauuccugagcccgagaaacagcggacgccgcaggacaaccaacuggccuaugucguuaucggaauucucacccuggcggccaucaucgcugccaaugaaaugggccuucuggagacaaccaagcgcgaucucggcaugagcaaagaaccugggguggugucucccacauccuaccuggacgucgaccugcaccccgcuagcgccuggacccucuacgcuguggccacgacaguuauuaccccuaugcuuagacauacaaucgagaacucuaccgcgaaugugagccuggccgcuauugccaaccaggcugucgugcugaugggacucgauaagggcuggccgaucuccaaaauggaccugggggucccccuucuggcccucggaugcuauucucaggugaacccucugacccugacagccgcgguucuccuucugauuacgcacuacgcuaucaucggccccgggcugcaggccaaggcuacccgggaagcccaaaagagaacagccgcuggaauuaugaaaaauccuaccguggauggcaucaugacaauugaccucgaucccgucaucuaugacagcaaguucgagaaacagcugggccaggugaugcuucugguucucugugccgugcagcugcugcucaugcgcaccuccugggcgcuuugcgaggcccugacgcuggcuacagggccuauuaccacccucugggaaggaucuccgggcaaguuuuggaacacaaccaucgccgucagcauggcuaauaucuuccggggguccuaccuggccggagcgggccuugccuuuagcauuaugaaaucuguggggacaggaaagagaggcacgggcucccaaggggagacccugggagaaaaguggaaaaagaaacucaaccagcugagccgcaaggaguucgaucgguauaaaaaguccggcaucacagaaguggacagaaccgaggcuaaagaggggcugaagcggggagaaacaacccaucacgccguuucucgcggcagcgcuaagcuccagugguuugucgagagaaauauggugauucccgaagggcgggugaucgaucuuggauguggccgcggcgggugguccuacuauugcgccggacugaaaaaggucacggagguuagaggcuacaccaaagggggaccuggccaugaagagcccgugccuaugucuacauacggguggaacauugugaagcugaugagcggaaaagacgucuucuaucuccccccggagaagugugauacccugcuuugcgacaucggcgaauccagcccuucucccacaguggaggaaucccggaccauucgcguucugaagaugguggagcccuggcucaaaaauaaccaguucuguaucaagauccugaauccuuacaugcccacagucauugagcaccuggaaagacuccaacggaaacacggcgggaugcuugugcgcaacccucugagcagaaauucuacccaugagauguauuggaucuccaacggaacgggcaauauuguugcuagcgugaacauggucucucggcugcuccugaauagauuuacaaugacccaccgccggccgaccaucgaaaaggauguggaccuuggggccggaacaagacaugugaacgcggagcccgaaacgccuaacauggacgucauuggcgagcgcaucaaacggaucaaggaggaacacaauagcaccuggcacuacgaugacgagaaccccuauaagacaugggccuaccauggguccuaugaaguuaaagcuaccggaucugccagcuccaugauuaauggcguggugaagcugcucacaaaaccuugggaugucgugcccaugguuacccagauggcuaugacagacaccacgccguucggccagcaaagaguguuuaaggagaaagucgauacccgcacaccucggagcaugcccgggaccagacgcgugaugggaaucacagccgaauggcuguggcggacccugggcagaaacaagaagccucgccucugcacgcgggaggaguucacaaaaaagguuagaaccaaugccgcgaugggggcuguguuuacagaagagaaccagugggacuccgccaaagccgcugucgaagaugaggacuucuggaagcugguggaucgcgaaagagagcuucacaaacugggaaaguguggcucuugcguuuacaauaugauggggaaacgggagaagaagcucggcgaauuuggaaaagccaagggcagccgcgcuauuugguacauguggcugggggccagauaucuugaguucgaagcgcugggauuucucaacgaggaccauugguucucccgggagaauucuuacagcggcguggaaggggagggacugcacaaacugggcuauauccucagagauauuuccaagauccccgggggcgccauguacgcugacgacaccgccggaugggauacgcggaucaccgaagacgaucugcauaacgaggaaaaaauuacacagcagauggacccugagcaccgccaacuugcuaaugccaucuuuaagcugaccuaucagaacaaggucgugaaaguccagagacccacaccgaccggcacagugauggauauuaucucucggaaggaccagcgcgggagcggacaaguuggcaccuacgggcucaauacguucacaaacauggaggcgcagcugauuagacagauggaaggagagggcgugcuuuccaaagccgaucuggaaaauccucaccuccccgagaagaaaaucacccaguggcuggaaaccaagggggucgagcggcugaagcgcauggcuaucagcggcgacgauugcguggugaaacccauugacgauagauuugccaacgcucuccuggcccuuaacgacaugggaaagguucggaaagauaucccucaauggcagccgucuaagggcuggcaugacuggcagcaggugcccuucuguucccaccauuuccacgagcugauuaugaaagacgggcgcaagcucgucgugccuugcagaccccaagaugaacugaucggacgggcucgcauuagccagggcgccggguggucucuuagagagacagcgugucugggaaaggccuaugcucagauguggucccucauguacuuucaccggcgcgaccugagacuggccagcaaugccaucugcucugcuguuccugugcauuggguccccaccucccggacaacguggagcauucacgcccaucaccaauggaugaccacagaagauaugcucaccguguggaacagagucuggaucgaggacaauccuuggauggaagauaaaacacccgugaccacgugggaggacguuccguaccugggcaagcgcgaggaucaguggugugggucccuuaucggccugaccagccgggcgacaugggcucagaacauuccuaccgccauccagcaagugagaucucucauuggaaaugaagaguuccuggacuauaugcccagcaugaaacgcuuucggaaggaagaggaguccgaaggcgccaucugguga

SEQ ID NO: 20901 - RNA, 9873 nt, Artificial Sequence
  derived and/or modified CDS sequence (opt5) from DENV-3__JQ920476__SS-prME
accagccugugccucaugaugaugcugcccgccacccuugcuuuccaccugacgagcagagacggagaaccucggaugaucguggggaagaacgaacgcggaaagucucuccuguuuaagaccgccagcggcauuaauauguguacccuuaucgcgauggaucugggggagaugugcgacgauaccgugacauacaaguguccgcucauuaccgaaguugagcccgaagacaucgauugcugguguaaccugacauccaccugggugacguauggaaccugcaaucaggcuggcgagcauagacgggacaagcgcucuguggcccuggccccucacguugggaugggacucgauacaagaacccagacauggaugagcgcugagggcgccuggagacagguggaaaagguugagaccugggcuuuccgccaucccggcuuuacgauucuggcccuuuuccuggcgcacuacaucgggacaucccucacccagaagguggugaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaagcccacccuggacaucgagcuccagaagacagaagccacccagcuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaagccguucagcacgaaaaucucaaguauaccgugauuaucacaguccauacgggggaccagcaccaggugggaaacgagacccaaggcguuacagcugaaaucacaccccaggccuccacaguggaggcuauucugccugaauacggcacccuggggcucgagugcagcccccgcacgggacuggacuuuaaugagaugauccuucugaccaugaaaaacaaggccuggaugguccauagacagugguucuuugaucucccucugcccuggacaucuggcgccaccacagaaaccccgacguggaauaaaaaggagcuucuggugacauucaaaaacgcucacgcgaagaagcaagaagucgugguucucgggucccaggagggagccaugcacaccgcucugacaggcgccaccgaaauucagaccagcgggggcacaucuaucuuugccggacaucugaaaugucggcucaagauggacaaacuggagcuuaagggcauguccuaugcuaugugccugaaugccuucgugcucaaaaaggaggucagcgaaacgcagcacgggaccauucugaucaagguggaguacaaaggagaagaugcgccuuguaagauccccuucuccacagaggacggccaagggaaagcucauaacggacgccugauuaccgccaacccuaucguuacaaagaaagaggaacccgugaauauugaggccgaacccccuuuuggcgagucuaacaucgucauugggaucggcgauaaggcucuuaagaucaauugguacaaaaagggaagcuccauuggcaaaauguucgaagccaccgcuagaggggcccggagaauggcgauccucggagacacggccugggauuuuggcagcgucgggggagugcugaacucucugggcaagaugguucaccagauuuucggguccgcuuauacagcccucuuuagcggcgucucuuggaucaugaaaauuggaaucggcgugcugcuuaccuggauugggcugaauagcaagaacaccuccaugucuuucagcugcaucgugaucggaauuaucacacucuaccugggcgcugucgugcaggccgacaugggguguguuauuaauuggaagggaaaagagcugaagugcggcuccgggaucuuugugaccaacgagguccauacauggacggaacaguauaaauuccaagcggauagcccgaagcgccuugccaccgcuauugccggcgcuugggagaauggaguguguggcauccggucuacaaccagaauggaaaaccuccuguggaaacagaucgccaaugagcugaacuacauucucugggaaaauaacaucaagcugacaauuguugugggggacgucaucggagugcuugagcagggcaaacgcacccugacgccccagccuauggagcucaaguauuccuggaagaccugggggaaagccaagauuguuacagcugaaacccaaaauagcucuuuuaucaucgauggacccaacacaccugagugccccaacgcgucccgggccuggaaugugugggaagucgaggacuacggcuucggcguguuuaccacaaacauuuggcugaaacugagagaaauguauacccagcuuugugaccaccgccucaugagcgcugccgugaaggaugagcgggccguccacgcugacaugggguacuggaucgagucccagaaaaauggaucuuggaagcuggaaaaggccagccugauugagguuaaaacgugcacauggccgaagucccauacccucuggucuaacggcgugcuggaaagcgauaugaucauuccuaaaucccuugcggggcccaucagccagcacaauuacagaccuggauaucauacccaaacagcuggccccuggcaccuggggaagcucgagcuggacuucaacuacugcgagggaaccacgguggucaucacagaaaauuguggcacccgcggcccuucucugcggacaaccacaguguccgggaaacuuauucacgaguggugcuguagaagcugcacccugcccccgcugcgcuauaugggagaagauggcuguugguacgggauggagauccggccuauuaacgaaaaggaggagaauaugguuaagucucugguguccgccggaagcggcaaagccgacaacuuuacgauggggguccucugccuggcuauccuuuucgaagaggugaugagaggaaaguucggcaaaaagcauaugauugccggcgcgcuguuuaccuucguucuccugcugucugggcagaucacauggcgggauauggcucacacccuuauuaugaucggaagcaaugccuccgaccgcaugggcaugggggugacauaucuggcccucaucgcuaccuuuaaaauucagcccuuccuggcccucggauuuuuccugagaaaacuuacgagccgggaaaaccugcuccugggcgucgggcuggcuauggccacaacccuucaacugcccgaggauaucgaacagauggcgaauggaauugcccucggccugauggcucucaagcugaucacacaguuugagaccuaccagcuuuggaccgcccuggugucucucauguguuccaacacaauuuucacgcugaccguugcuuggagaacagccacccugauccuugccgugaucagccugcucccugucugccaauccucuagcaugcgcaaaacagacuggcugccgaugaccguggcugcgaugggcgugcccccucucccccuguuuauuuucucccuuaaggauacgcugaaacggagaucuuggccucugaaugagggggucauggccguuggacucgugagcauccuggcuuccucuuuucuucgcaacgacgugcccauggccggcccucuggucgccgggggacuccugauugcuuguuaugugaucacaggcaccagcgccgaucucaccguugaaaaggcggcugacgugacaugggaggaagaggccgaacagaccggggucucccauaaccugaugauuacaguggacgaugacggaacgaugagaaucaaagaugacgagaccgagaauauccuuacaguucugcugaagaccgcccuccugauugugagcggcaucuuccccuacucuauuccggcuacacuucuggucuggcacaccuggcagaaacagacgcaacgguccggcgugcucugggaugucccuucucccccugaaacccagaaggccgagcuggaagaggggguguaccgcaucaagcagcagggaauuuuuggcaaaacacaaguuggggugggaguccagaaggagggcguguuccauaccauguggcacguuacaagaggggcggugcucacccacaacggaaaacggcuggaacccaauugggcuaacgucaagaaagaccuuaucuccuauggcggcggguggaagcuguccgcccaguggcaaaagggagaggaaguccaggugauugccguugagccgggcaaaaauccuaagaacuuccagacaaugcccgggaucuuucagacgaccacaggagaaaucggcgcuauugcccuggauuucaaaccugggaccagcggaucucccaucauuaaucgcgagggcaaggucgugggccucuacgggaacggaguggucaccaaaaauggcggguauguguccggaaucgcucaaacaaacgccgagcccgacggcccuacgccggaacuggaggaagagauguuuaagaagagaaaucuuaccauuauggaucugcaucccgggagcggcaaaacacggaaguaccucccugcgaucguucgcgaagccaucaaaagacggcugcgcacccucauucuggcucccacaagaguggucgccgcugagauggaggaagcccuuaagggacugccuauccgguaucagaccacggccacaaaauccgagcacaccggcagagaaauuguggaccugaugugccaugcuaccuucacaaugcgccuccugagccccguucgggugccuaacuacaaucuuaucgucauggaugaggcgcacuuuaccgacccggccucuauugcugccagaggguauaucagcacacgcgugggaaugggcgaagccgcugccaucuucaugaccgcgacgcccccugggacagcugaugccuuuccccaguccaacgccccuauucaggacgaggagcgggacauccccgaaagaucuuggaauagcggaaacgaguggauuaccgauuucgcuggcaagacaguuugguuugugccguccaucaaggccgggaacgacauugcgaauugucugcgcaaaaacggcaagaaagucauccaacucucucggaagaccuucgauacggaauaccagaaaaccaagcugaaugacugggauuuuguggugacaaccgacauuagcgagaugggagccaacuucaaggcugauagagucaucgacccucgccggugccugaaacccguuauccucacagauggccccgagagagugauucuugccgggccuaugcccgugaccgucgcuuccgccgcucagcggcgcggaagagugggccggaauccucagaaggaaaacgaccaauacaucuucacagggcagccgcugaauaacgaugaggaccaugcccacuggaccgaagcgaaaaugcugcucgacaauauuaacacgcccgagggaaucauuccugcccuguuugaacccgagcgcgagaagucugcugccaucgauggcgaauauagacuuaaaggggagagccggaagacauucguugaacugaugagacgcggcgaccucccuguguggcuggcucacaaagucgccuccgagggaaucaaguacaccgaucggaaguggugcuuugacggcgaaagaaauaaccagauucuggaggagaauauggauguggaaaucuggaccaaagagggggaaaagaaaaagcuccgcccccgguggcuugacgccagaacauauagcgauccgcuggcucugaaagaguucaaggacuuugcggccggacgcaagucuauugcucucgaucugguuaccgaaaucggccgggugccuucccaucuugcccacagaacacgcaacgcccuggacaaucucgucaugcugcauacgagcgagcacgggggccgggcuuaccggcacgccguggaggaacugcccgagaccauggaaacacuccuucugcugggccucaugauucugcuuaccggcggggcgaugcuguuccucaucucuggaaaaggcaucgggaagacauccauuggacugaucugugucguggccagcuccggcaugcuguggauggcugauguuccucuccaguggauugccucugcuaucgugcuugaguuuuucaugauggugcugcugauucccgagccugaaaaacaacgcacaccccaggacaaccagcucgccuaugucguuaucgggauucugacgcuugcggccaucguggcugccaaugagaugggacugcucgaaaccacaaagagagaucugggcaugagcaaagaguccggcguggucagcccgaccucuuaccuggacguggaccuccauccugcuuccgccuggacacuuuaugcuguugccaccacggugaucacacccaugcugcggcacaccauugaaaacagcacagcgaacgucucucuggccgcuaucgccaaucaagcugugguccucauggggcuggauaagggauggcccauuagcaagauggaccuuggcgugccucugcucgcccuggggugcuacucccagguuaacccgcugacccucaccgccgcggugcuucugcuggucacacauuacgcuaucauuggacccggccuccaggccaaagcuacgcgcgaggcccagaagagaaccgccgcugggaucaugaaaaauccuacaguggauggaaucaugaccauugaccuggaucccguuaucuaugacucuaaguuugagaaacaacuuggccaggugaugcugcucguccugugugccgugcagcugcuccuuaugcggacaagcugggcguucugcgaagcccugacccuggcuacgggcccuauuacaacccucugggaggggucccccggaaaguuuuggaacaccacaaucgccgugucuauggcuaauauuuucagaggcagcuaccuggccggggcgggacuugccuuuuccaucaugaaaagcguuggcaccgggaaacgcggaacaggcucucagggcgaaacgcugggggagaaguggaaaaagaaacucaaccaacugucccggaaggaguucgaucuguauaaaaagagcggaaucaccgaggucgacagaacagaggcuaaggaaggccucaaacgcggggagauuacccaccaugccgugucccggggaucugcuaaacuucagugguucguggaaagaaauauggucaucccugagggccggguuauugaucugggguguggacgcggcggcuggagcuacuauugcgccgggcugaaaaaggugacagaagugagaggauacaccaaaggcgggccgggacacgaggagcccgucccuauguccacguauggcuggaacaucgugaagcucaugucugggaaggacgucuuuuaccugcccccugaaaaaugugauacccuucugugcgacauuggagagagcucccccagcccgacaguggaagagucucggaccauccgcguccucaagaugguggagccuuggcugaaaaauaaccaguucuguauuaagguucugaaucccuacaugcccacagugaucgaacaccucgagagacuucagcggaaacauggcggcaugcugguccgcaacccucuguccagaaauagcacccacgaaauguauuggaucucuaacgggacaggaaauauuguguccagcgugaacauggucucucggcuccugcuuaaccgcuuuaccaugacgcauagacggcccacaaucgagaaggauguugaccugggcgcugggaccagacacgugaaugccgaaccugagaccccgaacauggacgugauuggagagcgcauccggagaauuaaggaagaacacagcuccacauggcauuacgaugacgaaaaucccuauaaaacgugggcguaccacggcucuuaugaggucaaggccaccgggagcgcuuccagcaugaucaacggagugguuaaacuccugacaaagccuugggaugugguccccauggugacccaaauggccaugacagacaccacaccuuucggccagcagcgcguuuuuaaagaaaagguggauacccggacgcccagaccgaugccuggcacccgcaaggucauggagaucacagcugaguggcuguggcggacccucgggagaaauaaacgcccccggcugugcacaagagaagaguucauuaagaaagugcgcaccaacgccgccaugggagcgguuuuuacggaagagaaucaaugggacuccgcucgggccgccguggaagaugaggaguucuggaaacuugucgacagagaacgcgagcugcauaaacucggcaagugugggucuugcguguacaacaugaugggaaaaagagaaaagaagcugggcgaguuugggaaagcuaagggcagccgggccaucugguauauguggcuuggagcucgcuaccuggaguucgaagcccucggcuuucugaaugaggaucacugguucuccagagaaaacucucauagcggggucgagggagaaggccugcacaaacucggguacauucugcgggacaucuccaagauuccuggaggcgcgauguaugccgaugacacagcugggugggacaccagaaucacagaggaugaccuucacaaugaggagaagaucacccagcagauggaucccgagcaucggcagcuggccaacgcuauuuuuaagcucacguaccaaaauaaggugguuaaagugcagcgcccuacccccaagggcacagucauggacaucauuucuagaaaagaucagcggggaagcggccagguggggaccuauggacugaacacauucaccaauauggaagcccaacuuauccgccagauggagggcgaaggggugcuguccaaggcggaccucgagaacccgcaccuccuggagaaaaagguuacacaguggcucgaaaccaagggaguggagagacugaaacggauggccauuagcggcgaugacugcgucgugaagccuaucgaugaccgcuucgcuaacgcccuucuggcucucaaugauauggggaaaguuagaaaggacaucccccaguggcaacccucuaaaggcuggcaugauuggcaacaggugccuuuuuguucccaccacuuccaugaacugauuaugaaggacggacggaaacuugucgugccgugccgcccccaggacgagcugaucggcagagcccggauuagccaaggggcuggauggucucuccgcgaaacggccugucugggcaaagcguacgcccagaugugggcucugauguauuuucacagacgggaucuccgccuggccuccaacgccaucugcagcgcugucccugugcauuggguucccacaucuagaaccaccugguccauucacgcccaucaccaguggaugacaaccgaggacaugcuuacaguguggaaucgggucuggaucgaggauaacccuuggauggaagacaagacgcccgugaccacaugggaggauguuccuuaccuggggaaaagagaagaccaaugguguggaagccucauuggccugaccucccgcgcgacaugggcucagaauauccuuaccgccauccaacaggugcggagccugauugggaacgaggaguuccucgauuauaugcccucuaugaagagauuucgcaaagaagaggaaagcgagggcgccaucugguga

SEQ ID NO: 20902 - RNA, 9873 nt, Artificial Sequence
  derived and/or modified CDS sequence (opt5) from DENV-3__JQ920477__SS-prME
accagccugugccucaugaugaugcugcccgccacccuugcuuuccaccugacgagcagagacggagaaccucggaugaucguggggaagaacgaacgcggaaaaucucuccuguuuaagaccgccagcggcauuaauauguguacacuuaucgcgauggaucugggggagaugugcgacgauaccgugacauacaaauguccgcucauuaccgaaguugagcccgaagacaucgauugcugguguaaccugacauccaccugggugacguauggaaccugcaaucaggcuggcgagcacagacgggacaagcgcucuguggcccuggccccucacguggggaugggacucgauacaagaacccagacauggaugagcgcugagggcgccuggagacagguggaaaaaguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccagcuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaagccguucagcacgaaaaucucaaguauaccgugauuaucacaguccauacgggggaccagcaccaggugggaaacgagacccaaggcguuacagcugaaaucacaccccaggccuccacaguggaggcuauucugccugaauacggcacccuggggcucgagugcagcccccgcacgggacuggacuuuaaugagaugauccuucugaccaugaaaaacaaggccuggaugguccauagacagugguucuuugaucucccucugcccuggacaucuggcgccaccacagaaaccccgacguggaauaaaaaggagcuucuggugacauucaaaaacgcucacgcgaagaagcaagaagucgugguucucgggucccaggagggagccaugcacaccgcucugacaggcgccaccgaaauucagaccagcgggggcacaucuaucuuugccggacaucugaaaugucggcucaagauggacaaacuggagcuuaagggcauguccuaugcuaugugccugaaugccuucgugcucaaaaaggaggucagcgaaacgcagcacgggaccauucugaucaagguggaguacaaaggagaagaugcgccuuguaagauccccuucuccacagaggacggccaagggaaagcucauaacggacgccugauuaccgccaacccuaucguuacaaagaaagaggaacccgugaauauugaggccgaacccccuuuuggcgagucuaacaucgucauugggaucggcgauaaggcucuuaagaucaauugguacaaaaagggaagcuccauuggcaaaauguucgaagccaccgcuagaggggcccggagaauggcgauccucggagacacggccugggauuuuggcagcgucgggggagugcugaacucucugggcaagaugguucaccagauuuucggguccgcuuauacagcccucuuuagcggcgucucuuggaucaugaaaauuggaaucggcgugcugcuuaccuggauugggcugaauagcaagaacaccuccaugucuuucagcugcaucgugaucggaauuaucacacucuaccugggcgcugucgugcaggccgacaugggguguguuauuaauuggaagggaaaagagcugaagugcggcuccgggaucuuugugaccaacgagguccauacauggacggaacaguauaaauuccaagcggauagcccgaagcgccuugccaccgcuauugccggcgcuugggagaauggaguguguggcauccggucuacaaccagaauggaaaaccuccuguggaaacagaucgccaaugagcugaacuacauucucugggaaaauaacaucaagcugacaauuguugugggggacgucaucggagugcuugagcagggcaaacgcacccugacgccccagccuauggagcucaaguauuccuggaagaccugggggaaagccaagauuguuacagcugaaacccaaaauagcucuuuuaucaucgauggacccaacacaccugagugccccuccgcgcugcgggccuggaacgugugggaagucgaggacuacggcuucggcguguuuaccacaaauauuuggcugaaacuuagagaaaaguauacccagcucugugaccaccgccugaugagcgcugccgugaaagaugagcgggccguccacgcugacaugggguacuggaucgagucccagaagaacggaucuuggaagcuggaaaaagccagccucauugagguuaagacgugcacauggccgaaaucccauacccuguggucuaauggcgugcuugaaagcgauaugaucauuccuaagucccuggcggggcccaucagccagcacaacuacagaccuggauaucauacccaaacagcuggccccuggcaccucgggaaacuggagcuggacuucaauuacugcgagggaaccacgguggucaucacagaaaacuguggcacccgcggcccuucucuucggacaaccacaguguccgggaagcucauucacgaguggugcuguagaagcugcacccugcccccgcugcgcuauaugggagaagauggcuguugguacgggauggagauccggccuauuaaugaaaaggaggagaacaugguuaaaucucucguguccgccggaagcggcaagacggacaauuuuaccauggggguccugugccuugccauccuguucgaagaggugaugagaggaaaauucggcaagaaacauaugauugcuggcgcccucuuuacauucguucugcugcuuucugggcagaucaccuggcgggauauggcgcacacacugauuaugaucggaagcaacgcuuccgaccgcaugggcaugggggugaccuaucucgcccugaucgccacguuuaagauucagcccuuccucgcucugggauuuuuccuuagaaagcugacaagccgggaaaaucuccugcugggcgucgggcuugccauggcuaccacacugcaacuccccgaggauaucgaacagauggccaacggaauugcgcugggccucauggcccugaaacuuaucacccaguuugagaccuaccagcuguggacagcucucgugucucugauguguuccaauacgauuuucacccugacaguugccuggagaaccgcuacacuuauccuggccgugaucagccuccugccugucugccaauccucuagcaugcgcaagaccgacuggcucccgaugacgguggccgcuaugggcgugcccccucugccccuuuuuauuuucucccugaaagauacacugaagcggagaucuuggccucucaacgagggggucauggcgguuggacuggugagcauccuugccuccucuuuucugcgcaaugacgugcccauggcuggcccucucgucgccgggggacugcucauugccuguuaugugaucaccggcaccagcgcugaucugacaguugaaaaagccgcggacgugaccugggaggaagaggcugaacagacaggggucucccauaaccuuaugauuacgguggacgaugacggaaccaugagaaucaaggaugacgagacagagaacauccugaccguucugcucaaaacagcccugcuuauugugagcggcaucuuccccuacucuauuccggccacccugcucgucuggcacacguggcagaagcagacccaacgguccggcgugcugugggaugucccuucucccccugaaacacagaaggcugagcucgaagaggggguguaccgcaucaaacagcagggaauuuuuggcaagacccaaguuggggugggaguccagaaagagggcguguuccauacaauguggcacguuaccagaggggccgugcugacacacaauggaaagcggcuugaacccaacugggcgaaugucaaaaaggaccugaucuccuauggcggcggguggaagcuguccgcucaguggcaaaaaggagaggaaguccaggugauugccguugagccgggcaagaacccuaaaaauuuccagacgaugcccgggaucuuucagaccacaaccggagaaaucggcgccauugcucucgauuucaagccugggaccagcggaucucccaucauuaaccgcgagggcaaagucgugggccuguacgggaauggaguggucacaaagaacggcggguauguguccggaaucgcccaaacgaaugcugagcccgacggcccuaccccggaacuugaggaagagauguuuaagaaaagaaaccugacaauuauggaucuccaucccgggagcggcaagacccggaaauaccugccugccaucguucgcgaagcgaucaagagacggcuccgcacacugauucuugcccccaccagaguggucgcugccgagauggaggaagcucugaaaggacugccuauccgguaucagacgacagccaccaaguccgagcacaccggcagagaaauuguggaccucaugugccaugccacauucaccaugcgccugcuuagccccguucgggugccuaauuacaaccugaucgucauggaugaggcucacuuuacagacccggcgucuauugccgcuagaggguauaucagcacccgcgugggaaugggcgaagccgccgcuaucuccaugacggccacacccccugggaccgcggaugcuuucccccagucuaaugccccuauucaggacgaggagcgggacauccccgaaagaagcuggaacuccggaaaugaguggauuacagauuuugccggcaagaccguuugguucgugccgucuaucaaagcugggaacgacauugccaacugucuccgcaagaauggcaaaaaggucauccaacugagccggaaaacguuugauaccgaauaccagaagacaaagcugaacgacugggauuucguggugaccacagacauuuccgagaugggagcgaauuuuaaagccgauagagucaucgacccucgccggugccucaagcccguuauccuuaccgauggccccgagagagugauucuggcugggccuaugcccgugacagucgccucugcugcccagcggcgcggaagagugggccggaacagccagaaagaaaaugaccaauacaucuucaccgggcagccucugaacaaugaugaggaccaugcucacuggacggaagccaagaugcuccuggacaacauuaauacaccggagggaaucauucccgcgcuuuucgaaccugagcgcgagaaauccgccgcuaucgauggcgaauauagacugaagggggagagccggaaaaccuuuguugaacucaugagacgcggcgaccugcccguguggcuggcccacaaggucgcuucugagggaaucaaguacaccgaucggaaauggugcuucgacggcgaaagaaacaaucagauucucgaggagaacauggauguggaaaucuggacaaaggagggggagaaaaagaaacuucgcccucgguggcuggacgccagaaccuauuccgauccccuggcccucaaggaguuuaaggacuucgcugcgggacgcaaaagcauugcccuggaucuuguuacagaaaucggccgggugccgucucaucuggcucacagaacgcgcaaugcccucgacaaccuggucaugcugcauaccuccgagcacgggggccgggccuaccggcacgcuguggaggaacucccugagacaauggaaacccuucugcugcucggccugaugauucuucugacaggcggggccaugcucuuucugaucagcggaaagggcaucgggaaaaccuccauuggacugaucugugucguggcgucuagcggcaugcucuggauggccgauguuccccuucaguggauugcuuccgccaucgugcuggaguucuuuaugauggugcugcucauuccugagcccgaaaagcaacgcacgccucaggacaaucagcuggcuuaugucguuaucgggauucuuacccuggccgcgaucguggccgcuaacgagaugggacuccuggaaacaaccaaaagagaucugggcaugagcaaggagcccggcguggucucuccgacauccuaccucgacguggaccuucauccugccagcgcuuggacccuguaugccguugcuacgacagugaucacccccaugcugcggcacacaauugaaaauucuaccgccaacgucagccucgcggccaucgcuaaccaagccgugguccugauggggcuugauaagggauggcccauuuccaaaauggaccugggcgugccucuccuggcucuggggugcuacucucagguuaauccgcucacccuuacagccgccgugcugcugcucgucacgcauuacgcgaucauuggacccggccugcaggcuaaggccacccgcgaggcucagaaaagaacagccgccgggaucaugaagaacccuaccguggauggaaucaugacaauugaccuugaucccguuaucuaugacagcaaauucgagaagcaacugggccaggugaugcuccugguccugugugcugugcagcuccuucugaugcggaccuccugggccuuuugcgaagcgcugacgcucgccacaggcccuauuaccacccugugggaggggucucccggaaaguucuggaauacaaccaucgcugugagcauggccaacauuuuuagaggcuccuaccuugcuggggccggacuggcguucagcaucaugaaaucuguuggcacagggaagcgcggaacgggcucccagggcgaaacccucggggagaaauggaagaaaaagcugaaucaacugagccggaaagaauuugaucucuauaagaaguccggaaucacagaggucgacagaaccgaggccaaagaaggccuuaagcgcggggagauuacacaccaugcugugucucggggaagcgccaaacugcagugguucguggaaagaaacauggucaucccugagggccggguuauugaucugggguguggacgcggcggcugguccuacuauugcgcugggcucaagaaagugaccgaagugagaggauacacgaagggcgggccgggacacgaggagcccgucccuaugucuaccuauggcuggaauaucgugaagcugaugagcgggaaagacguuuucuaccuucccccugaaaagugugauacacugcucugcgacauuggagaguccagccccucuccgaccguggaagagucccggacaauccgcguccugaaaaugguggagccuuggcugaagaacaaucaguuuuguauuaaaguucucaaccccuacaugcccaccgugaucgaacaccuugagagacugcagcggaagcauggcggcaugcugguccgcaauccucucagcagaaacucuacacacgaaauguauuggaucuccaaugggaccggaaacauugugagcucugugaauauggucagccggcugcuucugaaccgcuucacgaugacacauagacggcccaccaucgagaaggauguugaccucggcgccgggaccagacacgugaacgcugaaccugagacaccgaauauggacgugauuggagagcgcauccggagaauuaaagaggaacacuccucuacguggcauuacgaugacgaaaaccccuauaagaccugggccuaccacggcagcuaugaggucaaagcgacaggguccgccagcuccaugaucaauggagugguuaagcugcugaccaaaccuugggaugugguccccauggugacacaaauggcuaugaccgacacaaccccuuuuggccagcagcgcguuuucaaggaaaagguggauacgcggacccccagaccgaugccuggcacacgcaaagucauggagaucaccgccgaguggcucuggcggacacuggggagaaacaagcgcccccggcuuugcaccagagaagaguuuauuaaaaaggugcgcacgaaugcugccaugggagccguuuucacagaagagaaccaaugggacucugcgcgggcugccguggaagaugaggaguuuuggaaacuggucgacagagaacgcgagcuccauaagcugggcaaaugugggagcugcguguacaauaugaugggaaagagagaaaagaaacuuggcgaguucgggaaggccaaaggcucccgggcuaucugguauauguggcugggagcccgcuaccucgaguuugaagcucugggcuuccugaacgaggaucacugguuuucuagagaaaauagccauuccggggucgagggagaaggccuccacaagcugggguacauucuucgggacaucucuaaaauuccuggaggcgccauguaugcggaugacaccgccgggugggacacaagaaucaccgaggaugaccugcacaacgaggaaaagaucacgcagcagauggaucccgagcaucggcagcucgcuaaugccauuuucaagcugaccuaccaaaacaaagugguuaaggugcagcgcccuacacccaaaggcaccgucauggacaucauuagcagaaaggaucagcggggauccggccagguggggacauauggacuuaauaccuuuacaaacauggaagcucaacugauccgccagauggagggcgaaggggugcucagcaaagccgaccuggagaauccgcaucugcucgagaagaagguuacccaguggcuggaaacgaaaggaguggagagacuuaagcggauggcgauuucuggcgaugacugcgucgugaaaccuaucgaugaccgcuucgccaacgcucugcucgcccugaacgauauggggaagguuagaaaagacaucccccaguggcaacccuccaagggcuggcaugauuggcaacaggugccuuucuguagccaccacuuucaugaacuuauuaugaaggacggacggaaacuggucgugccgugccgcccccaggacgagcucaucggcagagcucggauuucucaaggggccggauggucccugcgcgaaacagcuugucugggcaaggccuacgcgcagaugugggcccucauguauuuccacagacgggaucugcgccuugcuagcaaugccaucugcucugccgucccugugcauuggguucccaccuccagaaccacauggagcauucacgcucaucaccaguggaugaccacagaggacaugcugacgguguggaaccgggucuggaucgaggauaauccuuggauggaagacaaaacccccgugacaaccugggaggauguuccuuaccucgggaagagagaagaccaaugguguggaucccugauuggccuuacaagccgcgccaccugggcgcagaacauccugacggcuauccaacaggugcggucucucauugggaaugaggaguuucuggauuauaugcccagcaugaaaagauuccgcaaggaagaggaauccgagggcgccaucugguga

SEQ ID NO: 20903 - RNA, 9873 nt, Artificial Sequence
  derived and/or modified CDS sequence (opt5) from DENV-3__JQ920478__SS-prME
accagccucugccucaugaugaugcugcccgccacccuugcuuuccaccugacgagccgggacggcgaaccucggaugaucguggggaagaacgaacgcggaaagucucuccuguuuaagaccgccagcggcauuaauauguguacccuuaucgcgauggaucugggggagaugugcgacgauaccgucacauacaaguguccgcucauuaccgaaguugagcccgaagacaucgauugcugguguaaccugacauccaccugggugacguauggaaccugcaaucaggcuggcgagcaucggcgggacaagcgcucuguggcccuggccccucacgucgggaugggacucgauacaagaacccagacauggaugagcgcugagggcgccuggagacagguggaaaagguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccagcuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaagccguucagcacgaaaaucucaaguauaccgugauuaucacaguccauacgggggaccagcaccaggugggaaacgagacccaaggcguuacagcugaaaucacaccccaggccuccacaguggaggcuauucugccugaauacggcacccuggggcucgagugcagcccccgcacgggacuggacuuuaaugagaugauccuucugaccaugaaaaacaaggccuggaugguccauagacagugguucuuugaucucccucugcccuggacaucuggcgccaccacagaaaccccgacguggaauaaaaaggagcuucuggugacauucaaaaacgcucacgcgaagaagcaagaagucgugguucucgggucccaggagggagccaugcacaccgcucugacaggcgccaccgaaauucagaccagccgggggacaucuaucuuugccggccaucugaaaugucgccucaagauggacaaacuggagcuuaagggaauguccuaugcuaugugccugaaugccuucgugcucaaaaaggaggucagcgaaacgcagcacggcaccauucugaucaagguggaguacaaaggggaagaugcgccuuguaagauccccuucuccacagaggacggacaaggcaaagcucauaacgggagacugauuaccgccaacccuaucguuacaaagaaagaggaacccgugaauauugaggccgaacccccuuuuggagagucuaacaucgucauuggcaucggggauaaggcucuuaagaucaauugguacaaaaagggcagcuccauuggaaaaauguucgaagccaccgcucggggcgccagacgcauggcgauccucggggacacggccugggauuuuggaagcgugggcggggugcugaacucucugggaaagaugguucaccagauuuucggcuccgcuuauacagcccucuuuagcggggucucuuggaucaugaaaauuggcaucggagugcugcuuaccuggauuggccugaauagcaagaacaccuccaugucuuucagcugcaucgugaucgggauuaucacacucuaccugggagcugucgugcaggccgacaugggcuguguuauuaauuggaaggggaaagagcugaagugcggauccggcaucuuugugaccaacgagguccauacauggacggaacaguauaaauuccaagcggauagcccgaagcggcuugccaccgcuauugccggggcuugggagaauggcguguguggaaucagaucuacaacccgcauggaaaaccuccuguggaaacagaucgccaaugagcugaacuacauucucugggaaaauaacaucaagcugacaauuguugugggcgacgucaucggggugcuugagcagggaaaacggacccugacgccccagccuauggagcucaaguauuccuggaagaccuggggcaaagccaagauuguuacagcugaaacccaaaauagcucuuuuaucaucgaugggcccaacacaccugagugccccuccgcgcugagagccuggaacgugugggaagucgaggacuacggauucggcguguuuaccacaaauauuuggcugaaacuucgcgaaaaguauacccagcucugugaccaccggcugaugagcgcugccgugaaagaugagagagccguccacgcugacaugggcuacuggaucgagucccagaagaacgggucuuggaagcuggaaaaagccagccucauugagguuaagacgugcacauggccgaaaucccauacccuguggucuaauggagugcuugaaagcgauaugaucauuccuaagucccuggcgggccccaucagccagcacaacuaccgcccuggguaucauacccaaacagcuggacccuggcaccucggcaaacuggagcuggacuucaauuacugcgaggggaccacgguggucaucacagaaaacuguggaacccggggcccuucucuuagaacaaccacaguguccggcaagcucauucacgaguggugcugucgcagcugcacccugcccccgcugcgguauaugggggaagauggauguugguacggcauggagaucagaccuauuaaugaaaaggaggagaacaugguuaaaucucucguguccgccgggagcggaaagacggacaauuuuaccaugggcguccugugccuugccauccuguucgaagaggugaugcgggggaaauucggaaagaaacauaugauugcuggcgcccucuuuacauucguucugcugcuuucuggccagaucaccuggcgcgauauggcgcacacacugauuaugaucgggagcaacgcuuccgacagaaugggaaugggcgugaccuaucucgcccugaucgccacguuuaagauucagcccuuccucgcucugggguuuuuccuucggaagcugacaagcagagaaaaucuccugcugggagucggccuugccauggcuaccacacugcaacuccccgaggauaucgaacagauggccaacgggauugcgcugggacucauggcccugaaacuuaucacccaguuugagaccuaccagcuguggacagcucucauuucucugauguguuccaauacgaucuucacccugacaguggccuggcgcaccgcuacacuuauccuggccguuauuagccuccugccugugugccaauccucuagcaugcggaagaccgacuggcucccgaugacggucgccgcuaugggcgugcccccucugccccuuuuuaucuucucccugaaagauacacugaagagacgcucuuggccucucaacgagggcgugauggcggucgggcugguuagcauucuugccuccucuuuucugagaaaugacgugcccauggcuggaccucucguggccggcgggcugcucaucgccuguuaugucauuaccggaaccagcgcugaucugacaguggaaaaagccgcggacguuaccugggaggaagaggcugaacagacaggcgugucccauaaccuuaugaucacggucgacgaugacgggaccaugcggaucaaggaugacgagacagagaacauucugaccgugcugcucaaaacagcccugcuuaucguuagcggaauuuuccccuacucuaucccggccacccugcucguguggcacacguggcagaagcagacccaacgcuccggcguccugugggaugugccuucucccccugaaacacagaaggcugagcucgaagagggcgucuacagaauuaaacagcaggggaucuuuggaaagacccaagugggcguuggggugcagaaagagggagucuuccauacaauguggcacgugacccggggcgccguucugacacacaaugggaagcgccuugaacccaacugggcgaaugugaaaaaggaccugauuuccuauggaggcggcuggaagcuguccgcucaguggcaaaaaggggaggaaguccaggugaucgccguggagccgggaaagaacccuaaaaauuuccagacgaugcccggcaucuuucagaccacaaccggggaaauuggagccaucgcucucgauuucaagccuggcaccagcgggucucccauuaucaacagagagggaaaaguugucggccuguacggcaaugggguggugacaaagaacggaggcuaugucuccgggauugcccaaacgaaugcugagcccgacggaccuaccccggaacuugaggaagagauguuuaagaaacggaaccugacaaucauggaucuccaucccggcagcgggaagacccgcaaauaccugccugccaucgugagagaagcgauuaagcggcgccucagaacacugauccuugcccccacccggguuguggcugccgagauggaggaagcucugaaaggccugccuauuagauaucagacgacagccaccaaguccgagcacaccggacgcgaaaucgucgaccucaugugccaugccacauucaccaugcggcugcuuagccccgugagaguuccuaauuacaaccugauugugauggaugaggcucacuuuacagacccggcgucuaucgccgcucgcggcuauaucagcacccgggucgggaugggagaagccgccgcuauuuucaugacggccacacccccuggcaccgcggaugcuuuuccccaguccaaugccccuauccaggacgaggagagagacauucccgaacgcucuuggaacagcgggaaugaguggaucacagauuucgccggaaagaccgugugguuuguuccguccauuaaagcuggcaacgacaucgccaacugucuccggaagaaugggaaaaaggugauucaacugucuagaaaaacguucgauaccgaauaccagaagacaaagcugaacgacugggauuuugucgugaccacagacaucagcgagaugggcgcgaauuucaaagccgaucgcgugaucgacccucggagaugccucaagcccgucauucuuaccgauggacccgagcggguuauccuggcuggcccuaugcccgugacaguggccuccgcugcccagcgcagagggcgggucggacgcaacucucagaaagaaaaugaccaauacauuuucaccggccagccucugaacaaugaugaggaccaugcucacuggacggaagccaagaugcuccuggacaacaucaauacaccggaggggauuauccccgcgcuuuuugaaccugagagagagaaaagcgccgcuaucgauggagaauaucggcugaagggcgaguccagaaaaaccuucguggaacucaugcgcagaggggaccugcccguuuggcuggcccacaagguggcuagcgagggcauuaaguacaccgauagaaaauggugcuuugacggagaacgcaacaaucagauccucgaggagaacauggaugucgaaauuuggacaaaggagggcgagaagaagaaacuucggccuagauggcuggacgcccgcaccuauucugauccccuggcccucaaggaguucaaggacuuugcugcggggcggaaauccaucgcccuggaucuugugacagaaauuggaagaguuccgagccaucuggcucaccgcacgagaaaugcccucgacaaccuggugaugcugcauaccucugagcacggcgggcgggccuaccgccacgcugucgaggaacucccugagacaauggaaacccuucugcugcucggacugaugauccuucugacaggcggcgccaugcuguuccugaucuccgggaagggaauuggcaaaaccagcaucgggcugauuuguguggucgcguccucuggaaugcucuggauggccgaugugccccuucaguggaucgcuagcgccauuguucuggaguuuuucaugauggugcugcucaucccugagcccgaaaagcaaagaacgccucaggacaaucagcuggcuuauguggucauuggcauccuuacccuggccgcgaucguugccgcuaacgagauggggcuccuggaaacaaccaaacgggaucugggaauguccaaggagcccggcguggugagcccgacaucuuaccucgacgucgaccuucauccugccuccgcuuggacccuguaugccguggcuacgacaguuauuacccccaugcugcgccacacaaucgaaaauagcaccgccaacgugucucucgcggccauugcuaaccaagccgucgugcugaugggccuugauaagggguggcccaucagcaaaauggaccugggagucccucuccuggcucugggcugcuacucccaggugaauccgcucacccuuacagccgccguucugcugcucgugacgcauuacgcgauuaucgggcccggacugcaggcuaaggccaccagagaggcucagaaacggacagccgccggcaucaugaagaacccuaccgucgaugggauuaugacaaucgaccuugaucccgugauuuaugacucuaaauuugagaagcaacugggacagguuaugcuccuggugcugugugcuguccagcuccuucugaugagaaccagcugggccuucugcgaagcgcugacgcucgccacaggcccuaucaccacccugugggagggcucccccgggaaguuuuggaauacaaccauugcugugucuauggccaacaucuuccgcggaagcuaccuugcuggcgccgggcuggcguuuuccaucaugaaaagcgugggaacaggcaagcgggggacgggaucucagggcgaaacccucggcgagaaauggaagaaaaagcugaaucaacuguccagaaaagaguucgaucucuauaaaaagagcgggauuacagagguugaccgcaccgaggccaaagaaggacuuaagcggggcgagaucacacaccaugcugucuccagagggucugccaaacugcagugguucguggaacggaacauggugauuccugagggacgcgucaucgaucugggcugugggagaggaggcuggagcuacuauugcgcuggccucaagaaaguuaccgaagugcggggguacacgaagggaggcccggggcacgaggagcccgugccuauguccaccuauggauggaauauugucaagcugaugucuggcaaagacguguuuuaccuucccccugaaaagugugauacacugcucugcgacaucggggagagcucccccagcccgaccguugaagagucucgcacaauuagagugcugaaaauggucgagccuuggcugaagaacaaucaguucuguaucaaagugcucaaccccuacaugcccaccguuaucgaacaccuugagcggcugcagcgcaagcauggaggcaugcuggugagaaauccucucucccggaacagcacacacgaaauguauuggauuucuaauggcaccgggaacaucgucuccagcgugaauauggugucucgccugcuucugaacagauuuacgaugacacaucggagacccaccauugagaaggaugucgaccucggagccggcacccgccacguuaacgcugaaccugagacaccgaauauggacgugaucggggagcggauuagacgcaucaaagaagaacacagcuccacguggcauuacgaugacgaaaaccccuauaagaccugggccuaccacggaucuuaugaggugaaagcgacaggcagcgccuccagcaugaucaauggggucgugaagcugcugaccaaaccuugggaucucguucccauggugacacaaauggcuaugaccgacacaaccccuuucggacagcagcgggucuuuaaggaaaagguggauacgagaacaccccgcccgaugccuggcacacggaaaguuauggagauuaccgccgaguggcuguggagaacacuuggccgcaacaagcggcccagacugugcacccgcgaagaguucaucaaaaaggugcggacgaaugcugccaugggggccgucuuuacagaagagaaccaaugggacuccgcgagagcugccguggaagaugaggaguucuggaaacucguugaccgcgaaagagagcugcauaaacuuggaaaauguggcucuugcguguacaauaugauggggaagcgggaaaagaaacugggagaguuuggcaaggccaaagggagccgcgcuauuugguauauguggcucggcgccagauaccuggaguucgaagcucugggauuucucaacgaggaucacugguucucccgggaaaauucucauagcggcgucgagggggaaggacugcacaaacuuggcuacauccugagagacauuuccaaaaucccugggggagccauguaugcggaugacaccgccggcugggacacacggaucaccgaggaugaccuccacaacgaggaaaagauuacgcagcagauggaucccgagcaucgccagcuggcuaaugccaucuuuaaacuuaccuaccaaaacaaaguggucaaggugcagagaccuacacccaaagggaccguuauggacauuaucucucggaaggaucagcgcggcagcggacaggugggcacauaugggcugaauaccuucacaaacauggaagcucaacucauuagacagauggagggagaaggcguccuguccaaagccgaccuggagaauccgcaccuccuggagaagaaggugacccaguggcuugaaacgaaagggguggagcggcugaagcgcauggcgaucagcggagaugacugcguugugaaaccuaucgaugacagauucgccaacgcucuccuggcccuuaacgauaugggcaagguccggaaagacauuccccaguggcaacccucuaagggguggcaugauuggcaacaggugccuuuuuguucccaccacuuccaugaacugaucaugaaggacggccgcaaacucguugugccgugcagaccccaggacgagcugauuggacgggcucgcaucagccaaggcgccggguggucucugagagaaacagcuugucucggaaaggccuacgcgcagaugugggcccugauguauuuucaccggcgcgaucuuagacuggcuuccaaugccauuugcagcgccgucccugugcauuggguccccaccucucggaccacaugguccauccacgcucaucaccaguggaugaccacagaggacaugcucacgguguggaacagaguuuggauugaggauaauccuuggauggaagacaaaacccccgugacaaccugggaggaugucccuuaccugggcaagcgcgaagaccaauggugugggagccuuaucggacugacaucccgggccaccugggcgcagaacauccucacggcuauucaacaggugagaagccugaucggcaaugaggaguuccuggauuauaugcccucuaugaaacgcuuucggaaggaagaggaaagcgagggggccauuugguga

SEQ ID NO: 20904 - RNA, 9873 nt, Artificial Sequence
  derived and/or modified CDS sequence (opt5) from DENV-3__JQ920480__SS-prME
accagccugugccucaugaugaugcugcccgccacccuugcuuuccaccugacgagcagagacggcgaaccucggaugaucguggggaagaacgaacgcggaaagucucuccuguuuaagaccgccagcggcauuaauauguguacacuuaucgcgauggaucugggggagaugugcgacgauaccgugacauacaaguguccgcucauuaccgaaguugagcccgaagacaucgauugcugguguaaccugacauccaccugggugacguauggaaccugcaaucaggcuggcgagcauagacgggacaagcgcucuguggcccuggccccucacguggggaugggacucgauacaagaacccagacauggaugagcgcugagggcgccuggagacagguggaaaagguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaagcccacccuggacaucgagcuccagaagacagaagccacccagcuggcuacacuucgcaagcuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaagccguucagcacgaaaaucucaaguauaccgugauuaucacaguccauacgggggaccagcaccaggugggaaacgagacccaaggcguuacagcugaaaucacaccccaggccuccacaguggaggcuauucugccugacuacggcacccuggggcucgaaugcagcccccgcacgggacuggauuuuaaugagaugauccuucugaccaugaaaaacaaggccuggaugguccauagacagugguuccucgaccugccucuucccuggacaucuggcgccaccacagagaccccgacguggaauaaaaaggaacugcucgugacauuuaaaaacgcucacgcgaagaagcaagaggucgugguucuggggucccaggaaggagccaugcacaccgcucugacaggcgccaccgagauucagaccagcgggggcacaucuaucuucgccggacaucucaaaugucggcugaagauggauaaacuugaacugaagggcauguccuaugcuaugugccucaaugccuuugugcugaaaaaggaggucagcgagacgcagcacgggaccauucugaucaagguggaauacaaaggagaggacgcgccuuguaagauccccuucuccacagaagauggccaagggaaagcucauaacggacgccuuauuaccgccaacccuaucguuacaaagaaagaggagcccgugaauauugaagccgagcccccuuucggcgaaucuaacaucgucauugggaucggcgacaaggcucucaagaucaauugguacaaaaagggaagcuccauuggcaaaauguuugaggccaccgcuagaggggcccggagaauggcgauccugggagauacggccugggacuucggcagcgucgggggagugcugaacucucucggcaagaugguucaccagauuuuuggguccgcuuauacagcccuguucagcggcgucucuuggaucaugaaaauuggaaucggcgugcuucugaccuggauugggcucaauagcaagaacaccuccaugucuuuuagcugcaucgugaucggaauuaucacacuguaccugggcgcugucgugcaggccgauaugggguguguuauuaauuggaagggaaaagaacuuaagugcggcuccgggaucuucgugaccaacgagguccauacauggacggagcaguauaaauuucaagcggacagcccgaagcgccucgccaccgcuauugccggcgcuugggaaaauggaguguguggcauccggucuacaaccagaauggagaaccugcuguggaaacagaucgccaaugaacucaacuacauucugugggagaauaacaucaaacuuacaauuguugugggggaugucaucggagugcuggaacagggcaaacgcacccucacgccccagccuauggagcugaaguauuccuggaagaccugggggaaagccaagauuguuacagcugagacccaaaauagcucuuucaucaucgacggacccaacacaccugaaugccccuccgcgcugcgggccuggaacgugugggaggucgaagacuacggcuuuggcguguucaccacaaauauuuggcuuaaacucagagagaaguauacccagcugugugaucaccgccugaugagcgcugccgugaaagacgaacgggccguccacgcugauaugggguacuggaucgagucccagaagaacgagucuuggaagcucgaaaaagccagccugauugagguuaagacgugcacauggccgaaaucccauacccuuuggucuaauggagugcuggaaagcgacaugaucauuccuaagucccucgcgggccccaucagccagcacaacuacagaccuggguaucauacccaaacagcuggacccuggcaccugggcaaacuggagcuugauuuuaauuacugcgaggggaccacgguggucaucacagaaaacuguggaacccgcggcccuucucuccggacaaccacaguguccggcaagcugauucacgaguggugcuguagaagcugcacccugcccccgcuccgcuauaugggggaagacggauguugguacggcauggagauccggccuauuaaugaaaaggaggagaacaugguuaaaucucugguguccgccgggagcggaaagacggauaauuucaccaugggcguccuuugccuggccauccucuuugaagaggugaugagagggaaauucggaaagaaacauaugauugcuggcgcccuguucauguuuguucugcuucugucuggccagaucacauggcgggacauggugcacacccucauuaugaucgggagcaacgcguccgaucgcaugggaaugggcgucacauaucuggcucucaucgccaccuucaagauucagcccuuucuggcccuuggguucuuucugagaaagcucacgagccgggaaaaucugcugcuuggagugggccuggcuauggccacaacccuccaacugcccgaggacaucgaacagauggcuaacgggauugcccucggacugauggcgcuuaaacugaucacacaguucgagaccuaccagcucuggaccgcccugauuucucugauguguuccaauacaaucuuuacgcuuaccguugcuuggagaacagccacccugauccucgcugugauuagccugcucccugucugccaauccucuagcaugcgcaagacagauuggcugccgaugaccguggccgccaugggcgugcccccucuuccccuguucaucuuuucccugaaagacacgcucaagcggagaucuuggccucugaacgagggcgucauggcuguugggcuugugagcauucuggcguccucuuuccuccgcaaugaugugcccauggccggaccucuggucgcuggcgggcuccugaucgccuguuaugugauuacaggaaccagcgccgaccuuaccguugaaaaagcugccgacgugacaugggaggaagaggcggaacagaccggcgucucccauaaccugaugaucacaguggaugacgaugggacgaugagaaucaaggacgaugagaccgagaacauucugacaguucuccugaaaaccgcccuucugaucgugagcggaauuuuucccuacucuaucccggccacacuccuggucuggcacaccuggcagaagcagacgcaacgguccggcgugcucugggacgucccuucucccccugaaacccagaaggccgagcuggaagagggcguguaccgcauuaaacagcaggggaucuucggaaagacacaaguuggcguggggguccagaaagagggaguguuucauaccauguggcacguuacaagaggcgcugugcuuacccacaaugggaagcggcuggaacccaacugggccaaugucaaaaaggaucugauuuccuauggaggcggcuggaagcucuccgcgcaguggcaaaaaggggaggaaguccaggugaucgcuguugagccgggaaagaacccuaaaaauuuccagacaaugcccggcaucuuccagacgaccacaggggaaauuggagccaucgcccuggacuuuaagccuggcaccagcgggucucccauuaucaaccgcgagggaaaagucgugggccuuuacggcaaugggguggucaccaagaacggaggcuauguguccgggauugcucaaacaaaugccgagcccgauggaccuacgccggaacuggaggaagagauguucaagaaaagaaaccucaccaucauggaccugcaucccggcagcgggaagacacggaaauaccucccugcuaucguucgcgaagccauuaagagacggcugcgcacccuuauccuggcgcccacaagaguggucgccgcugagauggaggaagcccugaaaggccucccuauucgguaucagaccacggcuacaaaguccgagcacaccggaagagaaaucguggaucugaugugccaugccaccuuuacaaugcgccuucugagccccguucgggugccuaauuacaaccucauugucauggacgaggcccacuucaccgauccggcuucuaucgcggccagaggcuauaucagcacacgcguggggaugggagaagcugccgccauuuuuaugaccgcuacgcccccuggcacagccgacgcguucccccaguccaaugcuccuauccaggacgaggagcgggauauucccgaaagaucuuggaacagcgggaaugaguggaucaccgacuuugccggaaagacaguuugguucgugccguccauuaaagccggcaacgauaucgcuaacugucugcgcaagaaugggaaaaaggucauucaacugucucggaaaaccuuugacacggaauaccagaagaccaagcucaacgauugggacuucguggugacaaccgauaucagcgagaugggcgccaauuuuaaagcggacagagucaucgauccucgccggugccuuaagcccguuauucugacagacggacccgagagagugauccuggccggcccuaugcccgugaccgucgcuuccgccgcucagcggcgcgggagagugggacggaacucucagaaagaaaaugaucaauacauuuucacaggccagccucucaacaaugacgaggaccaugcccacuggaccgaagcuaagaugcugcuugauaacaucaauacgccggaggggauuauccccgcccuguucgaaccugagcgcgagaaaagcgcggccaucgacggagaauauagacucaagggcgagucccggaaaacauuuguugaacugaugagacgcggggaucugcccguguggcucgcucacaaggucgccagcgagggcauuaaguacaccgaccggaaauggugcuucgauggagaaagaaacaaucagauccuugaggagaacauggacguggaaauuuggaccaaggagggcgagaagaagaaacugcgcccucgguggcuggaugcuagaacauauucugacccccucgcccugaaggaguuuaaggauuucgccgcugggcgcaaauccaucgcgcuugaccugguuaccgaaauuggacgggugccgagccaucucgcccacagaacacgcaaugcucuggauaaccuggucaugcuccauacgucugagcacggcgggagagccuaccggcacgccguggaggaacuuccugagaccauggaaacacugcugcuccugggacuuaugauccugcucaccggcggcgcuaugcuguuucugaucuccgggaagggaauuggcaaaacaagcaucgggcucauuugugucguggccuccucuggaaugcuuuggauggcggacguuccccugcaguggaucgccagcgcuauugugcuggaguucuuuaugauggugcuccugaucccugagcccgaaaagcaacgcaccccucaggauaaucagcuugccuaugucguuauuggcauccugacgcucgcugccaucguggcggccaacgagauggggcugcuggaaaccacaaaaagagaccucggaauguccaaggagcccggcguggucagcccgaccucuuaccuugacguggaucugcauccugcuuccgccuggacacuguaugcuguugccaccacggugauuacacccaugcuccggcacaccaucgaaaauagcacagcuaacgucucucuggccgcgauugccaaccaagcugugguccuuaugggccuggacaagggguggcccaucagcaaaauggaucucggagugccucugcuggcccucggcugcuacucccagguuaauccgcuuacccugaccgcugccgugcugcuccuggucacacauuacgccauuaucgggcccggacuucaggcgaaggcuacgcgcgaggcccagaaaagaaccgcugccggcaucaugaagaacccuacaguggacgggauuaugaccaucgaucuggaccccguuauuuaugauucuaaauucgagaagcaacucggacaggugaugcugcugguccucugugccgugcagcuucugcugaugcggacaagcugggcuuuuugcgaagcccucacccuggcgacgggcccuaucacaacccuuugggagggcucccccgggaaguucuggaauaccacaauugccgugucuauggcuaacaucuuuagaggaagcuaccuggccggcgcugggcucgccuucuccaucaugaaaagcguuggaaccggcaagcgcgggacaggaucucagggcgaaacgcugggcgagaaauggaagaaaaagcugaaucaacucucccggaaagaauuugaccuuuauaaaaagagcgggauuaccgaggucgauagaacagaggcgaaagaaggacugaagcgcggcgagaucacccaccaugccgugucccgggggucugcuaaacugcagugguucguggaaagaaacauggucauuccugagggacggguuaucgaccucggcugugggcgcggaggcuggagcuacuauugcgccggccugaagaaagugacagaagugagaggguacaccaagggaggcccggggcacgaggagcccgucccuauguccacguauggauggaauauugugaaacuuaugucuggcaaagauguuuucuaccugcccccugaaaagugugacacccuccugugcgauaucggggagagcucccccagcccgacaguggaagagucucggaccauucgcguccugaaaaugguggagccuuggcucaagaacaaucaguuuuguaucaaaguucuuaaccccuacaugcccacagugaucgaacaccuggagagacugcagcggaagcauggaggcaugcucguccgcaauccucuguccagaaacagcacccacgaaauguauuggauuucuaauggcacagggaacaucguguccagcgugaauauggucucucggcuucugcucaaccgcuucaccaugacgcauagacggcccacaauugagaaggacguugaccugggagcuggcaccagacacgugaacgccgaaccugagaccccgaauauggaugugaucggggagcgcauucggagaaucaaagaggaacacagcuccacauggcauuacgacgaugaaaaccccuauaagacgugggcuuaccacggaucuuaugaggucaaagccaccggcagcgcguccagcaugaucaauggggugguuaagcugcucacaaaaccuugggacgugguccccauggugacccaaauggccaugacagauaccacaccuuuuggacagcagcgcguuuucaaggaaaagguggacacccggacgcccagaccgaugccuggcacccgcaaagucauggagauuacagcugaguggcuguggcggacccuuggcagaaacaagcgcccccggcugugcacaagagaagaguuuaucaaaaaggugcgcaccaaugccgcuaugggggccguuuucacggaagagaaccaaugggauuccgcccgggcggcuguggaagacgaggaguuuuggaaacucgucgauagagaacgcgagcugcauaaacuuggaaaauguggcucuugcguguacaauaugauggggaagagagaaaagaaacugggagaguucggcaaggccaaagggagccgggccauuugguauauguggcucggcgcucgcuaccuggaguuugaagcccugggauuccucaacgaggaccacugguuuuccagagaaaauucucauagcggcgucgagggggaaggacugcacaaacuuggcuacauccugcgggauauuuccaaaaucccugggggagcuauguaugccgacgacacagcgggcugggauaccagaaucacagaggacgaucuccacaacgaggaaaagauuacccagcagauggaccccgagcaucggcagcuggccaaugcuaucuucaaacuuacguaccaaaacaaagugguuaaggugcagcgcccuacccccaaagggacagucauggauauuaucucuagaaaggaccagcggggcagcggacaggugggcaccuaugggcugaauacauuuaccaacauggaagcccaacucauucgccagauggagggagaaggcgugcuguccaaagcugaucuggagaauccgcaccuccuggagaagaagguuacacaguggcuugaaaccaaagggguggagagacugaagcggauggccaucagcggagacgauugcgucgugaaaccuaucgacgaucgcuucgcgaacgcccuccuggcucuuaacgacaugggcaagguuagaaaagauauuccccaguggcaacccucuaagggguggcaugacuggcaacaggugccuuucuguucccaccacuuucaugaacugaucaugaaggacggccggaaacucgucgugccgugccgcccccaggaugagcugauuggacgggcucggaucagccaaggcgcuggguggucucugcgcgaaacggccugucucggaaaggcuuacgcccagaugugggcgcugauguauuuccacagacgggaccuucgccuggccuccaaugcuauuugcagcgccgucccugugcauuggguucccacaucuagaaccaccugguccauccacgcccaucaccaguggaugacaaccgaggauaugcucacaguguggaaccgggucuggauugaggacaauccuuggauggaagauaaaacgcccgugaccacaugggaggacguuccuuaccugggcaagagagaagaucaauggugugggagccuuaucggacugaccucccgcgcuacaugggcccagaacauccucaccgcgauucaacaggugcggagccugaucggcaaugaggaguuucuggacuauaugcccucuaugaaaagauuccgcaaggaagaggaaagcgagggggcuauuugguga

SEQ ID NO: 20905 - RNA, 9873 nt, Artificial Sequence
  derived and/or modified CDS sequence (opt5) from DENV-3__JQ920479__SS-prME
accagccugugccucaugaugaugcugcccgccacccuugcuuuccaccugacguccagagacggagagccucggaugaucguggggaagaacgaacgcggaaagucucuccuguuuaagaccgccagcggcauuaauauguguacacuuaucgcgauggaucugggggagaugugcgacgauaccgugaccuacaaguguccgcucauuaccgaaguugagcccgaagacaucgauugcugguguaaccugacauccaccugggugacguauggaaccugcaaucaggcuggcgagcauagacgggacaagcgcucuguggcccuggccccucacguggggaugggacucgauacaagaacccagacauggaugagcgcugagggcgccuggagacagguggaaaagguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaagcccacccuggacaucgagcuccagaagacagaagccacccagcuggcuacacuucgcaagcuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaagccguucagcacgaaaaucucaaguauaccgugauuaucacaguccauacgggggaccagcaccaggugggaaacgagacccaaggcguuacagcugaaaucacaccccaggccuccacaguggaggcuauucugccugaauacggcacccuggggcucgagugcagcccccgcacgggacuggacuuuaaugagaugauccuucugaccaugaaaaacaaggccuggaugguccauagacagugguuccucgaucugccucuucccuggacaucuggcgccaccacagaaaccccgacguggaauaaaaaggagcugcucgugacauuuaaaaacgcucacgcgaagaagcaagaagucgugguucuggggucccaggagggagccaugcacaccgcucugacaggcgccaccgaaauucagaccagcgggggcacaucuaucuucgccggacaucucaaaugucggcugaagauggacaaacuugagcugaagggcauguccuaugcuaugugccucaaugccuuugugcugaaaaaggaggucagcgaaacgcagcacgggaccauucugaucaagguggaguacaaaggagaagaugcgccuuguaagauccccuucuccacagaggacggccaagggaaagcucauaacggacgccuuauuaccgccaacccuaucguuacaaagaaagaggaacccgugaauauugaggccgaacccccuuucggcgagucuaacaucgucauugggaucggcgauaaggcucucaagaucaauugguacaaaaagggaagcuccauuggcaaaauguuugaagccaccgcuagaggggcccggagaauggcgauccugggagacacggccugggauuucggcagcgucgggggagugcugaacucucucggcaagaugguucaccagauuuuuggguccgcuuauacagcccuguucagcggcgucucuuggaucaugaaaauuggaaucggcgugcuucugaccuggauugggcucaauagcaagaacaccuccaugucuuuuagcugcaucgugaucggaauuaucacacuguaccugggcgcugucgugcaggccgacaugggguguguuauuaauuggaagggaaaagagcuuaagugcggcuccgggaucuucgugaccaacgagguccauacauggacggaacaguauaaauuucaagcggauagcccgaagcgccucgccaccgcuauugccggcgcuugggagaauggaguguguggcauccggucuacaaccagaauggaaaaccugcuguggaaacagaucgccaaugagcucaacuacauucugugggaaaauaacaucaaacuuacaauuguugugggggacgucaucggagugcuggagcagggcaaacgcacccucacgccccagccuauggagcugaaguauuccuggaagaccugggggaaagccaagauuguuacagcugaaacccaaaauagcucuuucaucaucgauggacccaacacaccugagugccccuccgcgcugcgggccuggaacgugugggaagucgaggacuacggcuuuggcguguucaccacaaauauuuggcuuaaacucagagaaaaguauacccagcugugugaccaccgccugaugagcgcugccgugaaagaugagcgggccguccacgcugacaugggguacuggaucgagucccagaagaacgaaucuuggaagcucgagaaagccagccugauugaaguuaagacgugcacauggccgaaaucccauacccuuuggucuaauggagugcuggagagcgauaugaucauuccuaagucccucgcgggccccaucagccagcacaacuacagaccuggguaucauacccaaacagcuggacccuggcaccugggcaaacuggagcuugacuuuaauuacugcgaagggaccacgguggucaucacagagaacuguggcauucgcggcccuucucuccggaccacaaccguguccggcaagcugauccacgaauggugcuguagaagcugcacacugcccccgcuccgcuauaugggggaggauggauguugguacggcauggaaauucggccuaucaaugagaaggaggaaaacaugguuaaaucucugguguccgccgggagcggaaagaccgacaauuucacgaugggcguccuuugccuggccauucucuuugaggaagugaugagagggaaauucggaaagaaacauaugaucgcuggcgcccuguucauguuuguucugcuucugucuggccagauuaccuggcgggauauggugcacacacucaucaugaucgggagcaacgcguccgaccgcaugggaaugggcgucaccuaucuggcucucauugccacauucaagauccagcccuuucuggcccuuggguucuuucugagaaagcucaccagccgggagaaucugcugcuuggagugggccuggcuauggccacgacacuccaacugcccgaagauauugagcagauggcuaacgggaucgcccucggacugauggcgcuuaaacugauuacccaguucgagacauaccagcucuggaccgcccugaucucucugauguguuccaauaccaucuuuacacuuacgguugcuuggagaaccgccacacugauucucgcugugaucagccugcucccugucugccaauccucuagcaugcgcaagaccgacuggcugccgaugacaguggccgccaugggcgugcccccucuuccccuguucauuuuuagccugaaagauacccucaagcggagaucuuggccucugaacgaaggcgucauggcuguugggcuugugagcauccuggcguccucuuuccuccgcaaugacgugcccauggccggaccucuggucgcuggcgggcuccugauugccuguuaugugaucacgggaacaagcgccgaucuuaccguugagaaagcugccgacgugaccugggaagaggaagcggagcagacaggcgucucccauaaccugaugaucaccguggacgaugacgggacaaugagaauuaaggaugacgagacggaaaacauccugaccguucuccugaaaacagcccuucugauugugagcggaaucuuucccuacucuauuccggccacccuccuggucuggcacacauggcagaagcagacccaacgguccggcgugcucugggaugucccuucucccccugagacgcagaaggccgaacuggaggagggcguguaccgcaucaaacagcaggggauuuucggaaagacccaaguuggcguggggguccagaaagaaggaguguuucauacaauguggcacguuaccagaggcgcugugcuuacacacaaugggaagcggcuggagcccaacugggccaaugucaaaaaggaccugaucuccuauggaggcggcuggaagcucuccgcgcaguggcaaaaaggggaagagguccaggugaucgcuguugaaccgggaaagaacccuaaaaauuuccagaccaugcccggcauuuuccagacaacgaccggggagaucggagccauugcccuggauuuuaagccuggcacaagcgggucucccaucauuaaccgcgagggaaaagucgugggccuuuacggcaaugggguggucaccaagaacggaggcuauguguccgggaucgcucaaaccaaugccgaacccgacggaccuacaccggagcuggaagaggaaauguucaagaaaagaaaccucacgaucauggaucugcaucccggcagcgggaagacccggaaauaccucccugcuauuguucgcgaggccaucaagagacggcugcgcacacuuauucuggcgcccaccagaguggucgccgcugagauggaagaggcccugaaaggccucccuauccgguaucagacaaccgcuacgaaguccgaacacacaggaagagagauuguggaccugaugugccaugccaccuuuaccaugcgccuucugagccccguucgggugccuaauuacaaccucaucgucauggaugaagcccacuucacagacccggcuucuaucgcggccagaggcuauauuagcacccgcguggggaugggagaggcugccgccaucuuuaugacagcuacacccccuggcacggccgaugcguucccccaguccaaugcuccuauucaggacgaggaacgggacauccccgagagaucuuggaacagcgggaaugaauggauuacagauuuugccggaaagaccguuugguucgugccguccaucaaagccggcaacgacauugcuaacugucugcgcaagaaugggaaaaaggucauccaacugucucggaaaacauuugauaccgaguaccagaagacgaagcucaacgacugggauuucguggugaccacagacaucagcgagaugggcgccaauuuuaaagcggauagagucauugacccucgccggugccuuaagcccguuauccugaccgauggacccgaaagagugauucuggccggcccuaugcccgugacagucgcuuccgccgcucagcggcgcgggagagugggacggaacucucagaaagagaaugaccaauacaucuucaccggccagccucucaacaaugaugaagaccaugcccacuggacagaggcuaagaugcugcuugacaacauuaauaccccggaagggaucauccccgcccuguucgagccugagcgcgaaaagagcgcggccauugauggagaguauagacucaagggcgagucccggaaaacguuuguugagcugaugagacgcggggaccugcccguguggcucgcucacaaggucgccagcgaaggcaucaaguacacagaucggaaauggugcuucgacggagagagaaacaaucagauucuugaggaaaacauggauguggagaucuggaccaaggaaggcgagaaaaagaaacugcgcccucgguggcuggacgcuagaaccuauucugauccccucgcccugaaggaauuuaaggacuucgccgcugggcgcaaauccauugcgcuugaucugguuacagagaucggacgggugccgagccaucucgcccacagaacccgcaaugcucuggacaaccuggucaugcuccauacaucugagcacggcgggagagccuaccggcacgccguggaagaacuuccugaaacgauggagacccugcugcuccugggacuuaugauccugcucacaggcggcgcuaugcuguuucugauuuccgggaagggaaucggcaaaaccagcauugggcucaucugugucguggccuccucuggaaugcuuuggauggcggauguuccccugcaguggauugccagcgcuaucgugcuggaguucuuuaugauggugcuccugauuccugaacccgagaagcaacgcacaccucaggacaaucagcuugccuaugucguuaucggcauccugacccucgcugccauuguggcggccaacgaaauggggcugcuggagacgaccaaaagagaucucggaauguccaaggaacccggcguggucagcccgacaucuuaccuugacguggaccugcauccugcuuccgccuggacccuguaugcuguugccacaaccgugaucacgcccaugcuccggcacacaauugagaauagcaccgcuaacgucucucuggccgcgaucgccaaccaagcugugguccuuaugggccuggauaagggguggcccauuagcaaaauggaccucggagugccucugcuggcccucggcugcuacucccagguuaauccgcuuacacugaccgcugccgugcugcuccuggucacccauuacgccaucaucgggcccggacuucaggcgaaggcuacacgcgaggcccagaaaagaacggcugccggcauuaugaagaacccuaccguggaugggaucaugacaauugaccuggaucccguuaucuaugacucuaaauucgaaaagcaacucggacaggugaugcugcugguccucugugccgugcagcuucugcugaugcggaccagcugggcuuuuugcgaggcccucacacuggcgaccggcccuauuacgacacuuugggaaggcucccccgggaaguucuggaauaccaccaucgccgugucuauggcuaacaucuuuagaggaagcuaccuggccggcgcugggcucgccuucuccauuaugaaaagcguuggaacaggcaagcgcgggaccggaucucagggcgagacacugggcgaaaaauggaagaaaaagcugaaucaacucucccggaaagaguuugaucuuuauaaaaagagcgggaucacggaggucgacagaaccgaagcgaaagagggacugaagcgcggcgaaauuacacaccaugccgugucccgggggucugcuaaacugcagugguucguggagagaaacauggucaucccugaaggacggguuauugaucucggcugugggcgcggaggcuggagcuacuauuccgccggccugaagaaagugaccgaggugagaggguacacaaagggaggcccggggcacgaggaacccgucccuaugucuaccuauggauggaauaucgugaaacuuaugagcggcaaagacguuuucuaccugcccccugagaagugcgauacgcuccugugugacauuggggaauccagccccucuccgaccguggaggagucccggacaauccgcguccugaaaaugguggaaccuuggcucaagaacaaucaguuuugcaucaaaguucuuaaccccuacaugcccaccgugauugagcaccuggaaagacugcagcggaagcauggaggcaugcucguccgcaauccucugagcagaaacucuacacacgagauguauuggaucuccaauggcaccgggaacauugugagcucugugaauauggucagccggcuucugcucaaccgcuucacaaugacccauagacggcccacgaucgaaaaggauguugaccugggagcuggcacaagacacgugaacgccgagccugagaccccgaauauggacgugauuggggaacgcauccggagaaucaaagaggaacacuccucuaccuggcauuacgaugacgagaaccccuauaagacaugggcuuaccacggaagcuaugaagucaaagccacgggcuccgcgagcuccaugauuaauggggugguuaagcugcucaccaaaccuugggaugugguccccauggugacacaaauggccaugaccgacacaaccccuuuuggacagcagcgcguuuucaaggagaagguggauacacggacccccagaccgaugccuggcacgcgcaaagucauggagaucaccgcugaauggcuguggcggacacuuggcagaaacaagcgcccccggcuguguaccagagaggaauuuauuaaaaaggugcgcacaaaugccgcuaugggggccguuuucaccgaggaaaaccaaugggacucugcccgggcggcuguggaggaugaggaauuuuggaaacucgucgacagagagcgcgaacugcauaaacuuggaaaaugcggcagcuguguguacaauaugauggggaagagagagaagaaacugggagaguucggcaaggccaaagggucccgggccaucugguauauguggcucggcgcucgcuaccuggaauuugaggcccugggauuccucaacgaagaucacugguuuucuagagagaauagccauuccggcgucgaaggggagggacugcacaaacuuggcuacauucugcgggacaucucuaaaaucccugggggagcuauguaugccgaugacacggcgggcugggacacaagaauuaccgaggaugaccuccacaacgaagagaagaucacacagcagauggaucccgaacaucggcagcuggccaaugcuauuuucaaacuuaccuaccaaaacaaagugguuaaggugcagcgcccuacgcccaaagggaccgucauggacaucauuagcagaaaggaucagcggggcuccggacaggugggcacauaugggcugaauaccuuuacaaacauggaggcccaacucauccgccagauggaaggagagggcgugcugagcaaagcugaccuggagaauccgcaccuccuggaaaagaagguuacccaguggcuugagacaaaagggguggaaagacugaagcggauggccaucucuggagaugacugcgucgugaaaccuauugaugaccgcuucgcgaacgcccuccuggcucuuaacgauaugggcaagguuagaaaagacaucccccaguggcaacccuccaagggguggcaugauuggcaacaggugccuuucugcagccaccacuuucaugagcugauuaugaaggacggccggaaacucgucgugccgugucgcccccaggacgaacugaucggacgggcucggauuucucaaggcgcuggguggucccugcgcgagaccgccugccucggaaaggcuuacgcccagaugugggcgcugauguauuuccacagacgggaucuucgccuggccagcaaugcuaucuguucugccgucccugugcauuggguucccacguccagaacaaccuggagcauucacgcccaucaccaguggaugaccacagaggacaugcucaccguguggaaccgggucuggaucgaagauaauccuuggauggaggacaaaacacccgugacgaccugggaagauguuccuuaccugggcaagagagaggaccaauggugcgggucccuuaucggacugacaagccgcgcuaccugggcccagaacauucucacagcgauccaacaggugcggucucugauuggcaaugaggaauuucuggauuauaugcccagcaugaaaagauuccgcaaggaggaagaguccgaaggggcuaucugguga

SEQ ID NO: 20906 - RNA, 9873 nt, Artificial Sequence
  derived and/or modified CDS sequence (opt5) from DENV-3__KU216208__SS-prME
accagccugugccucaugaugauccugcccgccgcucuugccuuccaccugacgucccgggacggagaaccucggaugauuguggggaagaacgaacgcggaaagucucuccuguuuaagacggcgagcggcaucaauauguguacccuuauugcuauggaucugggggagaugugcgacgauacagucaccuacaaauguccgcacaucacagaaguugagcccgaagacauugauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggauugauguggugcuggagcacggcgggugcgucaccacaauggccaagaauaaacccacgcuggacaucgagcuccagaagaccgaagcuacacaacuggccacccuucgcaaacuguguauugagggaaagaucacaaacauuaccacggauuccagaugcccuacacagggcgaagcgguucucccggaggaacaggaccagaauuauguguguaaacacgccuacguggaucggggcugggggaacggaugcggccuguucgggaagggaagccuugugacaugcgcuaaguuucaaugucuggagcccaucgagggcaaagugguucaguaugaaaaucucaaguacaccgugaucauuacaguccauaccggggaccagcaccaggugggaaacgagacacaaggcguuacggccgaaaucaccccucaggcuucuacaaccgaggccauucugcccgaauauggcacacuggggcucgagugcuccccucgcaccggacuggacuucaaugagaugauccuucugacgaugaaaaacaaggccuggauggugcauagacagugguuuuucgaucucccccugccguggaccagcggcgcuacaaccgaaacaccuaccuggaaucggaaagagcuucuggucacguuuaagaacgcgcacgccaaaaagcaagaaguggucgugcucgggucucaggagggagcuaugcacacagcccugaccggcgccacagaaauucaaaauuccgggggcaccagcaucuucgcuggacaucugaagugucgccucaaaauggacaagcuggagcuuaaaggcaugucuuacgccaugugcaccaacacauuuguucugaagaaagagguguccgaaacgcagcacgggaccauccucauuaaggucgaguacaagggagaagaugcgcccuguaaaaucccuuucagcacagaggacggccaagggaaggcucauaacggaagacugauuaccgccaaucccgugguuaccaagaaggaggaacccgugaacaucgaggccgaaccuccguucggcgaguccaauauugucaucgggaucggcgauaacgcucugaaaauuaauugguauaagaagggaucuagcaucggcaaaauguuugaagccaccgcuagaggggccagacgcauggcgauucuuggagacacggccugggauuucggcuccgucgggggagugcucaacagccugggcaagaugguucaccagaucuuugggucugcuuacacagcccuguucuccggcgucagcugggugaugaaaauuggaaucggcgugcuccugaccuggauugggcuuaauucuaagaacaccagcauguccuuuucuugcaucgcuaucggaauuaucacacuguaucucggcgccgucgugcaggcggacaugggguguguugugaauuggaaaggaaaggagcugaagugcggcagcgggauuuucgucaccaacgaggugcauacauggacggaacaguacaaauuucaagccgauucccccaagcggcuggcuaccgccaucgcuggcgccugggagaauggaguuuguggcauuagaagcacaacccgcauggaaaaccuucucuggaaacagaucgccaaugagcugaacuauauccugugggaaaauaacauuaagcucacaguggucgugggggacaccaucggaguucuggagcagggcaaacggacgcuuaccccucagcccauggagcugaaguacucuuggaaaacaugggggaaggcuaagauugugaccgcggaaacacaaaacuccagcuucaucauugauggaccuaauacccccgagugcccgucugccuccagagcuuggaacgucugggaaguggaggacuauggcuuuggcguguucacaaccaauaucuggcucaaacugcgcgaagucuacacgcagaugugugaccaccggcugaugagcgccgccguuaaggaugagagagcugugcacgccgacaugggguacuggaucgagucccagaaaaacggaucuuggaaacuugaaaaagcgagccucauugaggugaagacaugcaccuggccuaagucccauacccuguggucuaauggcguccuggaaagcgauaugaucauucccaaaucccucgcugggccuaucagccagcacaacuaucgccccggauaccauacacaaaccgccggcccuuggcaccuggggaaacuugagcuggacuuuaauuauugcgagggaacgacagugguuauuaccgaaaacuguggcacacggggccccucucucagaaccacaaccguguccgggaaacugauccacgaguggugcugucgcagcugcacgcugccgccucuucgguacaugggagaagauggcuguugguaugggauggagaucagacccauuucugaaaaggaggagaauauggucaaaucccucgugagcgccggaucuggcaagguugacaacuucaccaugggggugcugugccuggcuauccucuuugaagaggucaugcggggaaaguucggcaaaaagcauaugauugccggcguguucuuuacauucguucugcuucugagcgggcagaucaccuggcgcgauauggcgcacacacucauuaugaucggauccaaugcuagcgacagaaugggcaugggggugaccuaccuggcccugauugccacguuuaaaauccagcccuuccuugcucugggauuuuuccuccggaagcugacaucuagagaaaaccuccugcuuggcgucgggcuggccauggcuaccacacuccaacugccugaggauaucgaacagauggccaauggaauugcgcugggccuuauggcccugaaacucaucacccaguuugagaccuaucagcuguggacagcucucauuucccugacguguagcaacaccaucuucacacuuaccguggccuggcgcacagcuacccugauucucgccggcgugucccugcugccggucugccaaucuagcuccaugcggaagacggacuggcuucccaugacaguugccgcuaugggggugccuccccugccucucuuuaucuucucucugaaggauacccucaaaagacgcagcuggccccugaaugagggagugauggcggucggccuuguguccauccuggccucuagccugcucagaaacgacguuccuauggcugggccccugguggccggaggccuucugauugccuguuacgucaucaccgggacauccgcugaucucaccguggaaaaggccgcggacguuacaugggaggaagaggcugaacagacgggagugagccauaaccugaugauuaccgucgacgaugacggcacaaugcggaucaaagaugacgagaccgagaauauucucacagugcugcuuaagaccgcccugcugaucgucucuggcaucuuuccguacuccauuccugccacgcuccugguguggcacaccuggcagaaacagacacaacgcagcgggguucuuugggaugugcccucuccucccgaaacccagaaggcugagcuggaagagggagucuauagaaucaaacagcagggcauucucgggaagacacaagugggaguuggcgugcagaaggagggggucuuccauaccauguggcacgugacacggggagccgugcugacgcacaacggcaaacgccucgaaccgaauugggcguccguuaagaaagaccugaucagcuacggcgggggauggagacuuucugcucaguggcaaaagggcgaggaaguccaggugauugccguggagccugggaaaaaccccaagaauuuucagaccaugccuggaacauuccagaccaccacaggcgaaaucggggccauugcucuggauuucaagcccggaacguccggcagccccaucaucaaccgggagggcaaagucguggggcuguauggaaauggcguugugaccaagaacgggggauacgucuccggcauugcccaaacaaaugcugagccugacgggccgacccccgaacucgaggaagagauguuuaaaaagcgcaaccugacaaucauggaucuucauccuggcagcggaaaaaccagaaaguaucugcccgccauugugcgggaagcgaucaagcgcagacuccggacgcugauucucgccccuacaagaguuguggcugccgagauggaggaagcucugaaaggccuucccauccgcuaccagaccaccgccacaaagucugagcacaccgggcgggaaaucgucgaccugaugugccaugccacauucaccaugagacugcucagcccugugcgcguuccgaauuauaaccugauuaucauggaugaggcucacuuuacggaccccgcguccauugccgcucggggauacaucucuacaagagugggcaugggggaagccgccgcuauuuucaugaccgccacaccucccggaaccgcggaugcuuuuccucagagcaaugcccccauccaggacgaggagcgcgacaucccggaacgguccuggaacucuggcaaugaguggauuacggauuucgccgggaaaaccgucugguuugugccuagcaucaaggcuggcaacgacauugccaacugucuuagaaagaauggaaagaaggugauccaacugucccgcaaaacauucgaaaccgaguaccagaagacaaaacucaacgauugggacuuugucguuaccacagauauuucugagaugggcgcgaauuucaaggccgaccgggugaucgaucccagacggugccugaaacccgugauucugaccgacgggccugaacgcgucauccucgcuggacccaugccugugacggccgcuagcgccgcucagagacggggccgcguugggagaaacccgcagaaggagaaugaucaauauaucuuuacaggacagccccuuaacaaugacgaagaucaugcccacuggaccgaggcgaagaugcugcuggacaacauuaauaccccugaaggcaucauucccgcccucuucgagccugagcgggaaaaauccgcugccaucgacggggaguacagacugaagggcgaaagccgcaaaacauucguggagcuuaugcggagaggagaucugcccgucuggcucgcuuauaagguggccucugaaggcauuaaauacaccgaccgcaaguggugcuuugaugggcagcggaacaaucagauccuggaggagaacauggacguugaaaucuggacaaaagagggagaaaagaagaaacugagaccgcgcuggcucgaugcccggacguauuccgacccucuugcucugaaggaguucaaagauuuugcggccggcagaaagagcauugcucuggaccucgugaccgaaaucgggcgcguccccucucaccuggcccauagaacacggaaugcccuugauaaccuggugaugcuccacaccuccgagcauggaggccgcgcuuacagacacgccgucgaggaacugccugagacaauggaaacccugcuccuucugggccugaugauucuccugacagggggagcgaugcuuuuccugaucagcggcaaagggauuggaaagaccuccaucggccucaucugugugauugccucuagcgggaugcuguggauggcugagaucccccugcaauggauugccuccgcuaucguucucgaguuuuucaugauggugcuucugauuccugaacccgagaagcagcggacaccgcaggacaaucaacuggccuauguggucaucggcauucucacccuggcggccaucaucgcugccaacgaaaugggccuucuggagacaaccaaacgcgaucucggcaugagcaaggaaccugggguugugucucccacguccuaccuggacguggaucugcaccccgcuagcgccuggacacucuacgcugucgccaccacagugauuaccccuaugcuuagacauaccaucgaaaauucuacagcgaacguuagccuggccgcuauugccaaccaggcugugguccugaugggacucgacaaaggcuggccgaucuccaagauggaccugggggugccccuucuggcccucggaugcuauucucaggucaauccucugacgcugaccgccgcggugcuccuucugauuacacacuacgcuaucaucggccccgggcugcaggccaaagcuacccgggaggcccaaaagagaacagccgcuggaauuaugaagaacccuaccguugauggcaucauuacgaucgaccucgaucccgugauuuaugacagcaaauuugagaagcagcugggccaggucaugcuucuggugcucugugccguucagcugcugcucaugcgcacauccugggcgcuuugcgaggcccugacccuggcuaccgggccuaucacaacccucugggaaggaucuccgggcaaauucuggaauacaacgaucgccgugagcauggcuaacauuuuucggggguccuaccuggccggagcgggccuugccuucagcaucaugaagucugucgggaccggaaaaagaggcacaggcucccaaggggagacccugggagaaaaguggaagaaaaagcucaaucagcugagccgcaaagaguuugaucuguauaagaaauccggcauuacagagguggaccggaccgaagcuaaggaggggcucaaaagaggagaaacgacccaucacgccgugucucggggcagcgcuaaacuucagugguucguugagcgcaacauggucauccccgaagggagagugauugaucugggauguggccggggcgggugguccuacuauugcgccggacugaagaaagugacagagguccgcggcuacaccaaagggggaccuggccaugaggaacccguuccuauggcuacauacggguggaauaucgugaaacucaugucuggaaaggacguguuuuaucugcccccggagaaaugugauacccuucugugcgacauuggcgaaagcuccccuagccccacagucgaggagucuagaaccauccgggugcucaagaugguugaacccuggcugaagaacaaucaguucuguaucaaagugcugaacccuuacaugcccgccgucauugagcaccucgaacgccuucaaagaaagcacggcgggaugcuggugcggaauccucugucccgcaacagcacgcaugagauguauuggaucucuaauggaacaggcaacauuguuuccagcgugaauauggucucuagacuccugcuuaaccgguucaccaugacccacagacgcccgacaaucgaaaaagauguggaccugggggcgggaacgcggcaugugaacgccgagcccgagaccccuaauauggaugucauuggcgaaagaaucaagcgcaucaaagaggaacacaacagcacauggcacuacgacgacgagaaucccuauaagaccugggcuuaccauggguccuaugaaguuaaggccacaggaucugcuagcuccaugauuaacggcguggugaaacuccugaccaagccuugggaugucgugcccaugguuacacagauggccaugaccgacacgaccccguuuggccagcaacggguguucaaagagaaggucgauacaagaaccccucgccccaugccugggacacggaaagugauggagaucaccgccgaauggcuguggagaacgcucggacgcaauaagcggcccagacugugcacacgcgaggaauuuaccaagaaaguucggacaaacgcggcuaugggcgccguguucaccgaggaaaaucagugggacagcgccaaggcugccgucgaggaugaggaauuuuggaaacuuguggacagagagcgcgaacugcacaagcucgggaaauguggauccugcguuuacaacaugaugggcaagagagagaaaaagcugggggaguucggcaaggcuaaaggaucucgggccauuugguacauguggcuuggcgcgcgcuaucuggaauuugaggcccucggguuccugaaugaagaucauugguuuagcagagagaacuccuacucuggaguggaaggcgaggggcugcacaagcucggauauauccugcgggacauuagcaaaaucccuggcggggcuauguacgccgaugacacggcuggcugggauaccagaaucacagaggacgaccuucauaaugaagagaagauuacccagcagauggaucccgaacaccggcugcucgccaacgcgaucuucaaacugacauaucaaaauaaggucgugaagguccagcgcccgaccccuacaggaaccgugauggacauuaucuccagaaaagaucagcggggcucugggcagguuggaacguacggccuuaacacauuuaccaauauggaggcccaacuggugcgccagauggaaggggagggaguccucagcaaggcugaccuggagaacccccaucugcccgagaagaagauuacccaguggcucgagacaaaaggcguggaaagacugaagcggauggccaucuccggggaugacugcgugguuaagccuaucgaugaccgcuucgcuaacgcccuucuggcucucaaugauaugggcaaagugagaaaggacauuccgcaguggcaacccagcaaaggauggcaugauuggcagcaggucccuuuuuguucucaccauuuccacgagcugaucaugaaggacggccggaaacuugugguucccugccgcccucaggaugaacugauugggagagcccggaucucccaaggagcgggcuggagccuccgcgagaccgccugucuggggaaggcuuaugcccagauguggucucugauguacuuccacagacgggaccuccgccuggccuccaacgcuauuugcagcgccgugcccguccauugggugccuacaucuagaacgaccugguccauccacgcgcaucaccaguggaugacaaccgaggacaugcuuacagucuggaaucggguguggauugaagauaaccccuggauggaggacaagaccccgguuacgaccugggaaaaugugccuuaccugggaaaaagagaggaucaaugguguggcagccucaucgggcugacaucccgcgcuaccugggcccagaacauccccacagccauucagcagguccggagccuuaucggcaaugaggaauuucuggacuauaugccuucuaugaagagauuccgcaaagaggaagagagcgaaggagcuauuugguga

SEQ ID NO: 20907 - RNA, 9873 nt, Artificial Sequence
  derived and/or modified CDS sequence (opt5) from DENV-3__GU370053__SS-prME
acaagccugugccucaugaugauccugcccgccgcucuugccuuccaccugacaucccgggacggagaaccucggaugauuguggggaagaacgaacgcggaaaaucucuccuguuuaagacggcgagcggcaucaauauguguacccuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucauguggggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccgugggccagcggcgcuacaaccgaaacaccuaccuggaaucggaaagagcuucuggugacguuuaagaacgcgcacgccaaaaagcaagaagucgugguucucgggucucaggagggagcuaugcacacagcccugaccggcgccacagaaauccaaaauuccgggggcaccagcauuuucgcuggacaucugaagugucgccucaaaauggacaagcuggagcuuaaaggcaugucuuacgccaugugcaccaacacauuugugcugaagaaagaggucuccgaaacgcagcacgggaccauccucaucaagguggaguacaagggagaagaugcgcccuguaaaauuccuuucagcacagaggacggccaagggaaggcucauaacggaagacugaucaccgccaaucccguugugaccaagaaggaggaacccgucaacauugaggccgaaccuccguucggcgaguccaauaucgugauugggaucggcgauaacgcucugaaaaucaauugguauaagaagggaucuagcauuggcaaaauguuugaagccaccgcuagaggggccagacgcauggcgauccuuggagacacggccugggauuucggcuccgucgggggaguucucaacagccugggcaagaugguccaccagauuuuugggucugcuuacacagcccuguucuccggcgugagcugggugaugaaaaucggaauuggcguccuccugaccuggaucgggcuuaauucuaagaacaccagcauguccuuuucuugcauugcuaucggaaucauuacacuguaucucggcgccgugguucaggcggacauggggugugugaucaauuggaaaggaaaggagcugaagugcggcagcgggauuuucgucaccaacgaggugcauacauggacggaacaguacaaauuucaagccgauucccccaagcggcuggcuaccgccaucgcuggcgccugggagaauggaguuuguggcauuagaagcacaacccgcauggaaaaccuucucuggaaacagaucgccaaugagcugaacuauauccugugggaaaauaacauuaagcucacaguggucgugggggacaccaucggaguucuggagcagggcaaacggacgcuuaccccucagcccauggagcugaaguacucuuggaaaacaugggggaaggcuaagauugugaccgcggaaauccaaaacuccagcuucauuaucgauggaccuaauacacccgagugcccgucugccuccagagcuuggaacgucugggaaguggaggacuauggcuuuggcguguucaccacaaauaucuggcucaaacugcgcgaagucuacacccagcugugugaccaccggcuuaugagcgccgccguuaaggaugagagagcugugcacgccgacaugggguacuggauugagucccagaaaaacggaucuuggaagcucgaaaaagcgagccugaucgaggugaagacgugcacauggccuaagucccauacccuguggucuaauggcguccucgaaagcgauaugauuauccccaaaucccuggcugggccuauuagccagcacaacuaucgccccggauaccauacccaaacagccggcccuuggcaccuugggaagcuggagcucgacuuuaauuauugcgagggaaccacggugguuaucacagaaucuuguggcacccggggccccucccugagaacaaccacagugagcgggaaacugauccacgaguggugcugucgcucuugcacccuuccgccucuccgguacaugggagaagauggcuguugguaugggauggagauuagacccaucuccgaaaaggaggagaacauggucaaaagccuggugucugccggaagcggcaagguugacaauuucacgaugggggugcugugccucgcuauucuguacgaagaggucaugcggggaaaguuuggcaaaaagcauaugaucgccggcguguucuucaccuuuguucuucugcucuccgggcagauuacauggcgcgauauggcgcacacccugaucaugauuggaagcaacgcuucugacagaaugggcaugggggugacauaucuggcccuuaucgccaccuucaaaauccagcccuuucuggcucucggauucuuucugcggaagcucacguccagagaaaaucugcuucugggcgucgggcucgccauggcuacaacccugcaacugccugaggauauugaacagauggccaacggaaucgcgcuuggccugauggcccucaaacugauuacacaguucgagaccuaccagcucuggaccgcucuggugagccuuacauguuccaauacgaucuuuacccugacaguggccuggcgcaccgcuacacucauucuggccggcgucucucugcuuccgguuugccaaagcuccucuaugcggaagaccgacuggcugcccauggccguggcugcgaugggggugccuccccucccucuguucaucuuuagccucaaggauacgcugaaaagacgcuccuggccccuuaacgagggagucauggccgugggccugguuucuauccuggcuagcucccuccugagaaaugacgugccuauggccgggccccuugucgccggaggccugcucauugcuuguuacgugaucacagggaccagcgccgaucugaccguugaaaaggcggcugacgugacaugggaggaagaggccgaacagaccggagucucucauaaccucaugauuacaguggacgaugacggcacgaugcggaucaaagaugacgagaccgagaacauucugacaguccuucugaagaccgcccugcucaucguguccggcaucuucccguauagcauuccugcuacacugcuuguuuggcacaccuggcagaaacagacgcaacgcucuggggugcugugggauguccccuccccucccgaaacccagaaggccgagcucgaagagggaguguacagaaucaaacagcagggcauuuuugggaagacacaaguuggagugggcguccagaaggaggggguguuccauaccauguggcacgugacacggggagcgguucugacccacaauggcaaacgccucgaaccgaacugggcuagcgucaagaaagaccugaucucuuauggcgggggauggagacuuuccgcccaguggcaaaagggcgaggaaguccaggugauugccgucgagccugggaaaaaucccaagaacuuucagacaaugccuggaacguuccagaccacaaccggcgaaaucggggcuauugcccuggauuucaagcccggaaccagcggcucccccaucaucaaucgggagggcaaagugguugggcuguacggaaacggcguggucacaaagaaugggggauaugugagcggcauugcucaaacgaacgccgagccugacgggccgacccccgaacucgaggaagagauguuuaaaaagcgcaaucugacaaucauggaucuucauccuggcucuggaaaaaccagaaaguaccugcccgcgauuguucgggaagccaucaagcgcagacuccggacacugauucucgcuccuaccagaguggucgccgcugagauggaggaagcccugaaaggccuucccauccgcuaucagacgacagccaccaagagcgagcacaccgggcgggaaaucguggaccugaugugccaugcuacauucaccaugagacugcucuccccuguucgcgugccgaacuacaaucugauugucauggaugaggcgcacuuuacagaccccgccucuaucgcugcccggggauacauuagcaccagagugggcaugggggaagccgcugccaucuucaugacggcgacaccucccggaaccgcugaugccuuuccucaguccaacgcccccauucaggacgaggagcgcgacaucccggaacggucuuggaauagcggcaacgaguggaucacagauuucgcugggaaaaccgugugguuugucccuuccauuaaggccggcaaugacaucgcgaacugucuucgcaaaaacggaaagaagguuauucaacugucuagaaaaacguucgauaccgaauaucagaagacaaaacucaaugacugggauuuuguggugaccacagacaucagcgagaugggcgccaacuucaaggcugaucgggucauugaccccagacggugccugaaacccgugauccugaccgaugggccugagcgcguuauucucgccggacccaugccugugacagcugccuccgcugcccagagacggggccgcgucgggagaaauccgcagaaggaaaacgaccaauacaucuuuaccggacagccccuuaauaacgaugaggaccaugcgcacuggacggaagccaagaugcugcuggacaauaucaacacaccugagggcauuauccccgcucucuucgaaccugagcgggagaaaagcgccgcuauugauggggaauauagacugaagggcgagucucgcaaaaccuucguggaacuuaugcggagaggagaccugcccguuuggcucgcccacaagguggccuccgagggcaucaaauacaccgaucgcaaguggugcuuugacgggcagcggaauaaccagauucuggaagagaauauggaugucgagaucuggacaaaagaaggagagaagaagaaacugagaccgcgcuggcucgacgcucggaccuauagcgauccucuugcgcugaaggaguucaaagacuuugccgcuggcagaaagucuaucgcccuggaucucgugacagagauugggcgcguccccucccaucuggcccacagaacgcggaacgcucuugacaaucuggugaugcuccauaccagcgaacacggaggccgcgccuacagacacgcgguugaggagcugccugaaacaauggagacccugcuccuucugggccugaugauccuccugacagggggagccaugcuuuuccugauuuccggcaaagggaucggaaagaccucuauuggccucaucugugugaucgcuagcuccgggaugcuguggauggccgaagugccccugcaauggauugcuagcgccaucguccucgaguuuuucaugaugguucuucugauuccugagcccgaaaagcagcggacgccgcaggauaaccaacuggcguauguggugaucggcauucucacccuggccgcuaucauugccgcuaaugagaugggccuucuggaaacaaccaaacgcgaccucggcaugucuaaggagccuggggucgugucccccacaagcuaccuggauguugaccugcaucccgccucugcuuggacccucuacgccguggcgacgacagucaucaccccuaugcuuagacacacaaucgaaaacagcaccgccaaugugucccuggcugccauugcuaaccaggccgucgugcugaugggacucgacaaaggcuggccgaucucuaagauggaucuggggguuccccuucuggcccucggaugcuauagccaggugaacccucugacccugacagcggcuguccuccuucugauuacgcauuacgccaucauuggccccgggcugcaggcuaaagccacccgggaggcccaaaagagaacagcugccggaaucaugaagaauccuaccguggacggcaucaugacaauugaucucgaccccguuaucuaugauuccaaauuugagaagcagcugggccaggugaugcuucugguccucugugcggugcagcugcugcucaugcgcaccucuugggcccuuugcgaagcucugacgcuggccacagggccuauuaccacccucugggagggaagcccgggcaaauucuggaacacaaccaucgcuguguccauggccaauauuuuucgggggagcuaccuggcgggagccggccuugcuuucucuaucaugaaguccguugggacaggaaaaagaggcacgggcagccaaggggaaacccugggagagaaguggaagaaaaagcucaaccagcugucccgcaaagaauuugaccuguauaagaaaucuggcaucacagaggucgaucggaccgaggccaaggaagggcucaaaagaggagagacaacccaccaugcugugagccggggcuccgccaaacuucagugguucguggaacgcaauauggucguucccgaggggagagugauugaccugggauguggccggggcggguggucuuacuauugcgcuggacugaagaaagugacggaaguccgcggcuacaccaaagggggaccuggccacgaggagcccgugccuaugagcacauacggguggaacaucguuaaacucauguccggaaaggauguguuuuaucugcccccggaaaaaugugacacccuucugugcgauauuggcgagagcucuccuucccccacagucgaagagagcagaaccauccgggugcucaagaugguugagcccuggcugaagaauaaccaguucuguauuaaagugcugaauccuuacaugcccacagucaucgaacaccucgagcgccuucaaagaaagcauggcgggaugcuggugcggaacccucugucucgcaauuccacccacgaaauguauuggauuagcaacggaacgggcaauaucgugucuagcgucaacaugguuuccagacuccugcuuaaucgguucacaaugacccauagacgcccgaccaucgagaaagacguggaucugggggccggaacacggcacgugaacgcggaacccgagacgccuaacauggacgucauuggcgagagaaucaagcgcauuaaagaagaacacaauucuaccuggcauuacgacgaugaaaaccccuauaagacaugggccuaccacgggagcuaugaggugaaggcuaccggauccgccagcuccaugaucaauggcguugugaaacuccugacaaagccuugggacgucgugcccaugguuacccagauggcuaugacagauaccacgccguuuggccagcaacggguguucaaagaaaaggucgacaccagaacaccucgccccaugccugggacccggaaagugauggagauuacagccgaguggcuguggagaacccucggacgcaacaagcggcccagacugugcacgcgcgaagaguuuacaaagaaaguucggaccaaugccgcgaugggcgcuguguucacagaagagaaccagugggauucugccaaggccgcugucgaagacgaggaguuuuggaaacuuguggauagagaacgcgagcugcauaagcucgggaaauguggaagcugcgucuacaauaugaugggcaagagagagaagaagcugggggaguucggcaaggccaaaggaucccgggcuaucugguacauguggcuuggcgcccgcuaucuggaguuugaagcgcucggguuccugaacgaggaccacugguuuucuagagaaaauagcuacuccggaguggagggcgaagggcugcauaagcucggauauauccugcgggauauuucuaaaaucccuggcggggccauguacgcugacgauaccgccggcugggacacgagaauuaccgaggacgaucuucacaacgaggaaaagaucauucagcagauggaccccgagcaccggcaacuggcuaaugccaucuucaaacucacauaucagaacaagguugugaagguccagcgcccgaccccuacaggaaccgugauggauaucauuagcagaaaagaccagcggggcuccgggcaagugggaacauacggccugaauaccuuuacgaacauggaagcgcagcuuguucgccagauggagggggaaggagugcugacaaaggccgaucucgagaauccccaucugcccgagaaaaagaucacccaguggcuggaaaccaaaggcgucgagagacucaagcggauggcuauuagcggggacgauugcgugguuaagccuaucgacgaucgcuucgccaacgcucugcuugcccugaacgacaugggcaaagugagaaaggauauuccgcaauggcagcccucucggggauggcacgacuggcagcaggucccuuuuuguucccaucacuuccacgaacucaucaugaaagauggccgcaagcuggugguccccugcagaccucaagacgagcuuaucgggcgggcucgcauuagccagggagccggcuggucucugagagaaacagcgugucucgggaaagccuaugcucagauguggucccugauguacuuccaucggcgcgaccugagacucgccagcaaugccaucugcucugcugugcccguucacugggugccuaccucccggacaacguggagcauucaugcccaccaucaauggaugaccacagaggauaugcugaccgucuggaacagaguguggaucgaggaaaaucccuggauggaggacaagacaccgguuaccacgugggaaaacgugccuuaccuuggaaagcgcgaggaucagugguguggcucccugauugggcucaccagccgggcgacaugggcucagaauauccugaccgccauucagcaagucagaucucuuaucggcaacgaggaauuucuggacuauaugcccagcaugaaacgcuuccggaaggaggaagaguccgaaggagccaucugguga

SEQ ID NO: 20908 - RNA, 9873 nt, Artificial Sequence
  derived and/or modified CDS sequence (opt5) from DENV-3__JQ411814__SS-prME
accagccugugccucaugaugauccugcccgccgcucuugccuuccaccugacaucccgggacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggaauuggcaaccgggacuuuguggaagggcucagcggagcuaccugggucgauguggugcuggagcacggcgggugcgucaccacaauggccaagaauaaacccacgcuggacaucgagcuccagaagaccgaagcuacacagcuggccacccuucgcaaacuguguauugagggaaagaucacaaacauuaccacggauuccagaugcccuacacagggcgaagcgguucucccggaggaacaggaccagaauuauguguguaaacacaccuacguggaucggggcugggggaacggaugcggccuguucgggaagggaagccuugugaccugcgccaaguuucaaugucuggagcccaucgagggcaaagugguucaguaugaaaaucucaaguacacagugaucauuaccguccauacaggggaccagcaccaggugggaaacgagacgcaaggcguuaccgcugaaaucacaccucaggccucuaccacagaggcuauucugcccgaauauggcacccuggggcucgagugcuccccucgcacgggacuggacuucaaugagaugauccuucugaccaugaaaaacaaggccuggauggugcauagacagugguuuuucgaucucccccugccguggacaagcggcgccaccacagaaaccccuacguggaaucggaaagagcuucuggucacauuuaagaacgcucacgcgaaaaagcaagaaguggucgugcucgggucucaggagggagccaugcacaccgcucugacaggcgccaccgaaauucaaaauuccgggggcaccagcaucuucgccggacaucugaagugucgccucaaaauggacaagcuggagcuuaaaggcaugucuuacgcuaugugcacaaacacguuuguucugaagaaagagguguccgaaacccagcacgggacaauccucauuaaggucgaguacaagggagaagaugcccccuguaaaaucccuuucagcaccgaggacggccaagggaaggcgcauaacggaagacugauuacagcuaaucccgugguuaccaaaaaggaggaacccgugaacaucgaggccgaaccuccguucggcgaguccaauauugucaucgggaucggcgauaacgcccugaaaauuaauugguauaagaagggaucuagcaucggcaaaauguuugaagcuacggccagaggggcuagacgcauggccauucuuggagacacagcgugggauuucggcuccgucgggggagugcucaacagccugggcaagaugguucaccagaucuuugggucugccuacaccgcucuguucuccggcgucagcugggugaugaaaauuggaaucggcgugcuccugaccuggauugggcuuaauucuaagaacacaagcauguccuuuucuugcaucgccaucggaauuaucacccuguaucucggcgcugucgugcaggccgacaugggguguguuauuaauuggaaaggaaaggagcugaagugcggcagcgggaucuucgugacaaacgagguccauacguggaccgaacaguacaaauuucaagcggauucccccaagcggcuggccacagcuauugccggcgcuugggagaauggaguguguggcaucagaagcaccacacgcauggaaaaccuucucuggaaacagaucgccaaugagcugaacuauauucugugggaaaauaacaucaagcucaccguuguggucggggacacgauuggagugcuggagcagggcaaacggacccuuacaccucagcccauggagcugaaguacucuuggaaaaccugggggaaggccaagaucguuacagcugaaacccaaaacuccagcuucauuaucgauggaccuaauacacccgagugcccgucugcguccagagccuggaacgugugggaagucgaggacuauggcuuuggcguguucaccacgaauaucuggcucaaacugcgcgacguguacacacagcugugugaucaccggcuuaugagcgcugccgucaaggacgaaagagccguucacgcugauaugggguacuggauugagucccagaaaaacggaucuuggaagcucgagaaagccagccugaucgaagugaagaccugcaccuggccuaagucccauacacuguggucuaauggcgugcucgagagcgacaugauuauccccaaaucccuggcggggccuauuagccagcacaacuaucgccccggauaccauacccaaacggcuggcccuuggcaccuugggaagcuggaacucgauuuuaauuauugcgagggaacaaccgucgugaucacagagaacuguggcacccggggccccucucugagaacaaccacgguuuccgggaaacugauccacgaauggugcugucgcagcugcacccuuccgccucuccgguacaugggagaggacggcuguugguaugggauggaaauuagacccaucucugagaaggaagagaauauggugaaaucccuggucagcgccggaucuggcaagguggauaacuucacaauggggguucugugccucgccauucuguuugaggaagugaugcggggaaaguucggcaaaaagcauaugaucgcuggcguccuuuucaccuuugugcugcuccugagcgggcagauuacauggcgcgacauggcccacacccugaucaugauuggauccaaugcgagcgauagaaugggcauggggguuacguaccuugcucugaucgccacauucaaaauccagcccuuucucgcccugggauucuuucuccggaagcugaccucuagagagaaccuucugcucggcguggggcuggcuauggccacaacccugcaacuuccugaagacauugagcagauggcuaauggaaucgcccugggccucauggcgcugaaacucauuacccaguucgaaacauaucagcuguggacggcccuugucucccugaccuguagcaacacaauccucacccugacaguggcuuggcgcaccgccacgcugauucuugcuggcgugucccugcucccggucugccaaucuagcuccaugcggaagacagauuggcugcccaugaccguugccgccaugggggugccuccccucccucuguuuaucuucucucuuaaggacacccugaaaagacgcagcuggccccugaaugagggagugauggcugucggccucguguccauccuggcgucuagccuucugagaaacgauguuccuauggccgggccccucguggcuggaggccugcucauugccuguuacgucaucacagggaccuccgccgaccugacaguggagaaggcugccgacguuacgugggaagaggaagcggagcagaccggagugagccauaaccuuaugauuacagucgaugacgauggcaccaugcggaucaaagacgaugaaacagagaauauucugaccgugcugcucaagacggcucugcuuaucgucucuggcaucuuuccguacuccauuccugccacccugcucguguggcacacauggcagaaacagacccaacgcagcgggguucugugggacgugcccucuccucccgagacacagaaggccgaacucgaggaaggagucuauagaaucaaacagcagggcauucuggggaagacccaagugggaguuggcgugcagaaggagggggucuuccauacaauguggcacgugacgcggggagcugugcuuacccacaacggcaaacgccuggagccgaauugggccuccguuaagaaagaucugaucagcuacggcgggggauggagacucucugcgcaguggcaaaagggcgaagagguccaggugauugcuguggaaccugggaaaaaccccaagaauuuucagacaaugccuggaaccuuccagaccacaacgggcgagaucggggccauugcccuggacuuuaagcccggaaccuccggcagccccaucaucaaccgggaaggcaaagucguggggcuuuauggaaauggcguugugacaaagaacgggggauacgucuccggcauugcucaaaccaaugccgagccugaugggccgacacccgagcuggaagaggaaauguucaaaaagcgcaaccucaccaucauggaccugcauccuggcagcggaaaaacgagaaaguaucuccccgcuauugugcgggaggccaucaagcgcagacugcggacacuuauucuggcgccuaccagaguuguggccgcugaaauggaggaggcccugaaaggccuccccauccgcuaccagaccacagcuaccaagucugaacacacagggcgggagaucgucgaucugaugugccaugccaccuucacgaugagacuucugagcccugugcgcguuccgaauuauaaccucauuaucauggacgaagcccacuuuacagaucccgcuuccauugcggcccggggauacaucucuaccagagugggcaugggggaggcugccgccauuuucaugacagcuaccccucccggaacggccgacgcguuuccucagagcaaugcucccauccaggacgaggaacgcgauaucccggagcgguccuggaacucuggcaaugaauggauuaccgacuucgccgggaaaacagucugguuugugccuagcaucaaggccggcaacgauauugcuaacugucugcgcaaaaauggaaagaaggugauccaacuguccagaaaaaccuucgacacagaguaccagaagaccaaacucaacgauugggacuuugucguuacaaccgauauuucugaaaugggcgccaauuucaaggcggaccgggugaucgaucccagacggugccuuaaacccgugauucugacggacgggccugagcgcgucauccuggccggacccaugccugugacagcugccagcgcugcccagagacggggccgcguugggagaaacccgcagaaggagaaugaucaauauaucuuuaccggacagccccucaacaaugacgaagaccaugcucacuggaccgaggccaagaugcugcuugauaacauuaauacaccugaaggcaucauucccgcgcuguucgagccugaacgggagaaauccgccgcuaucgacggggaguacagacucaagggcgaaagccgcaaaaccuuuguggagcugaugcggagaggagaucugcccgucuggcucgcccacaagguggcuucugaaggcauuaaauauacagaccgcaaguggugcuucgaugggcagcggaacaaucagauccuugaggaaaacauggacguugagaucuggacgaaagagggagaaaagaagaaacugagaccgcgcuggcuggaugcccggaccuacuccgacccucucgcccugaaggaguucaaagauuuugcugcgggcagaaagagcauugcccuugaccuggugacagaaaucgggcgcguccccucucaucucgcucacagaacccggaaugcccuggauaaccuggugaugcuccauacauccgagcacggaggccgcgccuauagacacgcugucgaagaacuuccugagaccauggaaacgcugcugcuccugggccuuaugauucugcucaccgggggagccaugcuguuccugaucagcggcaaagggauuggaaagacauccaucggccucaucugugugauugcgucuagcgggaugcuuuggauggccgagaucccccugcaauggauugcuuccgccaucguucuggaauuuuucaugauggugcuccugauuccugagcccgagaagcagcggaccccgcaggacaaucaacuugcuuacguggucaucggcauucucacacucgccgcgaucaucgccgcuaacgaaaugggacugcuggagaccacgaaacgcgaucucggcaugagcaaggaaccugggguugugucucccacauccuaucuugacguggaccugcaucccgccagcgcuuggacccuguacgccgucgcuacaaccgugauuaccccuaugcucagacacacaaucgaaaauucuacggccaacguuagccuggcggccauugcuaaccaggccgugguccuuaugggacuggauaaaggcuggccgaucuccaagauggaccucggggugccccugcuggcucucggaugcuacucucaggucaauccucuuacccugacagccgccgugcugcuccugauuacccauuaugcgaucaucggccccgggcuucaggcuaaagccacacgggaagcucaaaagagaaccgccgccggaauuaugaagaacccuacgguugauggcaucaugacaauugaccuggaucccgugaucuacgacagcaaauuugagaagcagcucggccaggucaugcugcuggugcucugugcuguucagcuucugcugaugcgcaccuccugggcccucugcgaggcgcugacccuugccacagggccuauuaccacacugugggaaggaucuccgggcaaauucuggaauacgaccaucgcugugagcauggccaacaucuuucggggguccuaucucgcuggagccggccuggcguucagcauuaugaagucugucgggacaggaaaaagaggcaccggcucccaaggggagacacugggagaaaaguggaagaaaaagcucaaucagcuuagccgcaaagaguuugaucuguacaagaaauccggcaucaccgaaguggaccggacggaggccaaggaggggcugaaaagaggagaaauuacccaccaugcugugucucggggcagcgccaagcuccagugguucguugagcgcaacauggucauccccgaagggagagugauugaucugggauguggccggggcgggugguccuauuacugcgcuggacuuaagaaagugacagagguccgcggcuauaccaaagggggaccuggccacgaggagcccguuccuaugucuacauacggguggaauaucgugaaacugaugagcggaaaggacguguuuuaccugcccccggagaaaugugauacccugcugugcgacauuggcgaauccagcccuucucccacagucgaggaauccagaaccauccgggugcucaagaugguugagcccuggcuuaagaacaaucaguucuguaucaaagugcugaacccuuauaugcccacggucauugagcaccuggaacgccuccaaagaaagcauggcgggaugcuggugcggaauccucuuagccgcaacucuacacacgagauguacuggaucuccaauggaaccggcaacauuguuagcucugugaauauggucagcagacugcuccugaaccgguuuaccaugacacauagacgcccgacgaucgaaaaagauguggaccugggggccggaacccggcacgugaacgcugagcccgaaacaccuaauauggacgucauuggcgagagaaucaagcgcaucaaagaggaacacaacuccaccuggcauuaugaugacgagaaucccuacaagacaugggccuaucacgggucuuacgaaguuaaggcgaccggaagcgccuccagcaugauuaacggcguggugaaacuccugacaaagccuugggaugucgugcccaugguuacccagauggcuaugacggacaccacaccguucggccagcaacggguguucaaagagaaggucgauaccagaacaccucgccccaugccugggacccggaaagugaugggaaucacggccgaauggcuuuggagaacacugggccgcaauaagcggcccagacucugcacccgcgaggaguuuacaaagaaaguucggaccaacgcugccaugggggccguguucacggaagagaaucagugggacuccgcgaaggcugccgucgaagaugaggaauuuuggaaacugguggacagagagcgcgagcuucauaagcugggaaaauguggcucuugcguuuauaacaugauggggaagagagagaagaagcucggcgaguucggaaaggccaaaggcagccgggcuauuugguacauguggcugggggcccgcuaccuggaauuugaggcucucggauuccugaaugaggaucacugguuuuccagagacaacucuuauagcggcguggaaggggagggacuucauaagcugggcuacauccuccgggauauuuccaaaaucccugggggcgccauguaugcggacgacaccgccggaugggauacaagaaucaccgaagacgaucugcacaaugaggaaaagauuacacagcagauggaccccgagcaccggcaacuugcuaacgccaucuucaaacugaccuaccagaauaaggucgugaagguccagcgcccgacaccuaccggcacggugauggauauuaucucuagaaaagaccagcgggggagcggacaaguuggcacauaugggcucaacaccuuuaccaauauggaggugcagcugguccgccagauggaaggagagggcgugcuguccaaggcugaucucgaaaacccccaucugcccgagaaaaagauuacacaguggcuugaaaccaaagggguggagagacugaagcggauggccaucagcggcgacgauugcguugugaagccuaucgacgaucgcuucgcgaacgcccuccuggcucuuaaugacaugggaaaagucagaaaggauauuccgcaauggcagcccucuaaaggcuggcacgacuggcaacaggugccuuuuuguucccaucacuuccacgagcugaucaugaaggacgggcggaaacucguugugcccugccgcccucaagaugaacugauuggacgggcccggaucagccagggcgcuggguggucucugcgcgagacagccugucucggaaaggcuuacgcccagauguggucccugauguauuuucauagacgggaccuucgccuggcgagcaacgccauuugcucugcuguccccgugcacugggucccuacguccagaaccacauggagcauccaugcccaccaucaauggaugaccacagaagauaugcucaccguguggaaucggguuuggauugaggacaaccccuggauggaagauaagacgccggugaccacaugggagaaugucccuuaccugggcaaaagagaggaccaguggugugggucccuuaucggccugaccagccgcgccacaugggcucagaacauccccaccgccauucagcaagugcggucucucaucggaaaugaagaguuccuggauuacaugccuagcaugaagagauuccgcaaagaagaggaguccgaaggcgcgauuugguga

SEQ ID NO: 20909 - RNA, 9873 nt, Artificial Sequence
  derived and/or modified CDS sequence (opt5) from DENV-3__KM190937__SS-prME
accagccucugccucaugaugaugcugcccgccacacuugcuuuccaccugacgucccgggacggagaaccucggaugaucguggggaagaacgaacgcggaaaaucucuccuguuuaagaccgccagcggcauuaauauguguacacuuaucgcgauggaucugggggagaugugcgacgauaccgugacauacaaauguccgcauauuaccgaaguugagcccgaagacaucgauugcugguguaaccucacauccaccugggugacguauggaaccugcaaucaggcuggcgagcaccggcgggacaagcgcucuguggccauugccccucaugucgggaugggacuggauacaagaacccagacauggaugagcgcugagggcgccuggagacagguggaaaaaguugagaccugggcucugcgccaccccggcuucacgauccucgcccuguuucuugcgcauuacaucgggacaucccugacccagaagguggucauuuucauccuccugaugcuugugacaccuucuaugaccaugagauguguuggagugggcaaccgggacuuugucgaagggcugagcggagccaccuggguggaugugguccucgagcacggcgggugcguuacaacgauggcuaagaauaaacccacccuggacauugagcugcagaagacagaagccacccagcucgcuacacugcgcaaacuuuguaucgagggaaagauuaccaacaucacgacagauuccagaugcccuacccagggcgaagccauucugccggaggaacaggaccagaauuauguguguaaacacaccuacguggaucggggcugggggaacggaugcggccucuucgggaagggaagccuggucacaugcgcgaaguuucaaugucuugagucuaucgagggcaaagugguucagcaugaaaaucugaaguauaccgugaucauuacaguccacacgggggaccagcaucaggugggaaacgagaugcaaggcguuaccgccgaaaucacaccccaggcuuccaccgccgaggugauucucccugaauacggcacacuggggcuggagugcagcccccgcaccggacucgacuucaaugagaugaucucucugacgaugaaaaacaaggcuuggaugguccacagacagugguuuuucgaucuuccucugcccuggaccuccggcgccacagccgaaaccccgacauggaaucggaaagagcuccuggugaccuuuaagaacgcucacgcgaaaaagcaagaagucgugguucuugggagccaggagggagccaugcauacggcucugacaggcgccaccgaaauucagacaucugggggcaccuccaucuucgccggacaccucaagugucgccugaaaauggacaagcuggagcucaaaggcaugagcuaugcuaugugccuguccucuuuugugcuuaagaaagaggucagcgaaacccagcaugggacaauccugauuaagguggaguacaagggagaagaugccccuuguaaaauccccuucuccacggaggacggccaagggaaggcgcacaauggaagacucauuaccgcuaacccuguugugaccaaaaaggaggaacccgucaacaucgaggccgaacccccuuucggcgagagcaauauugugaucgggaucggcgauaaagcccugaagauuaacugguacaagaaaggaucuuccaucggcaagauguuugaagcuaccgccagaggggcuagacgcauggccauucugggagacacagcgugggauuucggcagcgucggcgggguucuuaauucucucgggaaaaugguccaucagaucuuugggagcgccuauaccgcucuguucggcggaguguccuggaugaugaagauuggcaucggggugcugcucacguggauuggacugaacucuaaaaauacaagcauguccuuuagcugcaucgccaucggcauuaucacccuuuaccugggggcugucgugcaggccgacaugggauguguuauuaacuggaagggcaaggagcucaaaugcgggucuggcaucuucgugaccaaugagguccacacauggaccgaacaguauaaguuucaagcggauuccccgaaacggcuggccacagcuauugccggagcuugggagaacggcgugugugggaucagaagcacgacccgcauggaaaaucugcuuuggaagcagaucgccaacgagcucaauuacauucugugggaaaacaauaucaaacugacaguuguggucggagacauuaccggcgugcucgagcaggggaagcggacacugacaccccagccuauggagcuuaaauauucuuggaagacguggggaaaggccaaaaucguuaccgcugaaacacaaaacuccagcuucauuaucgauggccccuccaccccugagugccccucugcgagcagagccuggaaugugugggaagucgaggacuacggcuuugggguguucacaaccaacaucuggcugaagcuccgcgaaguguauacacagcugugugaccaccggcugauguccgcugccgucaaagaugagagagccguucaugcugacaugggauacuggauugagucucagaagaacggcagcuggaaacuugaaaaggccuccuuuaucgaggugaagaccugcacguggccgaaaagccacacacucuggucuaauggggugcuggaauccgauaugauuaucccuaagagccuggcgggacccauuucucagcauaaccaccgcccuggcuaccacacccaaaccgcugggcccuggcaucucggaaaacuggagcuugacuucaauuauugcgagggcacaaccgucgugaucuccgaaaacuguggcacgcgggggccuagccugagaacaaccacaguuucuggaaagcucauccacgaguggugcugucgcagcugcacccugcccccgcugcgguacaugggcgaagauggguguugguauggaauggagauuagaccuaucaaugaaaaagaggagaacauggugaagucccuugccagcgccggcucugggaaggucgacaauuuuacaaugggagugcucugccuggcuauucuguucgaagagguuaugcggggcaaauucggcaagauccauaugauugccggggugcucuuuaccuucguccugcuucuguccggacagaucacguggcgcgauauggcgcacacccucauuaugaucggcagcaacgcuuccgacagaauggggaugggagugacauaccuggcccugaucgccaccuuuaaaauucagcccuuccuugcucugggcuuuuuccuccggaagcugacaucuagagaaaaucuccugcuugggguuggacuggccauggcugccacccuccgccugcccgaggauaucgaacaaauggcgaacggcauugcccugggccuuauggcucugaaacucaucacgcaguuugagacauaucagcuguggaccgcccucgugagccugacauguuccaauaccauuuucacccuuacagucgcuuggcggacggccacccugauccucgccgggaucucucugcugccugugugccagagcuccucuaugagaaagacagacuggcuuccgaugaccguggcugcgaugggagcccaaccccugccucucuuuauuuucagccugaaggauacacucaaacgcagauccuggccccugaacgagggcgucauggcuguugggcuugugagcauccuggccucuucccugcuccggaaugacgugccuauggccggaccccuggucgcuggcgggcuucugauugccuguuacgugaucaccggaacgagcgcggaucucacaguugaaaaggcugccgacgugaccugggaggaagaggccgaacagaccggcgucucucauaaccugauggugacaguugacgaugacggcaccaugcgcauuaaagaugacgagacagagaauauccucacggugcugcuuaagaccgcucugcugaucgucuccgggauuuuuccuuauagcauccccgccacacuccugguguggcacaccuggcagaaacagacacaaagaucuggaguccuuugggaugugccguccccucccgaaacccagaaggcggagcuggaagagggcguuuaccggauuaaacagcaggggaucuucggaaagacgcaagugggcgucggggugcagaaggagggaguuuuucacaccauguggcaugugacacgcggcgcuguccucacccacaacggcaaaagacuggaaccuaacugggccagcgugaagaaagaccucauuuccuacgggggaggcuggcggcugagcgcccaguggcaaaagggggaggaagugcagguuaucgcugucgagcccggcaaaaauccgaagaacuuccagacaaugccuggcauuuuccagaccacaacgggggaaaucggagccaucgcucuugauuuuaagcccggcaccucuggcagcccuauuaucaaucgcgaggggaaaguggugggacuguauggcaacggggucgugacaaagaauggaggcuacguuuccgggauugcccaaaccaacgcggagcccgacggccccaccccugaacuggaggaagagauguucaaaaagagaaaucucacaaucauggaucugcauccgggaucuggcaaaacgcggaaguaucuucccgccauugugcgcgaagcuaucaagagacggcugagaacccucauccuggccccuacacgcgucguggcugccgagauggaggaagcccucaaagggcugcccauucgguaccagaccacagcuaccaagagcgagcacacgggaagagaaaucguugaccuuaugugccaugcgacauuuaccaugcgccugcuguccccugugcggguccccaacuauaaucucauuaucauggaugaggcccacuucaccgacccugcuucuauugccgccagaggcuacaucagcacacgcguggggaugggagaagcugccgcgaucuuuaugaccgcuacaccgcccggcaccgccgaugccuucccucaguccaacgcucccauucaggacgaggagcgggacaucccugaaagaucuuggaauagcgggaacgaguggauuacggauuuuguuggcaaaacagugugguucguccccuccaucaaggccggaaaugacauugcgaacugucugcgcaaaaauggcaagaaggugauccaacuuagccggaaaaccuuugauacagaauaucagaagaccaaacugaacgacugggauuucguggucacgaccgacauuucugagaugggggccaacuuuaaggcugauagaguuaucgacccgcggcgcugccucaaaccugugauccugacagauggacccgagagagugauucuggccggccccaugccugucaccguggcuuccgccgcucagcggcgcgggagaguuggacggaauccccagaaggaaaacgaccaauacaucuucaugggccagccucucaauaacgaugaggaccacgcccauuggacagaagcgaagaugcuucuggacaauauuaacaccccggaggggaucauucccgcccuguucgaaccugagagagagaaaagcgcugccaucgauggcgaauaccgccucaagggagagucucggaaaacauuuguggaacugaugagacgcggcgaccuucccgucuggcuggcucacaagguggccuccgaggggaucaaauauaccgaucggaaguggugcuucgacggagaaagaaauaaccagauucucgaggagaauauggauguugaaaucuggacgaaagagggcgaaaagaagaaacugcgcccucgguggcuggacgccagaacauacagcgauccccucgcucuuaaggaguuuaaagacuucgcggccgggcgcaaguccauugcucuggaucuggugaccgaaaucggaagagucccgucucaucucgcccaccggacccgcaacgcccuggacaaucuugugaugcugcacacaagcgagcauggcggcagagcuuaucggcacgccgucgaggaacucccugagaccauggaaacacugcugcuccuugggcugaugauucugcucacgggaggcgcgaugcuguuucuuaucuccgggaaaggaaucggcaagaccagcauugggcugaucugugugauugccucuuccggaaugcucuggauggcugauguuccccugcaguggaucgccagcgcuauugugcuggaguucuuuaugauggugcuccuuaucccugagcccgaaaagcaacgcacaccucaggacaaccagcuggccuacgucguuauuggcauccugacccucgcggccaucguggcugccaaugagaugggccugcuugaaacaaccaaaagagaucuggggaugucuaaggagcccggaguggucagcccgacguccuaucucgacguggaccugcauccugcuucugccuggacccuguacgcuguugccacaaccgugauuacacccaugcuccggcacaccaucgaaaacagcacggcgaaugucucccuugccgcuauugccaaccaagcugugguccugaugggccuggauaaaggguggcccaucucuaagauggaccucggagugccucugcuugcccugggcugcuauagccagguuaauccgcucacacuggccgcggcugugcugcuccuugucacccauuacgccauuaucgggcccggacugcaggcuaaagccacaagagaggcccagaagcgcaccgcugccggcaucaugaagaacccuaccguggauggcauuaugacaaucgaccuggaucccguuauuuacgacuccaaauucgagaagcaacucggacaggugaugcugcuuguccugugugcggugcagcuccugcugaugcggacgagcugggcccucugcgaagugcuuacccuggcuacaggaccuaucaccacacugugggagggcucucccgggaaauuuuggaacaccacgauugccguuuccauggcuaauaucuucagaggaagcuaucucgccggcgcggggcuggccuuuuccaucaugaagucugucggaacaggcaaacgcggcaccgggagccagggagaaacccuuggcgagaaguggaagaaaaagcugaaccaacucucccggaaagaguucgaucuguacaagaaaucugggauuacagagguggacagaaccgaggcuaaggaaggacugaaacggggcgagaucacacaccacgccgugagccgcggguccgcuaagcuccagugguuugucgaaagaaauaugguuauuccugagggacgggugaucgaucuuggcuguggccgcgggggauggagcuauuacugcgccggccugaagaaagugacggaagucagaggguauaccaagggaggcccggggcaugaggagcccgugccuaugucuacauacggauggaacauuguuaaacugauguccggcaaggacguguucuaucugcccccugaaaaaugugauacccugcuuugcgacaucggcgagagcucucccuccccgacagucgaagagagccggaccauucgcgugcugaagaugguugagccuuggcucaagaauaaccaguucuguaucaaagugcugaaucccuacaugcccacggucaucgaacaccuggagagacuccagcggaagcaugggggaaugcuugugcgcaacccucugucuagaaauagcacccacgaaauguacuggauuuccaacggcacagggaauaucgugucuagcgucaacaugguuucccggcugcuccugaauagauuuaccaugacacaccgccggcccaccauugagaaagauguggaccuuggagcuggcacaagacaugugaacgccgaaccugagaccccgaauauggacgucaucggggagcgcauuaagcggaucaaagaagaacacagcuccacguggcauuaugaugacgaaaaccccuacaagacaugggcguaucacggaucuuacgaggugaaggccaccggcagcgcuuccucuaugaucaacggcguugugaaacugcucaccaagccuugggaugucgugcccaugguuacacaaauggccaugacggacaccacaccuuucgggcagcagagaguguuuaaagaaaaggucgauacccgcacaccccggccgaugccuggaaccagaaaagugauggagauuacagcugaguggcuguggcgcacccugggccggaauaagagaccccgccucugcacgcgggaagaguucaccaagaaaguuagaacaaacgccgccaugggggcgguguuuaccgaagagaaucaaugggacagcgcucgcgccgccgucgaagaugaggaguucuggaagcugguggacagagaacgggagcuucauaaacugggaaaguguggcuccugcgucuauaacaugauggggaaacgcgaaaagaaacucggcgaguuuggaaaggcuaagggcucuagagccaucugguacauguggcugggggcucgguaucuugaguucgaagcccugggauuucucaaugaggaucacugguucagcagagaaaacuccuacagcggcguggagggggaaggacugcacaaacugggcuacauucuccgggacaucucuaagauuccugggggcgcgauguaugccgaugacacagcuggaugggacacccgcaucacggaggaugaccugcauaaugaggagaaaaucacacagcagauggaucccgagcacagacagcuugccaacgcuauuuuuaagcugaccuaccaaaauaaaguugugaagguccagcggccuacacccaagggcaccgugauggacaucauuucccgcaaagaucagagagggagcggacaggugggcacguaugggcucaacaccuucacaaauauggaagcccaacugauccggcagauggagggagaaggcguucuuucuaaggcggaccuggagaacccgcauccucucgagaaaaagauuacccaguggcuggaaacaaaagggguggagcgccugaagagaauggccaucuccggcgaugacugcgucgugaagcccaucgaugaccgguuugcuaaugcccuccuggcucuuaacgauaugggaaaaguucgcaaggacauuccccaguggcaaccuagcaaaggcuggcacgauuggcaacaggugccguucuguucucaccauuuccacgaacugaucaugaaggacgggagaaaacucgucgugcccugccggccucaggacgagcugauuggacgcgccagaaucucccaaggcgcuggguggagccuucgggaaaccgccugucugggaaaggcguacgcccagaugugggcucucauguauuuucaucgcagagaucugcggcuggccuccaaugccauuugcagcgcuguccccgugcacuggguuccuacaucuagaaccacguggagcauccaugcccaccaccaguggaugacaaccgaggacaugcucaccguguggaaccgcgucuggauugaggauaaccccuggauggaagacaagacaccugugaccacaugggaggauguucccuaccugggcaaacgggaagaccaauggugugggucccuuaucggccugacgucuagagcgaccugggcucagaauauccucacagccauucaacaggugcgcagccugaucggaaacgaggaguuccuugauuauaugccguccaugaagcgguuuagaaaagaagaggaaucugagggcgccauuugguga

SEQ ID NO: 20910 - RNA, 9873 nt, Artificial Sequence
  derived and/or modified CDS sequence (opt5) from DENV-3__JQ920487__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagaacccaaacauggaugagcgcugagggcgccuggcggcagguggaaaaaguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccaacuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaagccguucagcacgaaaaucucaaguauaccgugauuaucacaguccauacgggggaccagcaccaggugggaaacgagacccaaggcguuacagcugaaaucaccccccaggccuccacaguggaggcuauucugccugaauacggcacccuggggcucgagugcagcccccgcacgggacuggacuuuaaugagaugauccuucugaccaugaaaaacaaggccuggaugguccauagacagugguucuuugaucucccucugcccuggacaucuggcgccaccacagaaaccccgacguggaauaaaaaggagcuucuggugacauucaaaaacgcucacgcgaagaagcaagaagucgugguucucgggucccaggagggagccaugcacaccgcucugacaggcgccaccgaaauucagaccagcgggggcacaucuaucuuugccggacaucugaaaugucggcucaagauggacaaacuggagcuuaagggcauguccuaugcuaugugccugaaugccuucgugcucaaaaaggaggucagcgaaacgcagcacgggaccauucugaucaagguggaguacaaaggagaagaugcgccuuguaagauccccuucuccacagaggacggccaagggaaagcucauaacggacgccugauuaccgccaacccuaucguuacaaagaaagaggaacccgugaauauugaggccgaacccccuuuuggcgagucuaacaucgucauugggaucggcgauaaggcucuuaagaucaauugguacaaaaagggaagcuccauuggcaaaauguucgaagccaccgcuagaggggcccggagaauggcgauccucggagacacggccugggauuuuggcagcguggggggagugcugaacucucugggcaagaugguucaccagauuuucggguccgcuuauacagcccucuuuagcggcgucucuuggaucaugaaaauuggaaucggcgugcugcuuaccuggauugggcugaauagcaagaacaccuccaugucuuucagcugcaucgugaucggaauuaucacacucuaccugggcgcugucgugcaggccgacaugggguguguuauuaauuggaagggaaaagagcugaagugcggcuccgggaucuuugugaccaacgagguccauacauggacggaacaguauaaauuccaagcggauagcccgaagcgccuugccaccgcuauugccggcgcuugggagaauggaguguguggcauccggucuacaaccagaauggaaaaccuccuguggaaacagaucgccaaugagcugaacuacauucucugggaaaauaacaucaagcugacaguuguggucggggacgugauuggaguucuugagcagggcaaacgcacccugacgccccagccuauggagcucaaguauuccuggaagaccugggggaaagccaagaucgugacagcugaaacccaaaauagcucuuuuauuaucgauggacccaacacaccugagugccccuccgcgagccgggccuggaacgucugggaaguggaggacuacggcuucggcguguuuaccacaaauaucuggcugaaacugagagaaauguauacccagcuuugugaccaccgccucauguccgcugccgucaaggaugagcgggccguucacgcugacaugggguacuggauugagucucagaaaaacggaagcuggaagcuggaaaaggccucccugaucgaggugaaaacgugcacauggccgaagucucauacccucuggagcaauggcgugcuggaauccgauaugauuaucccuaaaagccuugcggggcccauuucucagcacaacuacagaccuggauaucauacccaaacagcuggccccuggcaccuggggaagcucgagcuggacuucaauuacugcgagggaaccacggucgugaucacagaaaacuguggcacccgcggcccuucccugcggacaaccacaguuagcgggaaacuuauccacgaguggugcuguagaucuugcacccuccccccgcugcgcuauaugggagaagauggcuguugguacgggauggagauucggccuaucaaugaaaaggaggagaacauggugaagucccuggucagcgccggaucuggcaaagccgacaauuuuacgaugggggugcucugccuggcuauucuuuucgaagagguuaugagaggaaaguucggcaaaaagcauaugaucgccggcgcgcuguuuaccuucgugcuccugcugagcgggcagauuacauggcgggauauggcucacacccuuaucaugauuggauccaacgccagcgaccgcaugggcaugggggucacauaucuggcccucaucgcuaccuuuaaaauccagcccuuccuggcccucggauuuuuccugagaaagcuuacgucucgggaaaaucugcuccugggcguggggcuggcuauggccacaacccuucaacugcccgaggauauugaacagauggcgaacggaaucgcccucggccugauggcucucaagcugauuacacaguuugagaccuaccagcuuuggaccgcccugguuucccucauguguagcaauacaaucuucacgcugaccguggcuuggagaacagccacccugauucuugccgucaucucccugcucccugugugccaaucuagcuccaugcgcaaaacagacuggcugccgaugaccguggcugcgaugggcguccccccucucccccuguuuaucuucucucuuaaggauacgcugaaacggagaagcuggccucugaacgaggggguuauggccgugggacucguguccauucuggcuucuagcuuucuucgcaaugacguccccauggccggcccucugguggccgggggacuccugaucgcuuguuauguuauuacaggcaccuccgccgaucucaccguggaaaaggcggcugacgucacaugggaggaagaggccgaacagaccggggugagccauaaccugaugaucacaguugacgaugacggaacgaugagaauuaaagaugacgagaccgagaacauccuuacagugcugcugaagaccgcccuccugaucgucucuggcauuuuccccuacuccaucccggcuacacuucugguguggcacaccuggcagaaacagacgcaacggagcggcguccucugggaugugccuucucccccugaaacccagaaggccgagcuggaagaggggguuuaccgcauuaagcagcagggaaucuuuggcaaaacacaagugggggucggagugcagaaggagggcguuuuccauaccauguggcacgugacaagaggggcgguccucacccacaauggaaaacggcuggaacccaacugggcuaaugugaagaaagaccuuauuuccuauggcggcggguggaagcugagcgcccaguggcaaaagggagaggaagugcagguuaucgccgucgagccgggcaaaaacccuaagaauuuccagacaaugcccgggauuuuucagacgaccacaggagaaaucggcgcuaucgcccuggauuucaaaccugggaccucuggaucccccauuaucaaccgcgagggcaagguggugggccucuacgggaauggagucgugaccaaaaacggcggguauguuagcggaauugcucaaacaaaugccgagcccgacggcccuacgccggaacuggaggaagagauguuuaagaagagaaaccuuaccaucauggaucugcaucccggguccggcaaaacacggaaguaccucccugcgauugugcgcgaagccaucaaaagacggcugcgcacccucauccuggcucccacaagagucguggccgcugagauggaggaagcccuuaagggacugccuauucgguaucagaccacggccacaaaaagcgagcacaccggcagagaaaucguugaccugaugugccaugcuaccuucacaaugcgccuccugucucccgugcgggucccuaauuacaaccuuauugugauggaugaggcgcacuuuaccgacccggccagcaucgcugccagaggguauauuuccacacgcguuggaaugggcgaagccgcugccaucuucaugaccgcgacgcccccugggacagcugaugccuuuccccagucuaaugccccuauccaggacgaggagcgggacauucccgaaagaagcuggaacuccggaaaugaguggaucaccgauuucgcuggcaagacagugugguuugucccgucuauuaaggccgggaacgacaucgcgaacugucugcgcaaaaauggcaagaaagugauucaacucagccggaagaccuucgauacggaauaccagaaaaccaagcugaacgacugggauuuuguggucacaaccgacaucuccgagaugggagccaauuucaaggcugauagaguuauugacccucgccggugccugaaacccgugauccucacagauggccccgagagagugauccuugccgggccuaugcccgucaccguggcuucugccgcucagcggcgcggaagaguuggccggaacccucagaaggaaaaugaccaauacauuuucacagggcagccgcugaacaaugaugaggaccaugcccacuggaccgaagcgaaaaugcugcucgacaacaucaauacgcccgagggaauuaucccugcccuguuugaacccgagcgcgagaagagcgcugccauugauggcgaauauagacuuaaaggggagucccggaagacauucguggaacugaugagacgcggcgaccucccugucuggcuggcucacaaaguggccagcgagggaaucaaguacaccgaucggaaguggugcuuugacggcgaaagaaacaaucagauccuggaggagaacauggauguugaaauuuggaccaaagagggggaaaagaaaaagcuccgcccccgguggcuugacgccagaacauauucugauccgcuggcucugaaagaguucaaggacuuugcggccggacgcaaguccaucgcucucgaucuggugaccgaaauuggccgggucccuagccaucuugcccacagaacacgcaaugcccuggacaaccucgugaugcugcauacgucugagcacgggggaagagcuuaccggcacgccgucgaggaacugcccgagaccauggaaacacuccuucugcugggccucaugauccugcuuaccggcggggcgaugcuguuccucauuuccggaaaaggcaucgggaagacaagcaucggacugauuugugugguugccuccucuggcaugcuguggauggcugaugugccucuccaguggaucgccagcgcuauugugcuugaguuuuucaugaugguccugcugauccccgagccugaaaaacaacgcaccccccaggacaaucagcucgccuauguugugauugggauccugacgcuugcggccauuguggcugccaacgagaugggacugcucgaaaccacaaagagagaucugggcauguccaaagagccgggcgucgugagcccuaccucuuaccuggacguugaccuccaucccgcuuccgccuggacacuuuaugcuguggccaccacggucaucacacccaugcugcggcacaccaucgaaaauagcacagcgaacgugucucuggccgcuauugccaaccaagcugucgugcucauggggcuggauaagggauggccuaucagcaagauggaccuuggcguuccgcugcucgcccuggggugcuacucccaggugaauccccugacccucaccgccgcgguccuucugcuggugacacauuacgcuauuaucggaccuggccuccaggccaaagcuacgcgcgaggcccagaagagaaccgccgcugggauuaugaaaaaccccacaguugauggaaucaugaccaucgaccuggauccugugauuuaugacucuaaguuugagaaacaacuuggccaggucaugcugcucgugcugugugccgugcagcugcuccuuaugcggacaagcugggcguucugcgaagcccugacccuggcuacgggccccaucacaacccucugggagggguccccuggaaaguuuuggaauaccacaauugccguuucuauggcuaacaucuucagaggcagcuaccuggccggggcgggacuugccuuuuccauuaugaagagcgucggcaccgggaaacgcggaacaggcucucagggcgaaacgcugggggagaaguggaaaaagaaacucaaucaacugucccggaaggaauucgaucuguauaaaaagagcggaaucaccgagguggacagaacagaggcuaaggaaggccucaaacgcggggagaucacccaccaugccgugucccggggaucugcuaagcuucagugguucgucgaaagaaacaugguuauuccggagggccgggugaucgaucugggguguggacgcggcggcuggagcuacuauugcgccgggcugaaaaaggugacagaagucagaggauacaccaaaggcgggcccggacacgaggagccugugcccauguccacguauggcuggaauauuguuaagcucaugucugggaaggacguguuuuaccugccucccgaaaaaugugauacccuucugugcgacaucggagagagcuccccgagcccuacagucgaagagucucggaccauucgcgugcucaagaugguugagcccuggcugaaaaacaaucaguucuguaucaaggugcugaaccccuacaugccuacagucauugaacaccucgagagacuucagcggaaacauggcggcaugcuggugcgcaauccccuguccagaaacagcacccacgaaauguauuggaucucuaaugggacaggaaacaucguguccagcgucaauaugguuucucggcuccugcuuaaccgcuuuaccaugacgcauagacggccuacaauugagaaggauguggaccugggcgcugggaccagacacgugaacgccgaaccggagacccccaauauggacgucaucggagagcgcauucggagaaucaaggaagagcacagcuccacauggcauuacgaugacgaaaacccuuauaaaacgugggcguaccacggcucuuaugaggugaaggccaccgggagcgcuuccagcaugauuaauggaguugugaaacuccugacaaagcccugggaugucgugccuaugguuacccaaauggccaugacagacaccacacccuucggccagcagcgcguguuuaaagaaaaggucgauacccggacgccgagaccuaugcccggcacccgcaaggugauggagaucacagcugaguggcuguggcggacccucgggagaaacaaacgcccucggcugugcacaagagaagaguucaucaagaaaguucgcaccaaugccgccaugggagcgguguuuacggaagagaaccaaugggacuccgcucgggccgccgucgaagaugaggaguucuggaagcuuguggacagagaacgcgagcugcauaaacucggcaagugugggucuugcgucuacaauaugaugggaaaaagagaaaagaagcugggcgaguuugggaaagcuaagggcagccgggccauuugguauauguggcuuggagcucgcuaccuggaguucgaagcccucggcuuucugaacgaggaucacugguucuccagagaaaauucucauagcgggguggagggagaaggccugcacaaacucggguacauccugcgggacauuuccaagauccccggaggcgcgauguaugccgaugacacagcugggugggacaccagaauuacagaggaugaccuucacaacgaggaaaaaaucacccagcagauggauccugagcaucggcagcuggccaaugcuaucuuuaagcucacguaccaaaacaagguugugaaaguccagcgccccaccccgaagggcacagugauggacauuaucucuagaaaagaucagcggggaagcggccagguggggaccuauggacugaauacauucaccaacauggaagcccaacuuauucgccagauggagggcgaagggguucuguccaaggcggaccucgagaauccucaccugcuggagaaaaaggugacacaguggcucgaaaccaagggagucgagagacugaaacggauggccaucagcggcgaugacugcgugguuaagcccauugaugaccgcuucgcuaacgcccuucuggcucucaacgauauggggaaagugagaaaggacaucccccaguggcaaccuucuaaaggcuggcaugauuggcagcaggucccguuuuguucccaccacuuccaugaacugaucaugaaggacggacggaagcuugugguccccugccgcccucaggacgagcugauuggcagagcccggaucagccaaggggcuggauggucucuccgcgaaacggccugucugggcaaagcguacgcccagaugugggcucugauguauuuucacagacgggaucuccgccuggccuccaaugccauuugcagcgcugugcccguucauugggugccuacaucuagaaccaccugguccauccacgcccaucaccaguggaugacaaccgaggacaugcuuacagucuggaaccggguguggauugaggauaaucccuggauggaagacaagacgccuguuaccacaugggaggaugugcccuaccuggggaaaagagaagaccaaugguguggaagccucaucggccugaccucccgcgcgacaugggcucagaacauucuuaccgccauccagcagguccggagccugaucgggaaugaggaguuccucgauuauaugccgucuaugaagagauuucgcaaagaagaggaaagcgagggcgccauuugguga

SEQ ID NO: 20911 - RNA, 9873 nt, Artificial Sequence
  derived and/or modified CDS sequence (opt5) from DENV-3__JQ920488__SS-prME
accagccugugccucaugaugaugcugcccgccacccuugcuuuccaccugacguccagagacggagaaccucggaugaucguggggaagaacgaacgcggaaaaucucuccuguuuaagaccgccagcggaauuaauauguguacacuuaucgcgauggaucugggggaaaugugcgacgauaccgugacauacaaauguccgcucauuaccgaaguugaacccgaagacaucgauugcugguguaaccugacauccaccugggugacguauggaaccugcaaucaggcuggcgagcauagacgggacaagcgcucuguggcccuggccccucacgucgggaugggacucgauacaagaacccaaacauggaugagcgcugagggcgccuggagacagguggaaaaaguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccaacuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaagccguucagcacgaaaaucucaaguauaccgugauuaucacaguccauacgggggaccagcaccaggugggaaacgagacccaaggcguuacagcugaaaucacaccccaggccuccacaguggaggcuauucugccugaauacggcacccuggggcucgagugcagcccccgcacgggacuggacuuuaaugagaugauccuucugaccaugaaaaacaaggccuggaugguccauagacagugguucuuugaucucccucugcccuggacaucuggcgccaccacagaaaccccgacguggaauaaaaaggagcuucuggugacauucaaaaacgcucacgcgaagaagcaagaagucgugguucucgggucccaggagggagccaugcacaccgcucugacaggcgccaccgaaauucagaccagcgggggcacaucuaucuuugccggacaucugaaaugucggcucaagauggacaaacuggagcuuaagggcauguccuaugcuaugugccugaaugccuucgugcucaaaaaggaggucagcgaaacgcagcacgggaccauucugaucaagguggaguacaaaggagaagaugcgccuuguaagauccccuucuccacagaggacggccaagggaaagcucauaacggacgccugauuaccgccaacccuaucguuacaaagaaagaggaacccgugaauauugaggccgaacccccuuuuggcgagucuaacaucgucauugggaucggcgauaaggcucuuaagaucaauugguacaaaaagggaagcuccauuggcaaaauguucgaagccaccgcuagaggggcccggagaauggcgauccucggagacacggccugggauuuuggcagcgucgggggagugcugaacucucugggcaagaugguucaccagauuuucggguccgcuuauacagcccucuuuagcggcgucucuuggaucaugaaaauuggaaucggcgugcugcuuaccuggauugggcugaauagcaagaacaccuccaugucuuucagcugcaucgugaucggaauuaucacacucuaccugggcgcugucgugcaggccgacaugggguguguuauuaauuggaagggaaaagagcugaagugcggcuccgggaucuuugugaccaacgagguccauacauggacggaacaguauaaauuccaagcggauagcccgaagcgccuugccaccgcuauugccggcgcuugggagaauggaguguguggcauccggucuacaaccagaauggaaaaccuccuguggaaacagaucgccaaugagcugaacuacauucucugggaaaauaacaucaagcugacaauuguugugggggacgucaucggagugcuugagcagggcaaacgcacccugacgccccagccuauggagcucaaguauuccuggaagaccugggggaaagccaagauuguuacagcugaaacccaaaauagcucuuuuaucaucgauggacccaacacaccugagugccccuccgcgcugcgggccuggaacgugugggaagucgaggacuacggcuucggcguguuuaccacaaauauuuggcugaaacuuagagaaaaguauacccagcucugugaccaccgccugaugagcgcugccgugaaagaugagcgggccguccacgcugacaugggguacuggaucgagucccagaagaacgaaucuuggaagcuggagaaagccagccucauugaaguuaagacgugcacauggccgaaaucccauacccuguggucuaauggagugcuugagagcgauaugaucauuccuaagucccuggcgggccccaucagccagcacaacuacagaccuggguaucauacccaaacagcuggacccuggcaccucggcaaacuggagcuggacuucaauuacugcgaagggaccacgguggucaucacagagaacuguggcauucgcggcccuucucuucggaccacaaccguguccggcaagcucauccacgaauggugcuguagaagcugcacacugcccccgcugcgcuauaugggggaggauggauguugguacggcauggaaauucggccuaucaaugagaaggaggaaaacaugguuaaaucucucguguccgccgggagcggaaagaccgacaauuuuacgaugggcguccugugccuugccauucuguucgaggaagugaugagagggaaauucggaaagaaacauaugaucgcuggcgcccucuuuaccuucguucugcugcuuucuggccagauuacauggcgggauauggcgcacacccugaucaugaucgggagcaacgcuuccgaccgcaugggaaugggcgugacauaucucgcccugauugccaccuuuaagauccagcccuuccucgcucugggguuuuuccuuagaaagcugacgagccgggagaaucuccugcugggagucggccuugccauggcuacaacccugcaacuccccgaagauauugagcagauggccaacgggaucgcgcugggacucauggcccugaaacuuauuacacaguuugagaccuaccagcuguggaccgcucucaucucucugauguguuccaauacaaucuucacgcugaccguggccuggagaacagcuacccuuauucuggccguuaucagccuccugccugugugccaauccucuagcaugcgcaagacagacuggcucccgaugaccgucgccgcuaugggcgugcccccucugccccuuuuuauuuucucccugaaagauacgcugaagcggagaucuuggccucucaacgaaggcgugauggcggucgggcugguuagcauccuugccuccucuuuucugcgcaaugacgugcccauggcuggaccucucguggccggcgggcugcucauugccuguuaugucaucacaggaaccagcgcugaucugaccguggagaaagccgcggacguuacaugggaagaggaagcugagcagaccggcgugucccauaaccuuaugaucacagucgacgaugacgggacgaugagaauuaaggaugacgagaccgaaaacauccugacagugcugcucaaaaccgcccugcuuauuguuagcggaaucuuccccuacucuauuccggccacacugcucguguggcacaccuggcagaagcagacgcaacgguccggcguccugugggaugugccuucucccccugagacccagaaggcugaacucgaggagggcgucuaccgcaucaaacagcaggggauuuuuggaaagacacaagugggcguuggggugcagaaagaaggagucuuccauaccauguggcacgugacaagaggcgccguucugacccacaaugggaagcggcuugagcccaacugggcgaaugugaaaaaggaccugaucuccuauggaggcggcuggaagcugggggcucaguggcaaaaaggagaagagguccaggugaucgccguggaaccgggcaagaacccuaaaaauuuccagacaaugcccgggauuuuucagacgaccacaggagagaucggcgccauugcucucgauuucaagccugggaccuccggaagccccaucauuaaccgcgagggcaaaguugucggccuguacgggaauggaguggugaccaagaacggcggguaugucucuggaaucgcccaaacaaaugcugaacccgacggcccuacgccggagcuugaagaggaaauguuuaagaaaagaaaccugaccaucauggaucuccaucccggguccggcaagacacggaaauaccugccugccauugugcgcgaggcgaucaagagacggcuccgcacccugauucuugcccccacaagaguuguggcugccgagauggaagaggcucugaaaggacugccuauccgguaucagaccacggccacaaagagcgaacacaccggcagagagauugucgaccucaugugccaugccaccuucacaaugcgccugcuuucccccgugcggguuccuaauuacaaccugaucgugauggaugaagcucacuuuaccgacccggcgagcaucgccgcuagaggguauauuucuacacgcgucggaaugggcgaggccgccgcuaucuucaugaccgccacgcccccugggacagcggaugcuuuuccccagagcaaugccccuauucaggacgaggaacgggacauccccgagagauccuggaacucuggaaaugaauggauuaccgauuucgccggcaagacagugugguuuguuccgagcaucaaagcugggaacgacauugccaacugucuccgcaagaauggcaaaaaggugauccaacugucccggaaaaccuucgauacggaguaccagaagaccaagcugaacgacugggauuuugucgugacaaccgacaucucugagaugggagcgaauuucaaagccgauagagugauugacccucgccggugccucaagcccgucauccuuacagauggccccgaaagaguuauucuggcugggccuaugcccgugaccguggccagcgcugcccagcggcgcggaagagucggccggaacucccagaaagagaaugaccaauacaucuucacagggcagccucugaacaaugaugaagaccaugcucacuggaccgaggccaagaugcuccuggacaacauuaauacgccggaaggaaucauccccgcgcuuuuugagccugagcgcgaaaaaucugccgcuauugauggcgaguauagacugaagggggaaagccggaaaacauucguggagcucaugagacgcggcgaccugcccguuuggcuggcccacaagguggcuuccgaaggaaucaaguacaccgaucggaaauggugcuuugacggcgagagaaacaaucagauucucgaggaaaacauggaugucgagaucuggaccaaggaaggggagaaaaagaaacuucgcccucgguggcuggacgccagaacauauagcgauccccuggcccucaaggaguucaaggacuuugcugcgggacgcaaaucuauugcccuggaucuugugaccgagaucggccggguuccgucccaucuggcucacagaacacgcaaugcccucgacaaccuggugaugcugcauacgagcgagcacgggggccgggccuaccggcacgcugucgaagaacucccugaaaccauggagacacuucugcugcucggccugaugauccuucugaccggcggggccaugcuguuccugauuucuggaaagggcaucgggaaaacauccauuggacugaucuguguggucgcgagcuccggcaugcucuggauggccgaugugccccuucaguggauugcuucugccaucguucuggaguuuuucaugauggugcugcucauuccugaacccgagaagcaacgcaccccucaggacaaucagcuggcuuauguggucaucgggauccuuacgcuggccgcgauuguugccgcuaacgaaaugggacuccuggagaccacaaaaagagaucugggcaugagcaaggaacccggcgugguguccccgaccagcuaccucgacgucgaccuucauccugccucugcuuggacacuguaugccguggcuaccacgguuaucacacccaugcugcggcacaccauugaaaauagcacagccaacgugagccucgcggccaucgcuaaccaagccgucgugcugauggggcuugauaagggauggcccauuucuaaaauggaccugggcgucccucuccuggcucuggggugcuacagccaggugaauccgcucacccuuaccgccgccguucugcugcucgugacacauuacgcgaucaucggacccggccugcaggcuaaggccacgcgcgaggcucagaaaagaaccgccgccgggauuaugaagaacccuacagucgauggaaucaugaccauugaccuugaucccgugaucuaugacuccaaauuugaaaagcaacugggccagguuaugcuccuggugcugugugcuguccagcuccuucugaugcggacaucuugggccuucugcgaggcgcugacccucgccacgggcccuauuacaacccugugggaagggagccccggaaaguuuuggaauaccacaaucgcuguguccauggccaacaucuucagaggcucuuaccuugcuggggccggacuggcguuuagcauuaugaaauccgugggcaccgggaagcgcggaacaggcagccagggcgagacgcucggggaaaaauggaagaaaaagcugaaucaacugucucggaaagaguucgaucucuauaagaaguccggaaucaccgagguugacagaacagaagccaaagagggccuuaagcgcggggaaauuacccaccaugcugucagccggggauccgccaaacugcagugguucguggagagaaacauggugaucccugaaggccgggucauugaucugggguguggacgcggcggcuggucuuacuauugcgcugggcucaagaaaguuacagaggugagaggauacaccaagggcgggccgggacacgaggaacccgugccuaugagcacguauggcuggaauaucgucaagcugauguccgggaaagacguguuuuaccuucccccugagaagugugauacccugcucugcgacauuggagaaucuagccccuccccgacaguugaggagagccggaccauccgcgugcugaaaauggucgaaccuuggcugaagaacaaucaguucuguaucaaagugcucaaccccuacaugcccacaguuauugagcaccuugaaagacugcagcggaagcauggcggcaugcuggugcgcaauccucucucuagaaacuccacccacgagauguauuggaucagcaaugggacaggaaacauugucucuuccgugaauauggugagccggcugcuucugaaccgcuuuaccaugacgcauagacggcccacaaucgaaaaggaugucgaccucggcgccgggaccagacacguuaacgcugagccugagaccccgaauauggacgugauuggagaacgcauccggagaaucaaagaggaacacucuagcacauggcauuacgaugacgagaaccccuauaagacgugggccuaccacggcuccuaugaagugaaagcgaccgggucugccagcuccaugauuaauggagucgugaagcugcugacaaaaccuugggauguugugcccauggucacccaaauggcuaugacagacaccacaccuuucggccagcagcgcguguuuaaggagaagguugauacccggacgcccagaccgaugccuggcacccgcaaagugauggagaucacagccgaauggcucuggcggacccuggggagaaacaagcgcccccggcuuugcacaagagaggaguucauuaaaaagguccgcaccaaugcugccaugggagccguguuuacggaggaaaaccaaugggacagcgcgcgggcugccguugaggaugaggaguucuggaaacugguggacagagagcgcgaacuccauaagcugggcaaauguggguccugcgucuacaauaugaugggaaagagagagaagaaacuuggcgaguuugggaaggccaaaggcucucgggcuaucugguauauguggcugggagcccgcuaccucgaguucgaggcucugggcuuucugaacgaagaucacugguucagcagagaaaauucccauucugggguggagggagagggccuccacaagcugggguacauucuucgggacaucagcaaaaucccuggaggcgccauguaugcggaugacacagccgggugggacaccagaauuacagaggaugaccugcacaacgaagagaagaucacccagcagauggaucccgaacaucggcagcucgcuaaugccauuuuuaagcugacguaccaaaacaaagucgugaagguucagcgcccuacccccaaaggcacagugauggacaucauuuccagaaaggaucagcggggaucuggccaggucgggaccuauggacuuaauacauucaccaacauggaggcucaacugauccgccagauggaaggcgagggggugcucagcaaagccgaccuggagaauccgcaccuccucgaaaagaaggugacacaguggcuggagaccaaaggaguugaaagacuuaagcggauggcgaucuccggcgaugacugcguggucaaaccuauugaugaccgcuucgccaacgcucugcucgcccugaacgauauggggaaggugagaaaagacaucccccaguggcaacccagcaagggcuggcaugauuggcagcagguuccuuuuuguucucaccacuuccaugagcuuauuaugaaggacggacggaaacugguggucccgugccgcccccaggacgaacucaucggcagagcucggauuucccaaggggccggauggagccugcgcgagacggcuugucugggcaaggccuacgcgcagaugugggcccucauguauuuucacagacgggaucugcgccuugcuucuaaugccaucugcuccgccgugccuguccauugggugcccacaagcagaaccaccuggucuauucacgcucaucaccaguggaugacaaccgaggacaugcugacaguuuggaaccggguguggaucgaagauaauccuuggauggaggacaaaacgcccgucaccacaugggaagaugugccuuaccucgggaagagagaggaccaaugguguggaucccugaucggccuuaccagccgcgccacaugggcgcagaacauucugaccgcuauccagcagguucggucccucauugggaaugaggaguuccuggauuauaugcccagcaugaaaagauuucgcaaggaggaagagucugaaggcgccaucugguga

SEQ ID NO: 20912 - RNA, 9873 nt, Artificial Sequence
  derived and/or modified CDS sequence (opt5) from DENV-3__JQ920489__SS-prME
accagccugugccucaugaugaugcugcccgcuacccuugcuuuccaccugacgucccgggacggcgagccucggaugaucguggggaagaacgaacgcggaaagucucuccuguuuaagaccgccagcggcaucaauauguguacccuuaucgcgauggaucugggggagaugugcgacgauaccgucacauacaaguguccgcucauuaccgaaguugagcccgaagacaucgauugcugguguaaccugacauccaccugggugacguauggaaccugcaaucaggcuggcgagcaucggcgggacaagcgcucuguggcccuggccccucacgucgggaugggacucgauacaagaacccagacauggaugagcgcugagggcgccuggcggcaggucgaaaagguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaagcccacccuggacaucgagcuccagaagacagaagccacccagcuggcuacacuucgcaagcuguguauugagggaaagaucaccaacauuacgacagauuccagaugcccuacccagggcgaagccauccucccggaggaacaggaccagaauuauguguguaaacacaccuacguggaucggggcugggggaacggaugcggccuguuugggaagggaagccuugucacaugcgcgaaguuccaaugucuggagucuauugagggcaaagccgugcagcacgaaaaucucaaguauaccguuaucaucacagugcauacgggggaccagcaccaggucggaaacgagacccaaggcgugacagcugaaauuacaccccaggccuccacaguugaggcuauccugccugaauacggcacccuggggcucgagugcagcccccgcacgggacuggacuuuaaugagaugauucuucugaccaugaaaaacaaggccuggauggugcauagacagugguucuuugaucucccucugcccuggacaucuggcgccaccacagaaaccccgacguggaauaaaaaggagcuucuggucacauucaaaaacgcucacgcgaagaagcaagaaguggucgugcucgggucccaggagggagccaugcacaccgcucugacaggcgccaccgaaauccagaccagcgggggcacaucuauuuuugccggacaucugaaaugucggcucaagauggacaaacuggagcuuaagggcauguccuaugcuaugugccugaaugccuucguucucaaaaaggaggugagcgaaacgcagcacgggaccauccugaucaaggucgaguacaaaggagaagaugcgccuuguaagauucccuucuccacagaggacggccaagggaaagcucauaacggacgccugaucaccgccaacccuauugugacaaagaaagaggaacccguuaauaucgaggccgaacccccuuuuggcgagucuaacauugugaucgggaucggcgauaaggcucuuaagauuaauugguacaaaaagggaagcuccaucggcaaaauguucgaagccaccgcuagaggggcccggagaauggcgauucucggagacacggccugggauuuuggcagcgucgggggagugcugaacucucugggcaagauggugcaccagaucuucggguccgcuuauacagcccucuuuagcggcguuucuuggauuaugaaaaucggaauuggcguccugcuuaccuggaucgggcugaauagcaagaacaccuccaugucuuucagcugcaucgugauuggaaucauuacacucuaccugggcgcugugguccaggccgacauggggugugugaucaauuggaagggaaaagagcugaagugcggcuccgggauuuuuguuaccaacgaggugcauacauggacggaacaguauaaauuccaagcggauagcccgaagcgccuugccaccgcuaucgccggcgcuugggagaauggagucuguggcauccggucuacaaccagaauggaaaaccuccuguggaaacagauugccaaugagcugaacuacauccucugggaaaauaacauuaagcugacaaucgugguuggggacgugauuggaguccuugagcagggcaaacgcacccugacgccccagccuauggagcucaaguauuccuggaagaccugggggaaagccaagaucgugacagcugaaacccaaaauagcucuuuuaucauugauggacccaacacaccugagugccccuccgcgagccgggccuggaacguuugggaaguggaggacuacggcuucggcgucuuuaccacaaauaucuggcugaaacugagagaaaaguauacccagcuuugugaccaccgccucauguccgcugccgugaaagaugagcgggccgugcacgcugacaugggguacuggauugagucucagaagaacggaagcuggaagcuggaaaaagccucccugaucgaggucaagacgugcacauggccgaaaucucauacccucuggagcaauggcguucuggaauccgauaugauuaucccuaagagccuugcggggcccaucucucagcacaacuacagaccuggauaucauacccaaacagcuggccccuggcaccuggggaaacucgagcuggacuucaauuacugcgagggaaccacgguggugauuacagaaaacuguggcauccgcggcccuucccugcggaccacaaccgucagcgggaaacuuauucacgaguggugcuguagaucuugcacacugcccccgcugcgcuauaugggagaagauggcuguugguacgggauggagauccggccuauuaaugaaaaggaggagaacauggugaaaucccugguuagcgccggaucuggcaagaccgacaauuuuacgaugggggugcucugccuggccauccuuuucgaagaggucaugagaggaaaauucggcaagaaacauaugauugcuggcgcccuguuuaccuucgugcuccugcugagcgggcagaucacauggcgggauauggcgcacacccuuaucaugauuggauccaacgcuagcgaccgcaugggcauggggguuacauaucuggcccucaucgccaccuuuaagauucagcccuuccuggcucucggauuuuuccugagaaaacuuacgucucgggaaaaucugcuccugggcguggggcuggccauggcuacaacccuucaacugcccgaggauaucgaacagauggccaacggaauugcgcucggccugauggcccucaaacugaucacacaguuugagaccuaccagcuuuggaccgcucugaucucccucauguguagcaauacaauuuucacgcugaccgucgccuggagaacagcuacccugauccuugccgugauuucccugcucccuguuugccaaucuagcuccaugcgcaagacagacuggcugccgaugaccguggccgcuaugggcgugcccccucucccccuguuuaucuucucucuuaaagauacgcugaagcggagaagcuggccucugaacgagggggugauggcggugggacucgucuccauucuggccucuagcuuucuucgcaaugacguucccauggcuggcccucugguggccgggggacuccugaucgccuguuaugugaucacaggcaccuccgcugaucucaccgucgaaaaagccgcggacgugacaugggaggaagaggcugaacagaccgggguuagccauaaccugaugauuacaguggacgaugacggaacgaugagaaucaaggaugacgagaccgagaacauucuuacaguccugcugaaaaccgcccuccugaucgugucuggcauuuuccccuacuccaucccggccacacuucugguuuggcacaccuggcagaagcagacgcaacggagcggcgugcucugggaugucccuucucccccugaaacccagaaggcugagcuggaagaggggguguaccgcauuaaacagcagggaaucuuuggcaagacacaagucggggugggaguucagaaagagggcguguuccauaccauguggcacgucacaagaggggccgugcucacccacaauggaaagcggcuggaacccaacugggcgaauguuaaaaaggaccuuaucuccuauggcggcggguggaagcugagcgcucaguggcaaaaaggagaggaagugcaggucauugccguggagccgggcaagaacccuaaaaauuuccagacaaugcccgggaucuuucagacgaccacaggagaaauuggcgccaucgcucuggauuucaagccugggaccucuggaucccccauuaucaaccgcgagggcaaagugguuggccucuacgggaauggagucgugaccaagaacggcggguaugugagcggaaucgcccaaacaaaugcugagcccgacggcccuacgccggaacuggaggaagagauguuuaagaaaagaaaccuuaccauuauggaucugcaucccggguccggcaagacacggaaauaccucccugccaucguccgcgaagcgauuaagagacggcugcgcacccucauccuggcccccacaagagugguugcugccgagauggaggaagcucuuaaaggacugccuauucgguaucagaccacggccacaaagagcgagcacaccggcagagaaaucguggaccugaugugccaugccaccuucacaaugcgccuccugucucccguccgggugccuaauuacaaccuuaucguuauggaugaggcucacuuuaccgacccggcgagcauugccgcuagaggguauaucuccacacgcgugggaaugggcgaagccgccgcuauuuucaugaccgccacgcccccugggacagcggaugcuuuuccccagucuaaugccccuauccaggacgaggagcgggacauucccgaaagaagcuggaacuccggaaaugaguggaucaccgauuucgccggcaagacagucugguuugugccgucuauuaaagcugggaacgacaucgccaacugucugcgcaagaauggcaaaaagguuauccaacucagccggaaaaccuucgauacggaauaccagaagaccaagcugaacgacugggauuuuguggucacaaccgacauuuccgagaugggagcgaauuucaaagccgauagagugaucgacccucgccggugccugaagcccgugauucucacagauggccccgagagagucauccuugcugggccuaugcccguuaccguggccucugcugcccagcggcgcggaagagugggccggaacagccagaaagaaaaugaccaauacauuuucacagggcagccucugaacaaugaugaggaccaugcucacuggaccgaagccaagaugcugcucgacaacaucaauacgccggagggaaucauucccgcgcuguuugaaccugagcgcgagaaauccgccgcuaucgauggcgaauauagacuuaagggggagagccggaaaacauucgucgaacugaugagacgcggcgaccuccccguguggcuggcccacaagguugcuucugagggaauuaaguacaccgaucggaaauggugcuuugacggcgaaagaaacaaucagauccuggaggagaacauggauguggaaauuuggacccgcgagggggaaaagaaaaagcuccggccuagauggcuugacgcccgcacauauuccgauccccuggcccugaaagaguucaaggacuuugcugcgggaagaaagagcaucgcccucgaucuggucaccgaaaucggcagagugccgucucaucuugcucaccgcacaagaaaugcccuggacaaccucguuaugcugcauacguccgagcacgggggacgggccuaccgccacgcuguggaggaacugccugagaccauggaaacacuccuucugcugggccucaugauucugcuuaccggcggggccaugcuguuccucaucagcggaaaaggcauugggaagacauccaucggacugauuugugucguggcgucuagcggcaugcuguggauggccgaugucccccuccaguggaucgcuuccgccauugugcuugaguuuuucaugaugguucugcugaucccugagcccgaaaaacaaagaaccccucaggacaaucagcucgcuuauguggugaucgggauucugacgcuugccgcgaucgucgccgcuaacgagaugggacugcucgaaaccacaaagcgggaucugggcaugagcaaagagcccggcguugugucuccgaccuccuaccuggacguggaccuccauccugccagcgcuuggacacuuuaugccgucgcuaccacggugauuacacccaugcugcgccacaccaucgaaaauucuacagccaacguuagccuggcggccauugcuaaccaagccgugguccucauggggcuggauaagggauggcccaucuccaagauggaccuuggcgugccucugcucgcucuggggugcuacucucaggucaauccgcugacccucaccgccgccgugcuucugcugguuacacauuacgcgaucauuggacccggccuccaggcuaaagccacgagagaggcucagaagcggaccgccgccgggaucaugaaaaacccuacaguggauggaauuaugaccaucgaccuggaucccgucauuuaugacagcaaguuugagaaacaacuuggccaggugaugcugcucguucugugugcugugcagcugcuccuuaugagaacauccugggccuucugcgaagcgcugacccuggccacgggcccuaucacaacccucugggaggggucucccggaaaguuuuggaauaccacaaucgcugucagcauggccaacauuuuccgcggcuccuaccuggcuggggccggacuugcguuuagcaucaugaagucugugggcaccgggaaacggggaacaggcucccagggcgaaacgcugggggagaaguggaaaaagaaacucaaucaacugagcagaaaggaguucgaucuguauaaaaaguccggaauuaccgagguggaccgcaucgaggccaaggaaggccucaaaagaggggaaauuacacaccaugcuguuucuagaggaagcgccaaacuucagugguucgucgaacggaacauggugaucccugagggccgcgugauugaucugggguguggaagaggcggcugguccuacuauugcgcugggcugaaaaaggucaccgaaguucggggauacacaaaaggcgggccgggacacgaggagcccgugccuaugucuaccuauggcuggaauaucgugaagcucaugagcgggaaggacgucuuuuaccugcccccugaaaaaugugauacgcuucugugcgacaucggagaguccagccccucuccgaccguggaagagucccgcacaauuagaguucucaagaugguggagccuuggcugaaaaacaaucaguucuguaucaagguccugaaccccuacaugcccaccgugauugaacaccucgagcggcuucagcgcaaacauggcggcaugcugguuagaaauccucugagccggaacucuacacacgaaauguauuggaucuccaaugggaccggaaacauugugagcucugucaauauggugagccgccuccugcuuaacagauuuacaaugacccaucggagacccacgaucgagaaggauguggaccugggcgccgggacacgccacgucaacgcugaaccugagaccccgaauaugaacguuaucggagagcggauuagacgcaucaaggaggaacacuccucuaccuggcauuacgacgaugaaaaucccuauaaaacaugggccuaccacggcagcuaugaggugaaggcgacgggguccgccagcuccaugauuaacggaguggucaaacuccugaccaagccuugggacgugguucccauggugacacaaauggcuaugaccgauacaaccccuuucggccagcagcgggucuuuaaagaaaagguggacacaagaacaccccgcccgaugccuggcacgcggaagguuauggagaucaccgccgaguggcuguggagaacacucgggcgcaauaaacggcccagacugugcacccgcgaagaguucauuaagaaagugcggacaaacgcugccaugggagccgucuuuaccgaagagaaucaaugggauucugcgagagcugccguggaagacgaggaguucuggaaacuuguugaucgcgaaagagagcugcauaaacucggcaagugugggagcugcguguacaacaugaugggaaaacgggaaaagaagcugggcgaguuugggaaagccaagggcucccgcgcuaucugguauauguggcuuggagccagauaccuggaguucgaagcucucggcuuucugaaugaggaccacugguucucucgggaaaacagccauuccggggucgagggagaaggccugcacaaacucggguacauccugagagauauuucuaagaucccuggaggcgccauguaugcggacgauacggccgggugggacacacggauuaccgaggacgaucuucacaaugaggagaaaauuacacagcagauggaccccgaacaucgccagcuggcuaacgccauuuuuaagcucaccuaccaaaauaagguggucaaagugcagagaccuacgcccaagggcaccguuauggauaucaucagccggaaagaccagcgcggauccggccagguggggacauauggacugaacaccuucacaaauauggaagcucaacuuauuagacagauggagggcgaagggguccugagcaaggccgaucucgagaacccgcaccuccuggagaaaaaggugacccaguggcucgaaacaaagggaguggagcggcugaaacgcauggcgaucucuggcgacgauugcguugugaagccuauugacgauagauucgccaacgcccuucuggcccucaaugacauggggaaaguccggaaggauaucccccaguggcaacccuccaaaggcuggcaugacuggcaacaggugccuuuuuguagccaccacuuccaugaacugauuaugaaggauggacgcaaacuuguugugccgugcagaccccaggacgagcugaucggccgggcucgcauuucucaaggggccggauggucccucagagaaaccgcuugucugggcaaagccuacgcgcagaugugggcccugauguauuuucaccggcgcgaccucagacuggcuagcaacgccaucugcucugccgucccugugcauuggguccccacgucccggacaaccuggagcauccacgcucaucaccaguggaugaccacagaggauaugcuuaccguguggaauagaguuuggauugaggacaacccuuggauggaagauaagacacccgugacgaccugggaggacgucccuuaccuggggaaacgcgaagaucaaugguguggaucccucaucggccugacaagccgggccaccugggcgcagaauauucuuacagcuauccaacaggugagaucucugauugggaacgaggaguuccucgacuauaugcccagcaugaagcgcuuucggaaagaagaggaauccgagggcgccaucugguga

SEQ ID NO: 20913 - RNA, 9873 nt, Artificial Sequence
  derived and/or modified CDS sequence (opt5) from DENV-3__KF824902__SS-prME
accucccugugccucaugaugaugcugcccgccacccuugcuuuccaccugacgucccgggacggcgagccucggaugaucguggggaagaacgaacgcggaaagucucuccuguuuaagaccgccagcggcauuaauauguguacccuuaucgcgauggaucugggggagaugugcgacgauaccgucaccuacaaauguccgcucauugcugaaguugagcccgaagacaucgauugcugguguaaccugaccuccacaugggugaccuauggaacgugcaaucaggccggcgagcaucggcgggacaagcgcucuguggcccuggcuccucacgucgggaugggacucgauacccggacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuauggcuaugagauguguuggagugggcaaccgggacuuugucgaagggcugagcggagccacauggguggaugugguccuggagcauggcgggugcguuaccaccauggcuaagaauaaacccacacucgacaucgagcugcagaagacggaagccacccagcuugcgacacugcgcaaacucuguauugagggaaagaucaccaacauuacaaccgauuccagaugcccuacgcagggcgaagccauccugccggaggaacaggaccagaauuauguguguaaacacacauacguggaucggggcugggggaacggaugcggccuuuucgggaagggaagccuggugaccugcgcuaaguuucaaugucucgagucuauugagggcaaagugguucagcacgaaaaucugaaguauaccgugacaaucaccguccauacaggggaccagcaccaggugggaaacgacacgcaaggcguuaccgccgagaucacaccccaggcuuccaccguggaagccauucugccugaguacggcacacucgggcuggaaugcagcccccgcaccggacuugauuucaaugagaugauccugcucacgaugaaaaacaaggccuggaugguccauagacagugguuuuucgaccugccucuucccuggaccucuggcgcuacaaccgagacaccgaccuggaaucggaaagaacugcucgugacguuuaagaacgcgcacgccaaaaagcaagaggucgugguucuggggucccaggaaggagcuaugcacacagcccugaccggcgccacagagauucagaauagcgggggcaccucuaucuucgcuggacaucucaagugucgccugaaaauggauaaacuugaacugaaaggcauguccuaugccaugugccucaacaccuuugugcugaagaaagaggucagcgagacacagcacgggacgauucugaucaagguggaauacaagggagaggacgcgccuuguaaaauccccuucuccaccgaagauggccaagggaaggcucauaacggaagacuuauuacagccaauccuguugugaccaaaaaggaggagcccgucaacaucgaagccgagcccccuuucggcgaaucuaauauugugaucgggauuggcgacaaagcucucaagaucaacugguacaagaaaggaagcuccaucggcaagauguuugaggccacagcuagaggggccagacgcauggcgauucugggagauaccgccugggacuucggcagcgucggcgggguucucaauucucucgggaaaaugguccaccagaucuuuggguccgcuuauacggcccuguucggcggagugagcuggauuaugaagaucggcauuggggugcuucugacauggaucggacucaacucuaaaaauaccagcauguccuuuucuugcauugucaucggcaucauuacccuguaccuggggacagugguucaggcugauaugggaugugugaucaacuggaagggcaaggaacuuaaaugcgggagcggcauuuucgucaccaaugaggugcauacauggacggagcaguauaaguuucaagccgacuccccgaaacggcucgcgaccgccaucgcuggagccugggaaaacggcguuugugggauuagaagcacaacccgcauggagaaucugcuguggaagcagaucgcuaacgaacucaauuacauccugugggagaacaauauuaaacuuacaguggucgugggagauaucauuggcguucuggaacaggggaagcgggcccucacaccccagccuauggagcugaaauauucuuggaagacguggggaaaggccaaaaucgugaccgcugagauucaaaacuccagcuucaucaucgacggccccaacacaccugaaugccccucugcguccagagccuggaaugucugggagguggaagacuacggcuuugggguguucaccacaaacauuuggcugaaacuucgcgaggucuauacccagacaugugaucaccggcucaugagcgcugccaucaaagacgaaagagccguucacgcugauaugggauacuggauugagucccagaagaauggcucuuggaaacuggagaaggccagcuuuaucgaagugaagaccugcacguggccgaaaacacauacccugugguccaacggggugcucgagucugacaugauuaucccuaagagccuggcgggacccaucucccagcacaaucaucgcccuggcuaccacacccaaacagcugggcccuggcaccuuggaaaacuggaacucgauuucaacuauugcgagggcaccacggucgugauuacagagaauuguggcacccgggggccuagccugagaacaaccacaguuucuggaaagcugauccaugaauggugcugucgcuccugcacccuucccccgcuccgguacaugggcgaggacggguguugguauggaauggaaauuagaccuaucaacgagaaagaagagaauauggucaagagccuggugucugccggcuccgggaagguggauaacuuuacgaugggaguucugugccucgccauucuguucgaggaagugaugcggggcaaauucggcaagaaacacaugaucgcugggguccuuuuuaccuucaugcugcuccugagcggacagauuacauggcgcgacauggcccauacccugaucaugaucggcucuaaugcgagcgauagaauggggaugggagugacauaccuugcucugauugccaccuuuaagauccagcccuuccucgcccugggcuuuuuccuccggaaacugacguccagagagaaccuucugcucgggguuggacuggcuauggccacaacccugcaacuucccgaagacauugagcagauggcuaauggcaucgcccugggccucauggcgcugaagcucauuacacaguuugaaaccuaucagcuguggaccgcccuugugagccugacauguucuaacacgaucuucacccucacagucgcuuggcgcaccgccacacugauccuggcuggggugucccuucugccugugugccaaagcuccucuaugcggaagaccgauuggcucccggucgccguugccgcuaugggagugcccccucugccccucuuuauuuucagccugaaagacacgcuuaagagacgcuccuggccucugaaugagggcgugauggcggucgggcuggugucuauccucgccagcucccugcuuagaaacgauguucccauggcuggaccucugguggccggcgggcuccugauugccuguuacgucaucacaggaaccucugcugaccucaccguggagaaagccgcggacguuacaugggaagaggaagcugagcagaccggcgugagccacaaccugaugauuacagucgaugacgauggcacgaugcggaucaaggacgaugaaaccgagaauauccuuacagugcugcugaaaaccgcccuccugauugucuccgggaucuuucccuauagcauuccggccacacuucugguguggcauaccuggcagaagcagacgcaacgcucuggaguucucugggacgugccuucucccccugagacccagaaagcugaacuggaggaaggcgucuacagaaucaagcagcaggggauuuucggaaagacacaagugggcguuggggugcagaaagagggagucuuucacaccauguggcacgugacacggggcgccgugcucacccauaacggcaagcgccuggagcccaauugggcgagcguuaaaaaggaucuuaucagcuacgggggaggcuggagacuguccgcucaguggcaaaaaggggaagagguccaggugauugccguggaaccgggacggaacccuaagaauuuccagacaaugcccggcaucuuccagacgaccacaggggagaucggagccauugcucuggacuuuaagccuggcaccagcggcucucccaucauuaaccgcgaagggaaagucgugggacucuauggcaaugggguugugaccaagaacggaggcuacgucuccgggaucgcccaagcuaaugccgagcccgagggcccuacaccggaacuggaggaagagauguucaaaaagagaaaccuuacgauuauggaucugcaccccggaagcggcaaaacccggaaguaucucccugcgaucgugcgcgaagccaucaagagacggcugagaacacucauucuggcucccacccgcguuguggccgcugagauggaggaagcccuuaaagggcugccuauccgguaccagacaaccgccacgaaguccgagcauacaggaagagaaauugucgugcugaugugccacgcuaccuuuaccaugcgccuccugagccccguucgggugccuaauuauaaccuuaucauuauggacgaggcgcauuucacagauccggccucuaucgcugccagaggcuacaucagcacccgcgucgggaugggagaagccgcugccauuuuuaugacagcgacacccccuggcacggcugaggccuucccccaguccaaugccccuauccaggacgaggaacgggauauucccgagagaucuuggaacagcgggaaugaauggaucacagacuuugugggcaaaaccgugugguucgucccguccauuaaggcuggaaacgacaucgccaacugucugcgcaaaaauggcaagaagguuauucaacucucucggaaaacauuugauaccgaguaucagaagacgaaacugaacgacugggauuucguggugaccacagacaucagcgagaugggggcgaauuuuaaggccgauagagucaucgacccucggcgcugccugaaacccgugauucucaccgauggacccgaaagaguuauccuugcuggcccuaugcccgugacagccgcuuccgccgcucagcggcgcgggagagucggacggaacccucagaaggagaaugaccaauacauuuucaugggccagccgcugaacaaugaugaagaccacgcccacuggaccgaggcgaagaugcugcucgauaacaucaauacacccgaagggauuaucccugcccuguucgagcccgagagagaaaaaucugcugccaucgacggcgaguaccgccuuaagggagaaagccggaaaaccuuuguggagcugaugagacgcggcgaccucccuguuuggcuggcucauaagguggccuccgaagggauuaaauauacggaucggaaguggugcuucgacggagagagaaacaaucagauccuggaggaaaacauggaugucgagauuuggacaaaagaaggcgagcgcaagaagcuccggcccagauggcuugacgcccgcaccuacagcgauccgcuggcucugaaagaauuuaaggacuucgcggccgggagaaaaucuaucgcucucgaucuggugaccgagauuggacgggucccuucccaccuugcccaucgcacaagaaaugcccuggacaaccucgugaugcugcacaccagcgagcacggcggccgggcuuaucgccaugccguugaggaacugcccgaaacaauggagacgcuccuucugcuggggcucaugauccugcuuaccggaggcgcgaugcuguuucucaucucugggaagggaauuggcaaaacauccaucgggcugauuugugugaucgugagcuccggaaugcuguggauggccgaugucccucuccaguggauugcuucugccaucguucuugaguucuuuaugauggugcugcugauucccgaaccugagaagcaaagaacaccccaggacaaucagcucgcuuacguggucaucggcauccugacacuugccgcgauuguggccgcuaacgaaaugggccugcucgagaccacgaagcgggaucuggggaugagcaaagaaccgggaguuguguccccuaccagcuaucuggacgucgaucuccaccccgccucugcuuggacacuuuacgccguggcuaccacagucaucacccccaugcugagacauacgauugaaaauuccacagccaacgugagccuggcggccaucgcuaaccaagccguugugcucaugggccuggacaagggguggccuauuucuaaaauggaccuuggagucccgcugcucgcucugggcugcuauagccaggugaauccccugacccucacagccgccguucuucugcuggugacccacuacgcgaucaucgggccuggacuccaggcuaaggccacccgcgaggcucagaaacggacagccgccggcauuaugaagaaccccacggucgauggcaucaugaccauugaccuggauccugugaucuacgacuccaaguucgaaaaacaacuuggacaggugaugcugcucguucugugugcuguccagcugcuccuuaugagaacaucuugggcccugugcgaggcgcugacccucgccacaggacccauuaccacgcugugggaaggcagcccugggaaguuuuggaauacaaccaucgcuguguccauggccaacaucuuccgcggaucuuaucuugcuggcgccgggcuggcguuuagcauuaugaaauccgugggaaccggcaagcggggcacagggagccagggagagacccucggcgaaaaauggaagaagaaacugaaucaacugucuagacgggaguucgagcucuacaagaaauccgggaucacagaagucgaucgcacggaggccaaggaaggacuuaaaagaggcgagaccacacaucacgcuguuagccggggguccgccaagcugcagugguuuguggaacgcaacauggugauuccggagggaagagucaucgaccugggcuguggcagagggggauggucuuauuacugcgcuggccucaaaaaggugaccgagguucgcggguauacaaagggaggccccgggcacgaagaaccugugcccaugagcaccuacggauggaauacggucaaacugauguccggcaaggauguguucuaucuuccucccgaaaaaugugacacccugcucugcgauauuggcgagucuagcccguccccuacaguugaggaaagcagaaccauccgggugcugaagauggucgagcccuggcugaaaaacaaucaguucuguauuaaggugcucaaccccuacaugccuacagugaucgaacaucuugagcgccugcagagaaagcacgggggaaugcugguccggaauccccucucuagaaacuccacccaugaaauguacuggaucagcaauggcacagggaacauuguuucuuccgugaauauggugagccgccugcuucugaaccgguuuaccaugacgcacagacgcccuacaaucgagaaagacgucgaucucggagccggcacccggcacgugaacgcugagccggaaacccccaauauggacguuauuggggagagaaucaagcgcauuaaagaagaacauucuagcacauggcacuaugaugacgaaaacccuuacaagacgugggccuaucauggauccuacgaggugaaagcgaccggcucugccagcuccaugaucaauggcgucgugaagcugcugacaaagcccugggacguugugccuauggucacccaaauggcuaugacagauaccacacccuucgggcagcagcggguguuuaaagagaagguugacaccagaacgccgcgcccuaugcccggaacccggaaagugauggaaaucacagccgaguggcucuggagaacccugggccgcaacaagcggccuagacuuugcacacgcgaagaguucaccaaaaaggucagaacgaaugcugccaugggggccguguuuacagaagagaaccaaugggagagcgcgcgggcugccgucgaagaugaggaguucuggaagcuggugggacgcgagagagagcuccacaaacugggcaaguguggguccugcguuuauaauaugaugggcaaacgggaaaagaaacuuggagaguuuggcaaggccaaagggucuagagcuauuugguacauguggcugggagcccgguaucucgaguucgaggcucugggcuuucugaacgaagaccauugguucagccgcgaaaauuccuacucugggguggagggagaaggccuccacaagcugggguacauccuuagagauauuagcaagauccccggcggagccauguaugcggacgauaccgccggcugggacacacggauuaccgaggaugaccugcacaacgaagagaaaaucacgcagcagauggauccugaacaucgccagcucgcuaaugccaucuuuaagcugaccuaccaaaacaaagucgugaaggugcagagacccacaccgaaagggaccguuauggacauuaucucccggaaggaccagcgcggaucuggccagguggggacauauggacuuaauaccuucacaaacauggaggcucaacugauuagacagauggagggcgaagggguccucagcaaggccgaucuggagaauccucaucugcuggagaagaagaucacccaguggcuggagacgaaaggcguggaacggcuuaagcgcauggcgauuuccggagacgauugcguugugaaacccaucgacgauagauuugccaacgcucugcucgcccugaacgacaugggcaagguccggaaggauaucccccaguggcaaccuagcaaaggguggcacgacuggcaacaggugccguucuguucucaccacuuccaugagcuuauuaugaaggauggacgcaaacuggucgugcccugcagaccucaggacgagcucaucggccgggcucgcauuucccaaggggccggauggagccugaaggaaacagcuugucugggcaaagccuacgcgcagauguggucucucauguauuuucacagacgggaucugagacuugccuccaaugcuaucugcagcgccguucccgugcauugggucccuaccucucgcaccacaugguccauucacgcccaucaccaguggaugaccacagaggacaugcugacgguguggaaccggguuuggaucgaagauaaucccuggauggaggacaagaccccugugacaaccugggaggacguccccuaccucgggaagagagaagaucaaugguguggcagccugauuggacuuacaucccgcgcuaccugggcccagaacauccugacggcgauccaacaggugcggagccucauuggcgacgaggaguuccuggauuauaugccgucuaugaaaagauuucgcaaggaggaagagagcgagggggcuaucugguga

SEQ ID NO: 20914 - RNA, 9873 nt, Artificial Sequence
  derived and/or modified CDS sequence (opt5) from DENV-3__KF824903__SS-prME
accagccugugccugaugaugaugcugcccgccacccuugcuuuccaccugacgagccgggacggcgaaccucggaugaucguggggaagaacgaacgcggaaagucucuccuguuuaagaccgccagcggcauuaauauguguacccuuaucgcgauggaucugggggagaugugcgacgauaccgucacauacaaguguccgcucauugcugaaguugagcccgaagacaucgauugcugguguaaccugaccuccacaugggugaccuauggaacgugcaaucaggccggcgagcaccggcgggacaagcgcucuguggcccuggcuccucacgucgggaugggacucgauacccggacacaaaccuggaugagcgccgagggcgcuuggagacagguggaaaagguugagacaugggcccugcgccaucccggcuucaccauucuugcgcuguuucucgcccacuacaucgggacgucccugacacagaagguggucaucuucauucuucugaugcucgugaccccuucuauggcuaugagauguguuggagugggcaaccgggacuuugucgaagggcugagcggagccacauggguggaugugguccuggagcauggcgggugcguuaccaccauggcuaagaauaaacccacacucgacaucgagcugcagaagacggaagccacccaacuugcgacacugcgcaaacucuguauugagggaaagaucaccaacauuacaaccgauuccagaugcccuacgcagggcgaagccauccugccggaggaacaggaccagaauuauguguguaaacacacauacguggaucggggcugggggaacggaugcggccuuuucgggaagggaagccuggugaccugcgcuaaguuucaaugucucgagucuauugagggcaaagugguucagcacgaaaaucugaaguauaccgugacaaucaccguccauacaggggaccagcaccaggugggaaacgacacgcaaggcguuaccgccgagaucacaccccaggcuuccaccguggaagccauucugccugaguacggcacacucgggcuggaaugcagcccccgcaccggacuugauuucaaugagaugauccugcucacgaugaaaaacaaggccuggaugguccauagacagugguuuuucgaccugccucuucccuggaccucuggcgcuacaaccgagacaccgaccuggaaucggaaagaacugcucgugacguuuaagaacgcgcacgccaaaaagcaagaggucgugguucuggggucccaggaaggagcuaugcacacagcccugaccggcgccacagagauucagaauagcgggggcaccucuaucuucgcuggacaucucaagugucgccugaaaauggauaaacuugaacugaaaggcauguccuaugccaugugccucaacaccuuugugcugaagaaagaggucagcgagacacagcacgggacgauucugaucaagguggaauacaagggagaggacgcgccuuguaaaauccccuucuccaccgaagauggccaagggaaggcucauaacggaagacuuauuacagccaauccuguugugaccaaaaaggaggagcccgucaacaucgaagccgagcccccuuucggcgaaucuaauauugugaucgggauuggcgacaaagcucucaagaucaacugguacaagaaaggaagcuccaucggcaagauguuugaggccacagcuagaggggcuagacgcauggcgauucugggagauaccgccugggacuucggcagcgucggcgggguucucaauucucucgggaaaaugguccaccagaucuuuggguccgcuuauacggcccuguucggcggagugagcuggauuaugaagaucggcauuggggugcuucugacauggaucggacucaacucuaaaaauaccagcauguccuuuucuugcauugucaucggcaucauuacccuguaccuggggacagugguucaggcugauaugggaugugugaucaacuggaagggcaaggaacuuaaaugcgggagcggcauuuucgucaccaaugaggugcauacauggacggagcaguauaaguuucaagccgacuccccgaaacggcucgcgaccgccaucgcuggagccugggaaaacggcguuugugggauuagaagcacaacccgcauggagaaucugcuguggaagcagaucgcuaacgaacucaauuacauccugugggagaacaauauuaaacuuacaguggucgugggagauaucauuggcguucuggaacaggggaagcgggcccucacaccccagccuauggagcugaaauauucuuggaagacguggggaaaggccaaaaucgugaccgcugagauucaaaacuccagcuucaucaucgacggccccaacacaccugaaugccccucugcguccagagccuggaaugucugggagguggaagacuacggcuuugggguguucaccacaaacauuuggcugaaacuucgcgaggucuauacccagacaugugaucaccggcucaugagcgcugccaucaaagacgaaagagccguucacgcugauaugggauacuggauugagucccagaagaauggcucuuggaaacuggagaaggccagcuuuaucgaagugaagaccugcacguggccgaaaucccauacacuguggucuaacggggugcucgagagcgacaugauuaucccuaagucccuggcgggacccaucagccagcacaaucaucgcccuggcuaccacacccaaaccgcugggcccuggcaccuuggaaaacuggaacucgauuucaacuauugcgagggcacaaccgucgugauuacggagaauuguggcacacgggggccuucucugagaaccacaaccguuuccggaaagcugauccaugaauggugcugucgcagcugcacacuucccccgcuccgguacaugggcgaggacggguguugguauggaauggaaauuagaccuaucaacgagaaagaagagaauauggugaagucucuggucuccgccggcagcgggaagguggauaacuuuaccaugggaguucugugccucgccauucuguucgaggaagugaugcggggcaaauucggcaagaaacacaugaucgcugggguccuuuuuacguucaugcugcuccugucuggacagauuaccuggcgcgacauggcccauacacugaucaugaucggcagcaaugcguccgauagaauggggaugggagugaccuaccuugcucugauugccacauuuaagauccagcccuuccucgcccugggcuuuuuccuccggaaacugaccagcagagagaaccuucugcucgggguuggacuggcuauggccacgacacugcaacuucccgaagacauugagcagauggcuaauggcaucgcccugggccucauggcgcugaagcucauuacccaguuugaaacauaucagcuguggaccgcccuugugucucugaccuguuccaacacaaucuucacgcucaccgucgcuuggcgcacagccacccugauccuggcuggggugagccuucugccugugugccaauccucuagcaugcggaagacagauuggcucccggucgccguugccgcuaugggagugcccccucugccccucuuuauuuucucccugaaagacacccuuaagagacgcucuuggccucugaaugagggcgugauggcggucgggcuggugagcauccucgccuccucucugcuuagaaacgauguucccauggcuggaccucugguggccggcgggcuccugauugccuguuacgucaucacgggaacaagcgcugaccucaccguggagaaagccgcggacguuaccugggaagaggaagcugagcagacaggcgugucccacaaccugaugauuaccgucgaugacgauggcacaaugcggaucaaggacgaugaaacggagaauauccuuaccgugcugcugaaaacagcccuccugauugucagcgggaucuuucccuauucuauuccggccacccuucugguguggcauacauggcagaagcagacccaacgcuccggaguucucugggacgugccuucucccccugagacgcagaaagcugaacuggaggaaggcgucuacagaaucaagcagcaggggauuuucggaaagacccaagugggcguuggggugcagaaagagggagucuuucacacaauguggcacgugacccggggcgccgugcucacacauaacggcaagcgccuggagcccaauugggcguccguuaaaaaggaucuuaucuccuacgggggaggcuggagacugagcgcucaguggcaaaaaggggaagagguccaggugauugccguggaaccgggacggaacccuaagaauuuccagaccaugcccggcaucuuccagacaacgaccggggagaucggagccauugcucuggacuuuaagccuggcacaucuggcucccccaucauuaaccgcgaagggaaagucgugggacucuauggcaaugggguugugaccaagaacggaggcuacgucagcgggaucgcccaagcuaaugccgagcccgagggcccuaccccggaacuggaggaagagauguucaaaaagagaaaccuuacaauuauggaucugcaccccggauccggcaaaacgcggaaguaucucccugcgaucgugcgcgaagccaucaagagacggcugagaacccucauucuggcucccacacgcguuguggccgcugagauggaggaagcccuuaaagggcugccuauccgguaccagaccacagccaccaagagcgagcauacgggaagagaaauugucgagugcaugugucacgcuacauuuaccaugcgccugcucucucccgugcggguuccuaauuauaaccugaucauuauggacgaagcgcauuucaccgauccggccagcaucgcugccagaggcuacaucuccacacgcguggggaugggagaggccgcugccauuuuuaugaccgcgacacccccuggcaccgcugaggccuucccccagucuaaugccccuauccaggacgaagaacgggauauucccgaaagaagcuggaacuccgggaaugaguggaucacggacuuugucggcaaaacagugugguucgugccgucuauuaaggcuggaaacgacaucgccaacugccuucgcaaaaauggcaagaaggucauucaacugagccggaaaaccuuugauacagaguaucagaagaccaaacucaacgacugggauuucguugugacgaccgacaucuccgaaaugggggcgaauuuuaaggccgauagagugaucgacccucggcgcugccugaaacccgucauucugacagauggacccgagagagugauccucgcuggcccuaugcccguuaccgccgcuucugccgcucagcggcgcgggagagugggacggaacccucagaaggaaaaugaccaauacauuuucacaggccagccgcuuaacaaugaugaggaccacgcccacuggaccgaagcgaagaugcugcuggauaacaucaauacacccgaggggauuaucccugcccucuucgagcccgaaagagagaaaagcgcugccaucgacggcgaauaccgccugaagggagagucccggaaaaccuuugucgaacuuaugagacgcggcgaccugccuguguggcucgcucauaagguugccagcgaggggauuaaauauacggaucggaagugguguuucgacggagagagaaacaaucagauccuggaagagaacauggauguggaaauuuggacaaaagagggcgaacgcaagaagcugcggcccagauggcucgacgcccgcaccuacucugauccgcuugcucugaaagaguuuaaggacuucgcggccgggagaaaauccaucgcucuggaucucgucaccgagauuggacgggugccuagccaccuggcccaucgcacaagaaaugcccuugacaaccuggucaugcuccacaccucugaacacggcggccgggcuuaucgccaugccguggaggaacugcccgagacaauggagacgcugcuccuucuggggcugaugauccuccugaccggaggcgcgaugcuuuuucugaucuccgggaagggaauuggcaaaacaagcaucgggcucauuugcguuaucguguccucuggaaugcuguggauggccgaugugccucugcaguggauugcuagcgccaucguccucgaguucuuuaugaugguucuucugauucccgagccugaaaagcaaagaacaccccaggacaaucagcuggcuuacguggugaucggcauccucacacuggccgcgauugucgccgcuaacgagaugggccuucuggaaaccacgaagcgggaucucgggauguccaaagagccgggagugguuagcccuaccucuuaucuggacguggaucugcaccccgccuccgcuuggacacucuacgccgucgcuaccacagugaucacccccaugcuuagacauacgauugagaauagcacagccaacgucucucuggcggccaucgcuaaccaagccgugguucugaugggccucgacaagggguggccuauuagcaaaauggaccugggagugccgcuucuggcucucggcuguuauucccaggucaauccccugacccugacagccgccgugcuccuucugguuacccacuacgcgaucaucgggccuggacugcaggcuaaggccacccgcgaagcucagaaacggacagccgccggcauuaugaagaaccccacgguggauggcaucaugaccauugaccucgauccugucaucuacgacucuaaguucgagaaacaacugggacaggugaugcuucuggugcucugcgcuguucagcugcugcucaugagaacaagcugggcccuuugugaagcgcugacccuggccacaggacccauuaccacgcucugggagggcuccccugggaaguuuuggaauacaaccaucgcugucucuauggccaacaucuuccgcggaagcuaucuggcuggcgccgggcuugcguuuuccauuaugaaaagcgugggaaccggcaagcggggcacagggucucagggagaaacccugggcgagaaauggaagaagaaacucaaucaacuguccagacgggaguucgaacuguacaagaaaagcgggaucacagagguggaucgcacggaagccaaggagggacucaaaagaggcgaaaccacacaucacgcugucucccgggggucugccaaacuucagugguuuguugagcgcaacauggugauuccggagggaagagugaucgaccugggcugcggcagagggggauggagcuauuacugugcuggccugaaaaaggucaccgaagugcgcggguauacaaagggaggccccgggcacgaggaaccuguucccauguccaccuacggauggaauacggugaaacucaugucuggcaaggaugucuucuaucugccucccgagaaaugcgacacccuucugugugauauuggcgagagcuccccgagcccuacaguggaagagucuagaaccauccggguucucaagaugguggaacccuggcugaaaaacaaucaguucugcauuaagguccugaaccccuacaugccuacagugaucgagcaucucgaacgccuucagagaaagcacgggggaaugcuggugcggaauccccuguccagaaacagcacccaugagauguacuggaucucuaauggcacagggaacauugucuccagcguuaauauggugucucgccuccugcuuaaccgguuuaccaugacgcacagacgcccuacaaucgagaaagacguggaucugggagccggcacccggcacgucaacgcugaaccggagacccccaauauggacgugauuggggaaagaaucaagcgcauuaaagaggaacauagcuccacauggcacuaugaugacgagaacccuuacaagacgugggccuaucauggaucuuacgagguuaaagcgaccggcagcgccuccagcaugaucaauggcguggucaagcuccugacaaagcccugggacgugguuccuauggugacccaaauggcuaugacagauaccacacccuucgggcagcagcgggucuuuaaagaaaagguggacaccagaacgccgcgcccuaugcccggaacccggaaaguuauggagaucacagccgaauggcuguggagaacccucggccgcaacaagcggccuagacuguguacacgcgaggaguucaccaaaaaggugagaacgaaugcugccaugggggccgucuuuacagaggagaaccaaugggaauccgcgcgggcugccguggaggaugaagaguucuggaaacuugucggacgcgagagagaacugcacaaacucggcaagugcgggucuugcguguauaauaugaugggcaaacgggagaagaaacugggagaauuuggcaaggccaaagggagcagagcuauuugguacauguggcuuggagcccgguaucuggaguucgaagcucucggcuuucugaacgaggaccauugguucucccgcgaaaauucuuacagcgggguugaaggagagggccugcacaagcucggguacauccugagagauauuuccaagauccccggcggagccauguaugcggacgauaccgccggcugggacacacggauuaccgaagaugaccuucacaacgaggagaagaucacgcagcagauggauccugagcaucgccagcuggcuaaugccaucuuuaagcucaccuaccaaaacaaaguggucaaggugcagagacccacaccgaaagggaccgugauggacauuaucucucggaaggaccagcgcggaagcggccagguugggacauauggacugaauaccuucacaaacauggaggcucaacuuauuagacagauggaaggcgagggggugcuguccaaggccgaucucgaaaauccucaucugcuggagaaaaagaucacccaguggcucgaaacgaaaggcgucgagcggcugaagcgcauggcgauuagcggagacgauugugugguuaaacccaucgacgauagauuugccaacgcccuucuggcccucaacgacaugggcaaggugcggaaggauaucccccaguggcaaccuucuaaaggguggcaugacuggcagcaggucccguucugcucccaccacuuccaugagcugauuaugaaggauggacgcaaacuugugguccccuguagaccucaggacgaacugaucggccgggcucgcauuagccaaggggccggauggucucucaaggagacagcuugccugggcaaagccuacgcgcagauguggucccugauguauuuucacagacgggaucucagacuggccagcaaugcuaucuguucugccgugcccguucauugggugccuaccucccgcaccacauggagcauucacgcccaucaccaguggaugaccacagaagacaugcuuacggucuggaaccggguguggaucgaggauaaucccuggauggaggacaagaccccuguuacaaccugggaagacgugcccuaccuggggaagagagaggaucaauggugcggcucccucauuggacugacaagccgcgcuaccugggcccagaacauccuuacggcgauccagcagguccggucucugauuggcgacgaagaguuccucgauuauaugccgagcaugaaaagauuucgcaaggaagaggaguccgaaggggcuaucugguga

SEQ ID NO: 20915 - RNA, 9873 nt, Artificial Sequence
  derived and/or modified CDS sequence (opt5) from DENV-3__JF504679__SS-prME
acaagccugugccucaugaugauccugcccgccgcucuugccuuccaccugacaucccgggacggcgaaccucggaugauuguggggaagaacgaacgcggaaaaucucuccuguuuaagacggcgagcggcaucaauauguguacacuuauugcuauggaucugggggagaugugcgacgauacagugaccuacaaauguccgcauaucacagaaguugagcccgaagacauugauugcugguguaaccucaccuccacaugggugaccuauggaacgugcaaucaggccggcgagcaccggcgggacaagcgcucuguggcccuggcuccucauguugggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggugauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucagugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacggccaagggaaggcgcauaacggaagacugaucacagcuaaucccguugugaccaaaaaggaggaacccgucaacauugaggccgaaccuccguucggcgaguccaauaucgugauugggaucggcgauaacgcccugaaaaucaauugguauaagaagggaucuagcauuggcaaaauguuugaagcuacggccagaggggcuagacgcauggccauccuuggagacacagcgugggauuucggcuccgucggagggguucucaacagccugggcaagaugguccaccagauuuuugggucugccuacaccgcucuguucuccggcgugagcugggugaugaaaaucggaauuggcguccuccugaccuggaucgggcuuaauucuaagaacacaagcauguccuuuucuugcauugccaucggaaucauuacccuguaucucggcgcugugguucaggccgacauggggugugugaucaauuggaaaggaaaggagcugaagugcggcagcgggauuuucgucacaaacgaggugcauacguggaccgaacaguacaaauuucaagcggauucccccaagcggcuggccacaguuaucgcuggcgccugggagaauggaguguguggcauuagaagcaccacacgcauggaaaaccuucucuggaaacagaucgcuaaugagcugaacuauauccugugggaaaauaacauuaagcucaccgucgugguuggggacacgaucggagugcuggagcagggcaaacggacccuuacaccucagcccauggagcugaaguacucuuggaaaaccugggggaaggccaagauugucacagccgaaacccaaaacuccagcuucaucauugauggaccuaauacacccgagugcccgucugcuuccagagcguggaacgugugggaaguggaggacuauggcuuuggcgucuucaccacgaauaucuggcucaaacugcgcgaaguuuacacacagaugugugaccaccggcugaugagcgccgcugugaaggaugagagagccgugcacgccgacaugggguacuggaucgagucccagaaaaacggaucuuggaaacuugaaaaagcuagccucauugaggucaagaccugcaccuggccuaagucccauacacuguggucuaauggcgugcuggaaagcgauaugaucauucccaaaucccucgccgggccuguuagccagcacaacuaucgccccggauaccauacccaaacggcgggcccuuggcaccuggggaaacuugagcuggacuuuaauuauugcgagggaacaaccguggucaucacagaaaacuguggcacccggggccccucucucagaacaaccacgguguccgggaaacugauucacgaguggugcugucgcagcugcacccugccgccucuucgguacaugggagaagauggcuguugguaugggauggagaucagacccaucucugaacgggaggagaauaugguuaagucccucgugagcgcuggaucuggcaaagucgacaacuucacaaugggggugcugugccuggccauucucuuugaagagguuaugcgcggaaaguucggcaagaaacauaugaucgccggcguguucuuuaccuucaugcugcuucugagcgggcagauuacauggagagauauggcucacacccucaucaugauuggauccaaugccagcgaccggaugggcaugggggucacguaccuggcgcugaucgcuacauuuaagauucagcccuuccuugcccugggauuuuuccucagaaaacugaccucucgcgaaaaccuccugcuuggcguggggcuggccauggcuacaaccauccaacucccugaggauaucgaacagauggccaauggaauugcucugggccugauggcccuuaagcugaucacccaguuugagacauaucagcucuggacggcgcugauuucccucaccuguagcaacacaaucuucacccugacaguggccuggcggaccgcuacgcuuauucuggccggcgucucccuccugccgguuugccaaucuagcuccaugagaaaaacagacuggcugcccaugaccguggcugccaugggggugccuccccuuccucuguuuaucuucucucucaaggauacccugaagcgcagaagcuggccccucaaugagggagucauggccgugggccugguuuccauccuugcuucuagccugcugcggaacgacgugccuauggcggggccccucgucgccggaggccugcuuauugcuuguuacgugaucacagggaccuccgccgaucugacaguugaaaaagccgcugacgugacgugggaggaagaggccgaacagaccggagucagccauaaccucaugauuacaguggacgaugacggcaccaugcgcaucaaggaugacgagacagagaauauucugaccguccuccugaaaacggcgcuucugaucgugucuggcaucuuuccguacuccauuccugcuacccugcucguuuggcacacauggcagaagcagacccaaagaagcggggugcugugggauguccccucuccucccgaaacacagaaagccgagcuugaagagggaguguaucggaucaagcagcagggcauucuggggaaaacccaaguuggagugggcguccagaaggaggggguguuccauacaauguggcacgugacgcgcggagccguucucacccacaacggcaagagacuggaaccgaauugggcuuccgucaaaaaggaccucaucagcuacggcgggggauggcggcugucugcccaguggcaaaaaggcgaggaaguccaggugauugcggucgagccugggaagaaccccaaaaauuuucagacaaugccuggaaccuuccagaccacaacgggcgaaaucggggcuauugcccuugauuucaagcccggaaccuccggcagccccaucaucaaccgcgagggcaaggugguugggcuguauggaaauggcguggucaccaagaacgggggauacguguccggcauugcccaaaccaaugcugagccugacgggccgacacccgaacuggaggaagagauguuuaagaaaagaaaccucaccaucauggaucugcauccuggcagcggaaagacgcggaaauaucuucccgccauuguucgcgaagcuaucaagagacggcugagaacacucauucuggccccuacccgcguggucgcggccgagauggaggaagcucucaagggccugcccauccgguaccagaccacagccaccaaaucugagcacacagggagagaaaucguggaccuuaugugccaugcuaccuucacgaugcgccugcugagcccuguucgggugccgaauuauaaccucauuaucauggaugaggcccacuuuacagaccccgccuccauugcugcgagaggauacaucucuacccgcgucggcaugggggaagccgcugccauuuucaugacagccaccccucccggaacggcugaugccuuuccucagagcaaugcgcccauccaggacgaggagcgggacaucccggaaagauccuggaacucuggcaaugaguggauuaccgauuucgcugggaagacagugugguuugugccuagcaucaaagccggcaacgacauugccaacugucugcgcaagaaugggaaaaaggucauccaacuuucccggaagaccuucgauacagaauaccagaaaaccaagcugaacgacugggauuuuguugugacaaccgacauuucugagaugggcgcuaauuucaaagccgauagagugaucgacccccggcgcugccucaagcccgucauucugacggaugggccugagagagugauccuggcgggacccaugccuguuacaguggccagcgcugcccagcggcgcggcagagucgggcggaacccgcagaaagaaaaugaccaauauaucuuuaccggacagccccucaacaaugaugaggaccaugcucacuggaccgaagccaagaugcuucuggacaacauuaauacaccugagggcaucauucccgcucuguucgaaccugagagagagaaguccgccgcgaucgauggggaauaccgccucaaaggcgagagccggaagaccuucguggaacugaugagacgcggagaccuucccguuuggcuggcccacaaaguggcuucugagggcauuaaguauacagaucggaaauggugcuuugacgggcagagaaacaaucagauccucgaagagaacauggaugucgagaucuggacgaaggaaggagagaaaaagaagcugcgcccgcgguggcuggacgccagaaccuacuccgauccucucgcucuuaaagaguucaaggacuuugccgccggccgcaaaagcauugcucuggaucuggugacagagaucgggagaguccccucucaucucgcgcaccggacccgcaaugcccuggacaaccuugugaugcugcauacauccgaacacggaggcagagcuuaucggcacgccguugaggagcucccugaaaccauggagacgcugcugcuccuuggccugaugauucugcucaccgggggagccaugcuguuccuuaucagcggcaaggggauuggaaaaacauccaucggccugaucugugugauugcuucuagcgggaugcucuggauggccgaaaucccccugcaauggauugcguccgccaucgugcuggaguuuuucaugaugguccuccuuauuccugagcccgaaaagcagcgcaccccgcaggauaaucaacuggcuuacguugugaucggcauucucacacucgccgcuaucaucgccgcgaacgagaugggacugcuugaaaccacgaagagagaccugggcaugagcaaagagccugggguggucucucccacauccuaucucgauguggaccugcaucccgccagcgcuuggacccuguacgccguugcuacaaccgugauuaccccuaugcuccggcacacaaucgaaaauucuacggccaacgucagccuugcugccauugcgaaccaggccgugguccugaugggacuggacaagggcuggccgaucuccaaaauggaucucggggugccccugcuugcucugggaugcuacucucagguuaauccucucacccugacagccgcugugcugcuccuugucacccauuaugccauuaucggccccgggcugcaggccaaggcgacaagagaggcucaaaaacgcaccgccgcuggaaucaugaagaacccuacgguggacggcauuaucacaauugaucuggaccccguuaucuacgauagcaaguuugagaaacagcucggccaggugaugcugcuuguccugugugccgugcagcuccugcugaugcggaccuccugggcccucugcgaagcucuuacccuggccacagggccuauuaccacacugugggagggaucuccgggcaaguucuggaauacgaccaucgcggugagcauggccaacaucuuuagaggguccuaucucgcuggagccggccuggcuuucagcauuaugaaaucuguugggacaggaaagcgcggcaccggcucccaaggggaaacacuuggagagaaauggaagaagaaacugaaucagcucagccggaaggaauuugaccuguacaaaaaguccggcaucaccgaggucgauagaacggaggccaaagaagggcugaagcggggagagaccacacaccaugcggugucucgcggcagcgccaaacuccagugguucguggaaagaaacauggucauucccgaggggcggguuaucgaccuuggauguggccgcggcgggugguccuauuacugcgcuggacugaagaaggugaccgaagugagaggcuauacaaaagggggaccuggccacgaggagcccgucccuaugucuaccuacggguggaauauugugaagcugaugagcggaaaagaugucuuuuaccugcccccggaaaagugugacacacugcuuugcgauaucggcgaguccagcccuucucccaccguggaagagucccggacgauucgcguccugaaaaugguggagcccuggcucaagaacaaucaguucuguaucaagguucugaacccuuauaugcccgccgugaucgaacaccuggagagacuccaacggaaacauggcgggaugcuuguccgcaauccucugagcagaaacucuacacacgaaauguacuggauuuccaauggaaccggcaacaucgugagcucugugaauauggucagccggcugcuccugaacagauucaccaugacacaucgccggccgacgauugagaaggacguugaucuuggggcuggaaccagacacgugaacgccgaacccgagacaccuaauauggacgugaucggcgagcgcauucggagaaucaaagaagaacacaacuccaccuggcauuaugacgaugaaaaucccuacaagacaugggcuuaucacgggucuuacgaggucaaagccaccggaagcgcguccagcaugaucaacggcgugguuaagcugcucacaaagccuugggacgugguccccauggugacccagauggccaugacggauaccacaccguuuggccagcaacgcguuuucaaagaaaagguggacacccggacaccuagacccaugccugggacccgcaaagucauggagauuacggcugaguggcuguggcggacacugggaagaaauaagcgcccccggcucugcaccagagaagaguuuaccaagaaggugcgcaccaacgccgcuaugggcgccguuuucacggaagagaaucagugggauuccgccaaggcggcuguggaagacgaggaguuuuggaaacuggucgauagagaacgggagcuucauaagcuggggaaauguggaucuugcguguauaacaugaugggcaagcgcgagaaaaagcucggggaguucggcaaagccaagggaagcagagccaucugguacauguggcugggcgcucgguaccuugaguuugaagcccugggguuccucaaugaggaccacugguuuuccagagaaaacucuuauagcggagucgagggcgaagggcugcauaagcugggauacauucuccgggauaucuccaaaauuccuggcggggcuauguaugccgacgauaccgcgggcugggacacacgcaucaccgaggacgaucugcacaaugaggaaaagaucacacagcagaugaaccccgagcacagacuucuggccaaugcuauuuucaaacucaccuaccaaaacaaggugguuaaagugcagcggccgacaccuaccggaacggucauggacaucauuucucgcaaggaucagagaggcagcggacaggugggaacauauggccugaauaccuuuaccaacauggaagcccaacuugugcggcagauggagggggaaggaguucuguccaaggcugaccucgagaacccccaucugcccgagaaaaagaucacacaguggcuggaaaccaaaggcguggagcgccucaagagaauggccauuagcggggaugacugcgucgugaaaccuaucgaugaccgguucgcgaaugcccugcuugcucugaacgauaugggcaagguucgcaaggacaucccgcaguggcaacccucuaaaggauggcacgauuggcaacaggugccuuuuuguucccaucacuuccacgaacucauuaugaaggacggcagaaaacuggucgugcccugccggccucaggaugagcuuaucgggcgcgccagaauuagccaaggagcuggcuggucucugcgggaaacagccugucucgggaaggcuuacgcccagauguggucccugauguauuuccaucgcagagaccugcggcucgcgagcaaugccaucugcucugcuguccccgugcacuggguuccuacguccagaaccacauggagcauucaugcccaccaucaguggaugaccacagaggacaugcugaccguguggaaccgcgucuggaucgaggauaaucccuggauggaagacaaaacgccggugaccacaugggagaacguuccuuaccuuggaaagcgggaagaucaaugguguggcucccugauugggcucaccagcagagccacaugggcucagaauauccccaccgccauccaacaggugcgcucucugauuggcaacgaggaguuucuugacuacaugccuagcaugaagcgguucagaaaagaagaggaauccgagggagcgaucugguga

SEQ ID NO: 20916 - RNA, 9873 nt, Artificial Sequence
  derived and/or modified CDS sequence (opt5) from DENV-3__KC425219__SS-prME
accagccugugccucaugaugauccugcccgccgcucuugccuuccaccugaccuccagagacggagaaccucggaugauuguggggaagaacgaacgcggaaaaucucuccuguuuaagacggcgagcggaaucaauauguguacccuuauugcuauggaucugggggaaaugugcgacgauacagugaccuacaaauguccgcacaucaccgaaguugagcccgaagacauugauugcugguguaaccucaccuccacaugggugaccuauggaacgugcaaucaggccggcgagagacggcgcgacaagagaucuguggcccuggcuccucacgucgggaugggacuggauacccggacacagaccuggaugagcgccgagggcgcuuggcgccagguggaaaaaguugagacaugggcccucagacaucccggcuucaccauccuggcgcuuuuucuggcccacuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcauggcgggugcguuaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuauguguguaaacacaccuacgucgaucgcggcugggggaacggaugcggccuguucgggaagggaagccuugugaccugcgccaaguuucaaugucuggagcccauugagggcaaaguugugcaguaugaaaaucucaaguacacagucaucaucaccgugcacacaggggaccagcaucagguuggaaacgagacgcaaggcgugaccgcugaaauuacaccucaggccucuaccacagaggcuauccugcccgaauauggcacccuggggcucgagugcuccccuagaacgggacuggacuucaaugagaugauucuucugaccaugaaaaacaaggccuggaugguccaccggcagugguuuuucgaucucccccugccguggacaagcggcgccaccacagaaaccccuacguggaaucgcaaagagcuucuggugacauuuaagaacgcucaugcgaaaaagcaagaagucgugguucucgggucucaggagggagccaugcacaccgcucugacaggcgccaccgaaauccagaauagcgggggcaccagcauuuucgccggacaccugaaguguagacucaaaauggacaagcuggagcuuaaaggcaugucuuacgcuaugugcacaaacacguuugugcugaagaaagaggucuccgaaacccagcaugggacaauccucaucaagguggaguaccggggagaagaugcccccuguaagauuccuuucagcaccgaggacggccaagggaaagcgcacaacggaagacugaucacagcuaaucccguugugaccaagaaagaggaacccgucaacauugaggccgaaccuccguucggcgaguccaauaucgugauugggaucggcgauaacgcccugaagaucaauugguauaaaaagggaucuagcauuggcaagauguuugaagcuacggcccgcggggcucggagaauggccauccuuggagacacagcgugggauuucggcuccgucgggggaguucucaacagccugggcaaaaugguccaucagauuuuugggucugccuacaccgcucuguucuccggcgugagcugggugaugaagaucggaauuggcguccuccugaccuggaucgggcuuaaucccaaaaacacaucuaugagcuuuuccugcauugccaucggaaucauuacccuguaucucggcgcugugguucaggccgacauggggugugugaucaauuggaagggaaaagagcugaagugcggcucugggauuuucgucacaaacgaggugcacacguggaccgaacaguacaaguuucaagcggauagcccuaaacgccuggccacagcuaucgccggcgcuugggagaauggaguuuguggcauucgguccaccacaagaauggaaaaccuucucuggaagcagaucgccaaugagcugaacuauauccugugggaaaauaacauuaaacucaccguggucgugggggacaucauuggaguucuggagcagggcaagcgcacgcuuacaccccagccuauggagcugaaauacagcuggaagacaugggggaaagccaagaucgugaccgcugaaacacaaaacucuuccuucauuaucgauggacccaauaccccggagugcccuagcgcgucucgggccuggaacgucugggaaguggaggacuauggcuuuggcguguucacaaccaauaucuggcucaagcugagagaagucuacacgcagcugugugaccaucgccuuauguccgcugccguuaaagaugagcgggccgugcacgcugacaugggguacuggauugagagccagaagaacggauccuggaaacucgaaaaggccucucugaucgaggugaaaacaugcaccuggcccaagagccacacccugugguccaauggcguccucgaaucugauaugauuaucccuaagagccuggcggggcccauuucccagcauaaccacagaccuggauaucauacacaaaccgcuggccccuggcaccuugggaaacuggagcucgacuuuaauuacugcgagggaacgacagugguuaucaccgaaaacuguggcacacgcggcccgagccugcggaccacaaccgugucugggaagcugauccacgaguggugcuguagauccugcacgcuuccuccccuccgguauaugggagaagauggcuguugguacgggauggagauucgccccaucagcgaaaaagaggagaauauggucaagucucugguguccgccggaagcggcaaaguugacaacuucaccaugggggugcugugccucgccauucuguuugaagaggucaugagaggaaaguucggcaagaaacauaugaucgcuggcguguucuuuacauucguucuucugcucucugggcagauuaccuggcgggauauggcccacacacugaucaugauuggaagcaaugcguccgacagaaugggcaugggggugaccuaucuggcucuuaucgccacguuuaagauccagccuuuccuggcccucggauuuuuccugcgcaaacucacaagccgggaaaaccugcuucugggcgucgggcucgcuauggccaccacacugcaacugccggaggauauugaacagauggcuaauggaaucgcccuuggccugauggcgcucaagcugauuacccaguuugagaccuaccagcucuggacagcccugaucucucuuacguguuccaacaccauguucacacugaccguggcuuggagaacagccacccucauucuggcuggcgugagccugcuucccgucugccaauccucuagcaugcgcaaaacggacuggcugccuauggccguugccgcuaugggggugcccccucucccccuguuuaucuucucccucaaggauacacugaagagacggucuuggccucuuaaugagggagugauggcggucggccuggugagcauccuggccuccucucuccugcgcaacgacguucccauggcugggccgcuuguggccggaggccugcucauugccuguuaugucaucaccgggaccagcgcugaucugacaguggaaaaagccgcggacauuaccugggaggaagaggcugaacagacaggaguuucccauaaccucaugaucacgguggacgaugacggcaccaugagaauuaaggaugacgagacagagaauauccugaccguccuucugaaaacagcccugcucaucgugagcggcgucuuuccuuacucuauucccgccacccugcuuguguggcacacguggcagaagcagacccaacgguccgggguucugugggaugugccuucucccccggaaacacagaaagcugagcucgaagagggagucuaccgcaucaagcagcagggcauuuucgggaaaacccaagugggaguuggcgugcagaaggagggggucuuucauacaauguggcacgugaccagaggagccgugcugacauauaacggcaagcggcucgaaccuaauugggcguccguuaaaaaggaccugaucuccuacggcgggggauggcgccuuagcgcucaguggcaaaaaggcgaggaaguccaggugauugccguggagcccgggaagaacccuaaaaauuuccagacgaugcccggaaccuuccagacaaccaccggcgaaaucggggccauugcucuggauuuuaagcccggaacaucuggcuccccuaucaucaacagagagggcaaggucguggggcuguauggaaauggcguugugacgaaaaacgggggauacgucagcggcauugcccaaaccaaugcugagccggacgggcccacaccugaacucgaggaagagauguucaagaaacggaaccugaccaucauggaucuucaccccggcuccggaaagacacgcaaauaucugccugccauugugagagaagcgaucaagcggagacuccgcacccugauucucgcccccacgcggguuguggcugccgagauggaggaagcucugaagggccuuccuaucagauaccagacaaccgccaccaaaagcgagcauacagggcgcgaaaucgucgaccugaugugccacgccaccuuuacaaugcggcugcucucuccggugagaguucccaauuauaaccugauuaucauggaugaggcucauuucaccgacccugcgagcauugccgcucgcggauacaucuccacgcgggugggcaugggggaagccgccgcuauuuuuaugacagccacacccccuggaacagcggaugcuuucccccagucuaaugccccgauccaggacgaggagagagacaucccugaacgcagcuggaacuccggcaaugaguggauuaccgauuuugccgggaagacggucugguucgugcccucuaucaaagcuggcaacgacauugccaacugucuucggaagaauggcaagaaggugauccaacugagcagaaagaccuuugauacagaauaccagaaaaccaagcucaacgacugggauuucgucguuacaaccgacauuuccgagaugggcgcgaauuuuaaagccgaucgggugaucgacccccgcagaugccugaagccugugauucugacagaugggcccgagcgggucauccucgcuggaccuaugccggugaccgccgcuucugccgcucagcgcagaggccggguugggagaaacccccagaaagaaaaugaccaauauaucuucacgggacagccucuuaacaaugaugaggaccacgcccauuggacagaagcgaagaugcugcuggacaacauuaauacccccgagggcaucauuccugcccucuucgaacccgagcgcgaaaagagcgcugccaucgauggggaauaccggcugaaaggcgaguccagaaagaccuuuguggaacuuaugcgccggggagaccugccggucuggcucgcucacaaaguggccagcgagggcauuaaguauacagauagaaaauggugcuucgacgggcagcgcaacaaucagauccuggaagagaacauggauguugagaucuggaccaaggaaggagagaaaaagaagcugcggccuagauggcucgacgcccgcacauacucugauccccuugcucugaaagaauuuaaggacuucgcggccggcagaaaauccauugcucuggaucucgugacggagaucgggcgggucccuagccaccuggcccaucgcaccagaaaugcccuugacaaccuggugaugcuccacacaucugaacauggaggccgggcuuaucgccacgccgucgaggagcugcccgaaaccauggagacacugcuccuucugggccugaugauucuccugaccgggggagcgaugcuuuuucugaucuccggcaaggggauuggaaaaacgagcaucggccucaucugugugauugccuccucugggaugcuguggauggcugaaaucccucugcaauggauugccagcgcuaucguucucgaguucuuuaugauggugcuucugauucccgagccggaaaagcagagaaccccucaggauaaucaacuggccuacguggucaucggcauucucacacuggcggccaucaucgcugccaacgagaugggccuucuggaaaccacaaagcgggaccucggcauguccaaagagcccgggguugugagccccaccucuuaucuggauguggaccugcacccugcuuccgccuggacgcucuacgcugucgccacaaccgugauuacaccgaugcuuagacauaccaucgaaaauagcaccgcgaacguuucucuggccgcuauugccaaccaggcugugguccugaugggacucgacaagggcuggcccaucagcaaaauggaucugggggugccucuucuggcccucggaugcuacucccaggucaauccccugacacugacggccgcggugcuccuucugauuacccacuaugcuaucaucggcccugggcugcaggccaaggcuacacgcgaggcccaaaaacggaccgccgcuggaauuaugaagaaccccacaguugacggcaucaugaccauugaucucgacccugugaucuacgauucuaaguucgagaaacagcugggccaggucaugcuucuggugcucugugccguucagcugcugcucaugagaacgagcugggcgcuuugcgaagcccugacacuggcuaccgggccgauuaccacacucugggagggaucccccggcaaguuuuggaauaccacaaucgccgugucuauggcuaacaucuuccgcgggagcuaucuggccggagcgggccuugccuuuuccauuaugaaaagcgucgggacgggaaagcggggcaccggcucucaaggggaaacacugggagagaaauggaagaagaaacucaaucagcuguccagaaaggaguucgaccuguacaaaaagagcggcaucaccgagguggaucggacagaggcuaaagaagggcucaagcgcggagagauuacccaucacgccguguccagaggcucugcuaaacuucagugguuuguugaacggaacauggucaucccugaggggcgcgugauugaccugggauguggcagaggcggguggagcuauuacugcgccggacugaagaaggugacggaaguccggggcuauaccaaagggggacccggccaugaggagccuguucccauguccacauacggguggaauaucgugaagcucaugucuggaaaagauguguucuaccugccgccugaaaagugugacacccuucugugcgauauuggcgagagcucccccagccccacagucgaagagucucgcaccaucagagugcucaaaaugguugagccuuggcugaagaacaaucaguucuguaucaaggugcugaaccccuauaugccuacagucauugaacaccucgagcggcuucaacgcaaacacggcgggaugcuggugagaaauccgcugucccggaacagcacccaugaaauguacuggaucucuaauggaacgggcaacauuguugcuuccgugaauauggucagcagacuccugcuuaaccgcuuuacaaugacccaccggagacccaccaucgagaaggacguggaucugggggccggaacacgccaugugaacgcggaaccugagacgcccaauauggacgucauuggcgagcggaucaaaagaaucaaggaagaacacaacucuaccuggcacuaugacgaugaaaauccuuacaaaacaugggccuaucaugggagcuacgagguuaaggcuaccggauccgccucuagcaugauuaacggcguggugaagcuccugacaaaacccugggacgucgugccgaugguuacccagauggcuaugacagauaccacgccuuucggccagcaacgcguguuuaaggaaaaagucgacacccggacacccagauccaugccugggacccgccgggugaugggaaucacagccgaguggcuguggagaacccucggccgcaauaagaaaccccggcugugcacgagagaggaguucacaaagaagguucgcaccaacgccgcgaugggggcuguguuuacagaggaaaaucagugggauagcgccaaagccgcugucgaggacgaagauuucuggaaacuuguggacagagagcgggagcugcacaaacucggaaaguguggcuccugcguuuauaacaugauggggaaacgcgaaaagaaacugggcgaguuuggaaaggccaagggcucuagagcuauuugguacauguggcuuggggcccgguaccuggaguucgaggcgcucggauuucugaaugaggaucauugguucagcagagaaaacuccuauucuggcguggagggggaaggacugcacaaacucggcuacauccugcgggacauuagcaagaucccugggggcgccauguaugcugaugacaccgccggaugggacacgcgcaucaccgaggaugaccuucauaaugaagagaaaauuacacagcagauggaucccgagcacagacaacuggcuaacgccaucuuuaagcucaccuaccagaauaaagucgugaagguccagcggccgacaccuaccggcacagugauggacauuaucucccgcaaggaucagagagggucuggacaaguuggcaccuaugggcugaacacguucacaaauauggaagcgcagcuuauucggcagauggagggagaaggcgugcugagcaaagccgaccucgagaacccccaucugcccgaaaagaaaaucacccaguggcuggagaccaagggggucgagcgccucaaaagaauggcuaucuccggcgaugacugcguggugaagccuauugaugaccgguuugccaacgcucugcuugcccugaaugauaugggaaagguucgcaaagacaucccgcaauggcagcccagcaagggcuggcaugauuggcaacaggugccuuucuguucucaccauuuccacgaacucauuaugaaagacgggagaaagcuggucgugcccugccggccucaagacgagcuuaucggacgcgcuagaauuucccagggcgccggguggagccugcgggaaacagcgugucucggaaaagccuacgcucagauguggucucugauguauuuucaccgcagagaucugcggcucgccuccaacgccaucugcagcgcuguucccgugcauugggucccuaccucuagaacaacgugguccauucacgcccaucaccaauggaugaccacagaggacaugcugaccguguggaaucgcgucuggaucgaagauaaccccuggauggaggacaagacaccggugaccacgugggagaauguuccuuaccuuggcaagcgggaagaucaguggugugggagccugaucggccucaccuccagagcgacaugggcucagaacauucccaccgccauccagcaagugcgcagccugauuggaaaugaggaguuccuugacuacaugccuucuaugaaacgguuuagaaaggaggaggaaagcgagggcgccaucugguga

SEQ ID NO: 20917 - RNA, 9873 nt, Artificial Sequence
  derived and/or modified CDS sequence (opt5) from DENV-3__AY858037__SS-prME
accagccugugccucaugaugaugcugcccgugacccuugccuuccaccugacguccagagacggcgagccucggaugauugucgggaagaacgaacgcggaaagucucuccuguuuaagaccgcuagcggcauuaauauguguacacuuaucgccauggaucugggggagaugugcgacgauaccguuaccuacaaauguccgcucauuaccgaaguggagcccgaagacaucgauugcugguguaaccugacauccaccugggugacguauggaaccugcaaucaggcgggcgagcauagacgggacaagcgcucugucgcucuggccccucacguggggaugggacucgauacaagagcccaaaccuggaugagcgcugagggcgccuggcggcagguugaaaaaguggagacaugggcuuuccgccaucccggcuuuaccauucuggcccuuuuccuggcgcacuacaucgggacgucccucacacagaaggucgugaucuuuauucugcuuaugcugguuaccccuucuaugacaaugagaugugugggagucggcaaccgggacuucguggaagggcucagcggagccaccuggguggaugucguucuggagcauggcgggugcgugaccacaauggcuaagaauaaacccacgcuggacaucgagcuccagaagaccgaagccacacaacuggcuacccuucgcaaacuguguauugagggaaagaucacaaacgugaccacggauuccagaugcccuacacagggcgaagccauucucccggaggaacaggaccagaauuaugucuguaaacacaccuacguggaucggggcugggggaacggaugcggccuguuugggaagggaagccuuguuaccugcgcgaaguuccaaugucuggagucuaucgagggcaaagugguccagcacgaaaaucucaaguauacagugauuaucaccguucauacaggggaccagcaccaggugggaaacgagacgcaaggcgucaccgccgaaaucacaccccaggcuuccaccguggaggccauucugccugaauacggcacacuggggcucgagugcagcccccgcaccggacuggacuuuaaugagaugauccuucugacgaugaaaaacaaggcuuggaugguccauagacagugguucuuugaucucccucugcccuggaccucuggcgccacaaccgaaacaccgaccuggaauaaaaaggagcuucuggugacguucaaaaacgcccacgcuaagaagcaagaaguugugguccucgggucccaggagggagcgaugcacacagcccugaccggcgcuacagaaauucagaccagcgggggcaccucuaucuuugccggacaucugaaaugucggcucaagauggacaaacuggagcuuaagggcauguccuaugccaugugcagcaaugcuuucgugcugaaaaaggagguuuccgaaacacagcacgggacgauucucaucaagguggaguacaaaggagaagaugccccuuguaagauccccuucucuaccgaggacggccaagggaaagcgcauaacggacgccugauuacagcuaacccugucgugaccaagaaagaggaacccgugaauaucgaggccgaacccccuuuuggcgagagcaacauuaucauugggaucggcgauagagcccugaagaucaauugguacaagaaaggauccagcauuggcaagauguucgaagcuacagccagaggggcuagacgcauggccauccuuggagacaccgcgugggauuuuggcucuguugggggaguccucaacucccugggcaaaauggugcaccagauuuucgggagcgccuauacggcucuguuuucuggcgugagcuggaucaugaagauuggaaucggcguccuccugacauggauugggcuuaauuccaaaaacaccucuaugagcuucuccugcaucgugaucggaauuaucacccuguaccucggcgccguugugcaggcugacauggggugugucauuaauuggaagggaaaggagcugaaaugcggcagcgggaucuuugugacaaacgagguucauaccuggacagaacaguauaaguuccaagccgauucuccgaaacggcuggcgacggccauugcuggcgccugggagaauggaguguguggcaucagauccaccacacgcauggaaaaccuucucuggaagcagaucgcuaaugagcugaacuacauucugugggaaaauaacaucaaacucaccgucgugguuggggacauuaucggagugcuggagcagggcaagcggacacuuacaccccagccuauggagcugaaauauagcuggaagacgugggggaaggccaaaauugucaccgccgaaacacaaaauucuuccuuuaucaucgauggacccaacaccccugagugccccaacgcuagcagagcguggaaugugugggaaguggaggacuacggcuucggcgucuuuacaaccaacauuuggcucaagcugcgcgaaauguauacacagcugugugaccaccggcuuauguccgccgcuguuaaagaugagagagccgugcacgccgacaugggguacuggaucgagucucagaagaauggaagcuggaaacucgaaaaggcuucccugauugaggugaagaccugcacguggccgaaaucucauacacuguggagcaacggcguccucgaauccgauaugaucauuccuaagagccuggccgggcccaucucucagcacaauuaccgcccuggauaucauacccaaaccgcgggccccuggcaccuugggaaacuggagcucgacuucaacuacugcgagggaacaaccgugguuaucacggaaaauuguggcacacggggcccuucccugagaaccacaaccgugagcgggaagcugauucacgaguggugcugucgcucuugcacacuucccccgcuccgguauaugggagaagauggcuguugguacgggauggagaucagaccuauuaacgaaaaagaggagaauauggucaagucccuggugagcgcuggaucuggcaagguugacaacuuuaccaugggggugcugugccucgccauccuguucgaagaggucaugcggggaaaauucggcaagaaacauaugauugccggcgugcuuuuuacguucguucugcuccugagcgggcagaucaccuggcgcgauauggcuagaacacugauuaugaucggauccaaugccagcgaccggaugggcaugggggugaccuaucuugcgcugaucgcuacauuuaagauucagcccuuccucgcccugggauuuuuccucagaaaacugaccucucgcgaaaaccuucugcucggcgucgggcuggccauggcuacgacacugcaacuucccgaggauaucgaacagauggccaauggaauugcucugggccucauggcccugaagcucaucacccaguuugagacauaccagcuguggaccgcgcuugugucccugauguguagcaacaccauuuucacacucacgguggccuggcggaccgcuacacugauccuggccggcaucucccuuuuuccugucugccaaucuagcuccaugagaaagaccgacuggcugccgaugacaguugcugccaugggggugcccccucucccccuguucaucuuuucucucaaagauacccugaagcgcagaagcuggccucuuaaugagggagugauggccgucggccugguguccauccuggcuucuagccuccugcggaacgacguucccauggcggggccucuuguggccggaggccugcucauugcuuguuaugucaucacggggacauccgccgaucugaccguggaaaaagccgcugacguuaccugggaggaagaggccgaacagacaggagugagccacaaccucaugauuaccgucgacgaugacggcacaaugcgcaucaaggaugacgagacggagaauauccugaccgugcuucugaaaacagcgcugcucauugucucuggcaucuuccccuacuccauuccggcuacccugcuuguguggcauacauggcagaagcagacccaaagaagcgggguucugugggaugugccuucucccccugaaacgcagaaagccgagcucgaagagggagucuaccggaucaagcagcagggcauuuuugggaagacccaagugggaguuggcgugcagaaagagggggucuuccacacaauguggcaugugacccgcggagccgugcugacauauaacggcaagagacucgaacccaauugggcuuccguuaaaaaggaccugaucagcuacggcgggggauggcggcuuucugcccaguggcaaaaaggcgaggaaguccaggugauugcgguggagccggggaagaacccuaagaauuuccagaccaugcccggaaucuuucagacaacgaccggcgaaaucggggcuauugcccuggauuucaaaccuggaacauccggcagccccaucauuaaccgcgagggcaaggucguggggcuguauggaaauggcguugugaccaaaaacgggggauacgucuccggcaucgcccaaaccaaugcugagcccgacgggccuacaccggaacucgaggaagagauguuuaagaaaagaaaccugacgauuauggaucuucaccccggcagcggaaagacccggaaguaucugccugccaucgugcgcgaagcuaucaaaagacggcucagaacacugauucucgcccccacccgcguuguggcggccgagauggaggaagcucugaagggccuuccuauccgguaccagacaaccgccacgaaaucugagcacacagggaaggaaauugucgaccugaugugccaugcuaccuucaccaugagacugcucagccccgugcgcguuccuaauuauaaccugaucauuauggaugaggcccacuuuacagacccggccuccaucgcugcgcggggauacaucucuaccagagugggcaugggggaagccgcugccauuuucaugacagccacacccccuggaacggcugaugccuuuccccagagcaaugcgccuauccaggacgaggagcgcgacauucccgaacgguccuggaacucuggcaaugauuggaucacagacuucgcugggaaaaccgucugguuugugccgagcauuaaggccggcaacgauaucgccaacugucuuagaaagaauggcaaaaaggugauucaacugucccgcaaaacauucgacaccgaguaccagaagacgaaacucaacgauugggacuuugucguuaccacagauaucucugaaaugggagcuaauuucaaggccgaccgggugaucgauccuagacggugccugaagcccgugauucugaccgacgggcccgagcgcgucauccucgcgggaccuaugcccgugacaguugccagcgcugcccagagacggggccgcguggggagaaacccucagaaagagaaugaucaauauauuuucaccggacagccgcuuaacaaugacgaagaccaugcucacuggacagaggccaagaugcugcuggauaacaucaauacccccgaaggcauuaucccugcucucuuugagcccgaacgggagaaauccgccgcgaucgacggggaguacagacugaagggcgaaagccgcaaaacguucgucgagcuuaugcggagaggagaucugccuguguggcucgcccauaagguugcuucugaaggcauuaaauauacagaccgcaaguggugcuuugauggggagcggaacaaucagauccuggaagagaacauggacguggagauuuggaccaaggaaggagagaaaaagaaacugagaccccgcuggcucgaugcccggaccuacuccgacccgcuugcucugaaggaguucaaagauuuugccgccggcagaaagagcaucgcucuggaccucgucacagagauugggcgcgugccuucucaccuggcgcacagaacccggaaugcccuugauaaccuggucaugcuccauacauccgaacacggaggccgcgcuuauagacaugccguggaggagcugcccgaaacgauggagacccugcuccuucugggccugaugauccuccugacagggggagccaugcuuuuccugaucagcggcaaggggguuggaaaaaccuccauuggccucaucugugugguggcuucuagcgggaugcuguggauggccgacauuccucugcaguggaucgcguccgccauuguccucgaauuuuucaugaugguucuucugauccccgagccugagaagcaacggacaccccaggauaaucagcuggcuuacguggugauuggaauccucacccuggccgcuaucgucgccgcgaacgaaaugggccuucuggagacgaccaaacgcgaccucggcaugagcaaggaaccgggggugguuucuccuacauccuaucuggacguggaucugcaccccgccagcgcuuggacccucuacgccgucgcuacaaccgugauuacgcccaugcuuagacacacaaucgaaaauucuaccgccaacgucagccuggcugccauugcgaaccaagccgugguucugaugggacucgacaaaggcuggccuaucuccaagauggaucugggggugccgcuucuggcucucggaugcuacucucaggucaauccccugacacugaccgccgcugugcuccuucugguuacccauuaugccauuaucggcccugggcugcaggccaaggcgacacgggaagcucagaaaagaacggccgcuggaaucaugaagaaccccaccguggacggcauuaugacaaucgaucucgacccugucauuuacgauagcaaauuugagaagcaacugggccaggugaugcuucuggugcucugugccguucagcugcugcucaugcgcaccuccugggccuucugcgaggcucuuacacuggccaccgggcccaucacgacacugugggaaggaucuccuggcaaauuuuggaauaccaccauugcggucagcauggccaacaucuuccggggguccuaucucgcuggagccggccuggcuuuuagcaucaugaagucuguggggacaggaaagagaggcaccggcucccagggggagacacuuggagaaaaauggaagaaaaagcugaaucaacucagccgcaaagaguucgaccuguacaagaaauccggcauuacggaaguggaucggaccgaggccaaggaggggcugaagagaggagaaaucacacaccaugcggucucucggggcagcgccaaacuccagugguucguugagcgcaacauggugauuccggaagggagagugaucgaccuuggauguggccggggcgggugguccuauuacugcgcuggacugaagaaagucaccgaggugcgcggcuauacaaaagggggacccggccacgaagaaccuguucccaugucuaccuacggguggaauauugugaaacugaugagcggaaaggaugucuuuuaccucccucccgagaagugugacacgcugcuuugcgauaucggcgaauccagcccgucuccuaccguggaggaauccagaacaauucggguucugaaaaugguggagcccuggcucaagaacaaucaguucuguaucaaaguccugaaccccuauaugccuaccgugaucgagcaucuggaacgccuccagagaaagcacggcgggaugcuugugcggaauccccugagccgcaacucuacacacgagauguacuggauuuccaauggaaccggcaacaucgucagcucuguuaauauggugagcagacugcuccugaaccgguuuacaaugaccuauagacgcccuacgauugaaaaagacguggaccuuggggccggaacacggcaugucaacgcugagccggaaacccccaauauggaugugaucggcgagcggauucgccggaucaaggaggaacacuccucuaccuggcauuacgacgaugagaacccuuauaagacaugggccuaccacgggagcuaugaaguuaaagcuacgggauccgccagcuccaugaucaauggcguggucaagcugcucaccaaacccugggacgugguuccuacagugacccaaauggcgaugacagauaccacacccuucggccagcagagagucuuuaaggagaaaguggacacccgcacgccgaagccuaugcccgggacccggaagguuauggaaauuacagccgaguggcuguggagaacccugggacgcaacaaacggccuagacucugcacacgcgaggaguucaccaagaaagugcggacgaaugcugccaugggcgcugucuuuacagaggaaaaccaaugggauucugccagagccgcgguggaggacgaagaguucuggaagcuggucgaucgcgagagagaacuucacaaacuggggaaguguggaagcugcguguacaauaugaugggcaaacgggagaagaagcucggggaauuuggcaaagcuaagggaucccgcgccaucugguacauguggcugggcgccagauaucuugaguucgaggcucugggguuucucaacgaagaccauugguucucucgggagaauagcuacuccggaguugaaggcgaggggcugcacaaacugggauauauucucagagauaucucuaagauucccggcggggccauguacgcugacgacaccgccggcugggauacacggaucaccgaagacgaucugcauaacgaggagaaaaucacgcagcagauggacccugaacaccgccagcuugcgaaugccauuuuuaagcugaccuaucaaaacaagguggucaaagugcagagacccacaccgaagggaaccgugauggauaucauuagccggaaagaccagcgcggcuccgggcagguuggaacauacggccucaauaccuucacaaacauggaggcucaacugaucagacagauggaaggggagggagugcuuagcaagaccgaucuggaaaauccucaucuccuggagaaaaagauuacgcaguggcuggagacaaagggcgucgaacggcucaaacgcauggccaucucuggggacgauugcgugguuaagcccaucgacgauagauucgcuaacgcccugcuugcgcugaacgacaugggcaaagugcggaaggauauuccccaguggcaaccuuccaaaggauggcacgacuggcagcaggucccguuuuguagccaccauuuccacgagcucaucaugaaggacggccgcaagcuggugguccccugcagaccucaggaugaacuuauugggcgggcccgcaucucucaaggagcuggcuggucccugaaagagaccgccugucucgggaaggcuuaugcccagaugugggcucugauguacuuucauagacgggaccugcgccucgccagcaaugcgauuugcucugccgugcccguucacugggugccuaccuccagaacaaccuggagcauccacgcucaucaccaguggaugacaacggaagauaugcugaccgucuggaaccggguguggauugaggacaaucccuggauggaggauaaaacaccuguuaccacaugggaagacgugcccuaccuuggaaagagagaggaucaaugguguggcucccugaucgggcucaccagccgcgccacgugggcccagaacauccugaccgcuauucagcagguccggucucuuaucggcaaugaagaguuccuggacuauaugccgagcaugaaaagauuucgcaaggaggaagaguccgaaggagccauuugguga

SEQ ID NO: 20918 - RNA, 9873 nt, Artificial Sequence
  derived and/or modified CDS sequence (opt5) from DENV-3__KJ737429__SS-prME
accagccugugccucaugaugaugcugcccgccacacuugcuuuccaccugacgucccgggacggcgaaccucggaugaucguggggaagaacgaacgcggaaagucucuccuguuuaagaccgccagcggcauuaauauguguacacuuaucgcgauggaucugggggagaugugcgacgauaccgucacauacaaguguccgcucauugcugaaguugagcccgaagacaucgauugcugguguaaccugaccuccacaugggugaccuauggaacgugcaaucaggccggcgagcaccggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaaacccacgcucgacaucgagcugcagaagaccgaagcuacacagcuugccacccugcgcaaacucuguauugagggaaagaucacaaacauuaccacggauuccagaugcccuacacagggcgaagcgauccugccggaggaacaggaccagaauuauguguguaaacacaccuacguggaucggggcugggggaacggaugcggccuuuucgggaagggaagccuggugacaugcgccaaguuucaaugucucgagcccauugagggcaaagugguucaguaugaaaaucugaaguacacagugaucaucaccguccacacaggggaccagcaucaggugggaaacgacacgcaaggcguuaccguggagauuacaccucaggcuucuaccgucgaagccgugcugcccgaguauggcacacucgggcuggaaugcuccccucgcaccggacuugauuucaaugagaugauccugcucacgaugaaaaacaaggcuuggaugguccacagacagugguuuuucgaccugccccuuccguggaccagcggcgccacaaccgagacaccuaccuggaaucggaaagaacugcucgugacguuuaagaacgcccaugcuaaaaagcaagagguugugguccuggggucucaggaaggagcgaugcacacagcccugaccggcgcuacagagauucaaaauuccgggggcaccagcaucuucgccggacaccucaagugucgccugaaaauggauaaacuugaacugaaaggcaugucuuacgccaugugccucaacaccuuugugcugaagaaagagguuuccgagacacagcaugggacgauucugaucaagguggaauacaagggagaggacgcucccuguaaaaucccuuucagcaccgaagauggccaagggaaggcccacaacggaagacuuauuacagcgaaucccgucgugaccaaaaaggaggagcccgugaacaucgaagcugagccuccguucggcgaauccaauauuguuaucgggauuggcgacaaagcccucaagaucaacugguauaagaaaggaucuagcaucggcaagauguuugaggccacagcuagaggggccagacgcauggcuauucugggagauaccgccugggacuucggcuccgucgggggagugcugaauagccucggcaaaauggugcaucagaucuuugggucugcguacacggcccuguucuccggcgucagcuggauuaugaagaucggaauuggcgugcuucugacauggaucgggcucaacucuaaaaauaccagcauguccuuuucuugcauuguuaucggaaucauuacccuguaucugggcgcugugguccaggccgauauggggugugugaucaacuggaagggaaaggaacuuaaaugcggcagcgggauuuucguuacaaaugaggugcacaccuggacagagcaguacaaguuucaagcugacucccccaaacggcucgccacggcgaucgccggcgcuugggaaaacggagucuguggcauuagaagcaccacacgcauggagaaucugcuguggaagcagaucgccaacgaacucaauuauauccugugggagaacaauauuaaacuuaccgugguugugggggauaucauuggaguccuggaacagggcaagcggacacucaccccucagcccauggagcugaaauacucuuggaagacgugggggaaggcuaaaaucgugaccgccgagacacaaaacuccagcuucauuaucgacggaccuaacacccccgaaugcccgucugccuccagagcuuggaaugugugggaggucgaagacuauggcuuuggcguuuucacaaccaacaucuggcugaaacuucgcgagguguacacacagagcugugaucaucggcucauguccgcggccauuaaagacgaaagagcugugcacgccgauaugggguacuggaucgagucucagaagaauggaagcuggaaacuggagaaggccuccuuuauugaagucaagaccugcacguggccuaaaucucacacacuguggagcaacggcgugcucgaguccgacaugaucauucccaagagccuggcugggccuaucucucagcauaaucaccgccccggauaucauacccaaaccgccggcccuuggcaccuugggaaacuggaacucgauuucaacuacugcgagggaacaaccguugugaucacggagaauuguggcacacggggccccucccugagaaccacaaccgucagcgggaagcugauucacgaauggugcugucgcucuugcacacuuccgccucuccgguauaugggagaggacggcuguugguacgggauggaaaucagacccauuaacgagaaagaagagaauauggugaagucccugguuagcgcgggaucuggcaagguggauaacuuuaccauggggguccugugccucgcuauccuguucgaggaagugaugcggggaaaauucggcaagaaacauaugauugccggcguucuuuuuacguucgugcugcuccugagcgggcagaucaccuggcgcgacauggcccacacacugauuaugaucggauccaaugcuagcgauagaaugggcaugggggucaccuaucuugcccugaucgcgacauuuaagauucagcccuuccucgcucugggauuuuuccuccggaaacugaccucuagagagaaccuucugcucggcguggggcuggccauggccacgacacugcaacuuccugaagacaucgagcagauggcuaauggaauugcccugggccucaugacccugaagcucaucacacaguuugaaaccuaccagcuguggaccgcucuugugucccugacauguagcaacacgauuuucacccucacagucgccuggcgcaccgcgacacugauccuggccggcguuucccuucugccgcucugccaaucuagcuccaugcggaagaccgauuggcugcccaugacgguggcugccaugggggugccuccccucccucuguuuaucuucucucuuaaagacacacccaagagacgcagcuggccucugaaugagggagucauggcugugggccugguuuccauucucgccucuagccugcuuagaaacgaugugcccauggccgggccgcuggucgcuggaggccuccugaucgcguguuaugugauuaccgggaccuccgccgaccucacaguugagaaagcugccgacgugaccugggaagaggaagccgagcagacaggagucagccauaaccugaugaucacgguggaugacgauggcaccaugcggauuaaggacgaugaaacagagaauauccuuaccguccugcugaaaacagcucuccugaucgugucuggcauuuuuccuuacuccauccccgccacccuucugguuuggcacacguggcagaagcagacccaacgcagcggggugcucugggacgucccuucucccccggagacacagaaagcggaacuggaggaaggaguguacagaauuaagcagcagggcaucuucgggaagacccaaguuggagugggcguccagaaagaggggguguuucauacaauguggcacgugacccggggagcuguucucacacacaacggcaagcgccuggagccuaauugggccuccgucaaaaaggaucuuauuagcuauggcgggggauggagacugucugcccaguggcaaaaaggcgaagagguccaggugaucgcugucgaacccgggaagaacccuaagaauuuccagacgaugcccggaauuuuccagaccacaaccggcgagaucggggccaucgcgcuggacuuuaaacccggaaccuccggcagcccuauuaucaaccgggaaggcaaggugguugggcucuacggaaauggcguggucaccaagaacgggggauauguguccggcauugcucaaacgaaugccgagccggaugggcccaccccugagcuggaagaggaaauguucaagaaacgcaaccuuacaaucauggaccugcaucccggcagcggaaagaccagaaaguaccucccugccauuguucgggaggcuaucaaacgcagacugcggacacucauccuggcccccaccagaguggucgcugccgaaauggaggaggcgcuuaagggccugccuauucgcuaucagacgacagccaccaaaucugaacacaccgggcgggagaucguggaucugaugugccaugcuacauuuaccaugagacuccugagcccgguucgcgugcccaauuacaaccuuauuaucauggacgaagcccacuucacagauccugcuuccauugccgcccggggauauaucucuaccagagucggcaugggggaggcugcggccaucuuuaugacggcuacacccccuggaaccgccgaagccuucccccagagcaaugcuccgauucaggacgaggagcgcgacaucccugaacgguccuggaacucuggcaaugaguggauuacagauuuuguggggaagaccgugugguucguccccagcaucaaagccggcaacgacauugcgaacugucugagaaagaauggaaagaaaguuauccaacucucccgcaagacguuugauaccgaauaccagaaaacacggcugaacgacugggauuucguggugaccacagacauuucugagaugggcgcuaauuuuaaggccgauagagucaucgacccccggcgcugccugaaaccugugauccucaccgaugggcccgagagaguuauucuugccggaccuaugccggugacagcugccagcgcggcccagcggcgcggcagagucgggcggaacccccagaaggaaaaugaccaauacaucuucaccggacagccucugaacaaugaugaggaccaugcucacuggacggaagccaagaugcugcucgacaacauuaauacacccgagggcaucauuccugcucuguucgaacccgagagagagaaauccgccgcuaucgauggggaauaucgccuuaagggcgagagccggaaaaccuuuguggaacugaugagacgcggagaccucccgguuuggcuggcccacaagguggcgucugagggcaucaaauacaccgaucggaaguggugcuucgacggggaaagaaacaaucagauucuggaggagaacauggaugucgaaaucuggacaaaagagggagaacgcaagaagcuccggccuagauggcuugacgcccgcaccuauuccgauccccuggcucugaaagaguuuaaggacuucgccgcuggcagaaaaagcauugcccucgaucuggugacagaaaucgggcgggucccuucucaucuugcccaccgcacgagaaaugcucuggacaaccucgugaugcugcauaccuccgagcacggaggccgggcguaccgccacgccguugaggaacugcccgagacaauggaaacccuccuucugcugggccucaugauucugcuuacagggggagcuaugcuguuucucaucagcggcaaggggaucggaaaaaccuccauuggccugaucugugugauugugucuagcgggaugcuguggauggccgaugucccucuccaguggaucgccuccgcuauuguucuugaguucuuuaugauggugcugcugauccccgagccggaaaagcaaagaacgccucaggacaaucagcucgccuauguggucauuggaauccugacccuugcggccaucguggcugccaacgagaugggccugcucgaaacaaccaagcgggaucugggcaugagcaaagagcccgggguugugucucccacauccuaccuggacgucgaccuccauccugcuagcgccuggacccuuuaugcgguggccacgacagucauuaccccgaugcugagacacacaaucgaaaauucuaccgcuaacgugagccuggccgcuauugccaaccaagcuguugugcucaugggacuggauaagggcuggcccaucuccaaaauggaccuuggggucccucugcucgcccugggaugcuacucucaggugaauccccugacccucacagcggccguucuucugcuggugacgcauuacgcuauuaucggcccugggcuccaggccaaggcuacccgcgaggcccagaaacggacagccgcgggaaucaugaagaaccccaccgucgauggcauuaugacaaucgaccuggauccugugauuuaugacagcaaguucgagaaacaacuuggccaggugaugcugcucguucugugugcuguccagcugcuccuuaugagaaccuccugggcccugugcgaagcucugacgcucgccacagggccgaucaccacccugugggagggaucucccggcaaguuuuggaauacaaccauugccgugagcauggcuaacaucuuccgcggguccuaccuugccggagcgggccuggccuuuagcaucaugaaaucuguggggacaggacggagaggcacgggcucccagggggaaacccucggagagaaguggaaaaagaagcugaaucaacugagccggaaagaguucgaucucuauaagaaauccggcauuacagaggucgaccgcaccgaggcuaaggaagggcuuaaaagaggagagacaacccaccaugccguuucucggggcagcgcuaagcugcagugguuuguggaacgcaacauggugaucccugaggggagagucauugaucugggauguggccggggcgggugguccuacuauugcgccggacucaaaaaggugacggaaguucgcggcuacaccaaaggcgggcccgggcacgaggagccugugcccaugucuacauauggguggaauaucgucaaacugaugagcggaaaggacguguucuaccuuccgccugaaaaaugugauacccugcucugcgacauuggcgaguccagccccucucccacaguugaagaguccagaaccauccgggugcugaagauggucgagccuuggcugaaaaacaaucaguucuguauuaaggugcucaaccccuacaugccuacagugaucgaacaccuugagcgccugcagagaaaguauggcgggaugcugguccggaauccgcucagcagaaacucuacccaugaaauguacuggaucuccaauggaacgggcaacauuguuagcucugugaauauggugagccgccugcuucugaaccgguuuacaaugacccacagacgccccaccaucgagaaagaugucgaccucggggcgggaacacggcaugugaacgccgaaccugagacgcccaauauggacguuauuggcgagagaaucaagcgcauuaaagaagaacacuccucuaccuggcacuaugaugacgaaaacccuuacaagacaugggcuuaucaugggagcuacgaggugaaagccaccggauccgcuagcuccaugaucaauggcgucgugaagcugcugacaaagcccugggauguugugccgauggucacccaaauggccaugacagacaccacgccuuucggccagcagcggguguuuaaagaaaagguugauaccagaacaccccgcccuaugcccgggacccggaaagugauggagaucacagcugaguggcucuggagaacccugggacgcaacaagaaaccucggcuuugcacgagagaagaguucacaaagaagguccgcaccaaugccgcgaugggcgccguguuuacagaagagaaccaaugggacucugcuagagccgcugucgaagaugaggaguucuggaaacugguggaccgggaacgcgagcuccacaagcuggggaaauguggaagcugcguuuauaauaugaugggcaagagagagaagaaacuuggggaguuuggcaaagccaagggaucccgggccauuugguacauguggcugggcgcgagauaccucgaguucgaagcucugggguuucugaacgaggaucauugguucucucgggaaaauagcuauuccggaguggagggcgaagggcuccacaagcugggauacauccuucgcgacauuucuaaaauccccggcggggccauguaugccgaugacaccgcuggcugggacacgagaauuaccgaggaugaccugcauaacgaggaaaagaucacacagcagauggauccggagcaccggcagcucgccaaugcuaucuuuaaacugaccuaccaaaacaaggucgugaaagugcagcgcccuacacccaagggaaccguuauggacauuaucagcagaaaggaucagcggggcuccggacaggugggaacauauggccuuaauaccuucacgaacauggaagcccaacugguccgccagauggagggggaaggagugcucagcaaagcggaccuggagaauccccaucugcucgagaagaaaauuacacaguggcuggaaaccaagggcguugagagacuuaaacggauggccaucucuggggaugacugcguggucaagccuauugaugaccgcuuugcuaacgcccugcucgcucugaacgauaugggcaaggugagaaaagacaucccgcaguggcaacccuccaagggauggcaugauuggcagcaggucccuuucuguagccaccauuuccacgaacuuaucaugaaagacggccggaagcuggugguucccugccgcccucaggacgagcucauugggagagcccggaucucucaaggagcgggcuggucccugaaagaaaccgccugucuggggaaggcuuacgcccagauguggagccucauguauuuucaccgcagagaucugcggcuugcuucuaaugccauuugcuccgcugugcccguccauugggugccuacaagcagaaccacaugguccauccacgcccaucaccaguggaugacgaccgaggacaugcugacaguuuggaaccgcguguggauugaggauaaucccuggauggaagacaagaccccggucacaaccugggaggaugugccuuaccucggaaaacgggaagaccaaugguguggcagccugaucgggcuuacgucuagagcgaccugggcccagaacauucugacagcuauccaacaggugcgcagccucaucggcgaugaggaguuccuggacuacaugcccuccaugaagcgguuuagaaaagaagaggaaucugagggagccauuugguga

SEQ ID NO: 20919 - RNA, 9873 nt, Artificial Sequence
  derived and/or modified CDS sequence (opt5) from DENV-3__DQ863638__SS-prME
acaagccucugccucaugaugaugcugcccgccacgcuugcuuuccaccugacgucccgggacggcgaaccucggaugaucguggggaagaaugaacgcggaaaaucucuccuguuuaagacagccagcggcauuaauauguguacacuuaucgcgauggaucugggggagaugugcgacgauaccgucacauacaaauguccgcauauugcugaaguugagcccgaagacaucgauugcugguguaaccucaccuccacaugggugaccuauggaacgugcaaucaggccggcgagcaccggcgggacaagcgcucuguggcccuggcuccucaugucgggaugggacuggauaccagaacacagaccuggaugagcgccgagggcgcuuggagacagguggaaaaaguugagacaugggcccuccgccaccccggcuucaccauucuggcgcuuuuucuggcccauuacaucgggacgucccucacacagaagguggucaucuucauucugcuuauccuggugaccccuucuauggcuaugagauguguuggagugggcaaccgggacuuugucgaagggcucagcggagccacauggguggaugugguccuggagcacggcgggugcguuaccaccauggcuaagaauaaacccacacuggacauugagcuccagaagacggaagccacccagcuggcgacacuucgcaaacuguguaucgagggaaagauuaccaacaucacaaccgauuccagaugcccuacgcagggcgaagccauucucccggaggaacaggaccagaauuauguguguaaacacacauacguggaucggggcugggggaacggaugcggccuguucgggaagggaagccuugugacaugcgcuaaguuucaaugucuggagucuaucgagggcaaagugguucagcaugaaaaucucaaguauaccgugaucauuacaguccacaccggggaccagcaucaggugggaaacgagacacaaggcguuacggccgaaaucacaccccaggcuuccacaguggaggccauucugccugaauacggcacccuggggcucgagugcagcccccgcacaggacuggacuucaaugagaugauccuucugaccaugaaaaacaaggccuggaugguccacagacagugguuuuucgaucucccucugcccuggacgucuggcgcuaccacagaaaccccgacauggaaucggaaagagcuucuggugaccuuuaagaacgcgcacgccaaaaagcaagaagucgugguucucgggucccaggagggagcuaugcauacggcccugacaggcgccaccgaaauucagaauagcgggggcacaucuaucuucgcuggacaccugaagugucgccucaaaauggacaagcuggagcuuaaaggcauguccuaugccaugugccugaacaccuuugugcucaagaaagaggucagcgaaacccagcaugggacaauccugauuaagguggaguacaagggagaagaugcgccuuguaaaauccccuucuccacggaggacggccaagggaaggcucacaacggaagacugauuaccgccaauccuguugugaccaagaaagaggaacccgucaacaucgaggccgaacccccuuucggcgagucuaauauugugaucgggaucggcgauaaagcucuuaagauuaacugguacaagaaaggaagcuccaucggcaagauguuugaagccaccgcuagaggggccagacgcauggcgauucucggagacacagccugggauuucggcagcgucggcgggguucucaauucucuggggaaaaugguccaucagaucuuuggguccgcuuauaccgcccucuucagcggcgugucuuggauuaugaagaucggaauuggcgugcugcuuacguggaucgggcugaacagcaaaaauacauccaugucuuuuagcugcaucgcuauuggaaucauuacccucuaccugggcgccgucgugcaggcggacaugggguguguuaucaacuggaagggaaaggagcugaaaugcggcuccgggauuuucgugaccaaugagguccacacauggaccgaacaguauaaguuucaagccgauagcccgaaacggcuugcuacagccaucgcuggcgccugggagaacggaguguguggcaucagaucuacgacccgcauggaaaaucuccuguggaagcagauugccaacgagcugaauuacauccucugggaaaacaauauuaaacugacaguuguggucggggacaucauuggagugcuugagcagggcaagcggacccugacaccccagccuauggagcucaaauauuccuggaagaccugggggaaggcuaaaaucguuacggcggaaacccaaaacagcucuuucaucauugauggaccccacacaccugagugccccagagccucccgcgcuuggaacgugugggaagucgaggacuacggcuuuggcguguucaccacaaauaucuggcugaagcugcgggaagaguauacccagcuuugugaccauagacucaugagcgccgccgugaaagaugagcgcgcuguccacgccgacaugggguacuggauugaaucccagaagaacggaucuuggaaacuggagaaggcgagccugaucgaaguuaagacaugcaccuggccgaaaucccauacgcucuggucuaauggcgugcuggagagcgauaugauuaucccuaagucccuugcugggcccaucagccagcacaaccaccggccuggauaccauacacaaaccgccggccccuggcaccuggggaaacucgagcuggacuuuaauuauugcgaaggaaccacaguggucauuaccgagaacuguggcacgagaggcccuucucugcgcacaaccacaguguccgggaaacuuauccaugaauggugcugucggagcugcacccugcccccgcugagauacaugggagaggauggcuguugguaugggauggaaauucggccuaucaaugagaaagaggaaaacaugguuaagucucuggccuccgcuggaagcggcaagguggacaauuucacaaugggguuucucugccuggccauucuuuucgaggaagucaugcgcggaaaauucggcaagaaacacaugaucgcgggcguguuucugaccuuccuccugcugcuuucugggcagauuacguggagagauauggcucauacccugaucaugaucggaagcaacgccuccgaccggaugggcauggggguuacauaccucgcccugauugcuaccuuuaagauccagcccuuccucgcccugggauuuuuccuuagaaaacugacaagccgcgagaauuuucuccugggcguggggcuggcuauggccaccacgcuucaacugcccgaagauauugagcagauggcgaacggaaucgcccucggccugauggcucucaagcugauuacacaguucgagaccuaucagcuuuggacagcccuggucucucucaccuguuccaauaccaucuuuacacugacgguggcuuggcggaccgccacacugauccuugccggcguuagccugcucccugugugccaauccucuagcaugagaaagaccgacuggcugccgauggcugucgcggccaugggggugcccccucucccccuguucauuuuuagccuuaaagauacacugaagcgcagaucuuggccucugaacgaaggagugauggcugucggccucguuagcauccuggccuccucucuucugcggaaugacgugcccauggccgggccucucguggcuggaggccugcucauugccuguuacgucaucaccgggacgagcgcggaucugacaguggagaaagcugccgacguuaccugggaagaggaagccgagcagaccggagugucccacaaccuuaugauuacagucgacgaugacggcaccaugcgcaucaaggaugacgagacagaaaacauccugacggugcugcucaaaaccgcucugcuuauuguuagcggcaucuuccccuauucuauuccggccacacugcucguguggcacaccuggcagaagcagacacaaagauccgggguccugugggaugugccuucucccccugagacccagaaagcggaacucgaggagggagucuaccggaucaagcagcagggcauuuuugggaagacgcaagugggaguuggcgugcagaaagaaggggucuuccauaccauguggcacgugacacgcggagcuguucugacccauaauggcaagagacuugagcccaacugggccuccgugaaaaaggaccugaucuccuacggcgggggauggcggcugagcgcccaguggcaaaaaggcgaagagguccaggugauugcuguggaaccggggaagaauccuaagaacuuccagacaaugcccggaaucuuucagaccacaacgggcgagaucggggccauugcucucgauuucaaaccuggaaccucuggcucccccaucauuaaucgcgagggcaagguugucgggcuguauggaaacggcguggugaccaagaaugggggauacgucagcggcaucgcccaaaccaacgcggaacccgacgggccuaccccggagcuugaagaggaaauguuuaagaaaagaaaucugacaauuauggaucuccaccccggcuccggaaagacgcggaaguaucugccugccaucgugcgcgaggcuaucaaaagacggcucagaacccugauucuugcccccacacgcguuguggcugccgagauggaagaggcccugaagggccugccuauccgguaccagaccacagcuaccaaaagcgaacauacggggagagagauugucgaccucaugugccacgcgacauucaccaugcgccugcuuucucccgugcggguuccuaacuauaaucugaucauuauggaugaagcccacuuuaccgacccggcuagcaucgccgccagaggauacaucuccacacgcgugggcaugggggaggcugccgcgauuuucaugaccgcuacacccccuggaaccgccgaugccuuuccccagucuaacgcuccuauccaggacgaggaacgggacauucccgagagaagcuggaacuccggcaacgaauggaucacggauuucgucgggaagacagugugguuuguuccgucuauuaaagccggcaaugacaucgcgaacugucuccgcaagaacggaaagaaagugauucaacugagccggaagaccuucgauacagaguaucagaaaaccaagcugaaugacugggauuuugucgugacgaccgacaucuccgagaugggcgccaacuucaaagcugauagagugaucgacccucggcgcugccucaagcccgucauucuuacagaugggcccgaaagaguuauccuggccggaccuaugcccgugaccgcugccucugcugcccagcggcgcggcagaguggggcggaauccucagaaggagaacgaccaauacauuuucagaggacagccgcugaauaacgaugaagaccaugcgcacuggacagaggccaaaaugcuccuggacaauaucaacacccccgaaggcauuaucccugcucuuuuugagcccgagcgcgaaaagagcgccgcuaucgauggggaguaccggcugaaaggcgaauccagaaagacauucgucgagcucaugcgccggggagaccugccuguguggcuggcccauaaaguugccagcgaaggcauuaaguauaccgauagaaaauggugcuuugacggggagcgcaauaaccagauccucgaggaaaauauggauguggagauuuggacgaaggaaggagagaagaagaaacuucggcccagauggcuggacgcucgcacauacucugauccgcuggcgcucaaagaguucaaagacuuugccgcuggcagaaaauccaucgcccuggaucuugucaccgagauugggcgggugccuagccaccuggcccaccgcaccagaaacgcucucgacaaucugguuaugcugcauacaucugagcacggaggccgggccuaucgccaugcgguggaggaacuccccgaaaccauggagacacuucugcugcucggccugaugauccuucugacagggggagccaugcuguuccugaucuccggcaaggggauuggaaagaccagcaucggccugauuugugucaucgcuuccucugggaugcucuggauggccgaugugccucuucaguggauugcuagcgccaucguccuggaguuuuucaugauggugcugcucauucccgaaccugagaaacaaagaacaccccaggacaaccagcuggcguacguugugaucggaauccuuacccuggccgcuauuguggccgcuaaugaaaugggccuccuggagacaaccaagcgggaucugggcauguccaaagaaccgggggucguuagcccuacgucuuaucucgacguggaccuucaccccgccuccgcuuggacccuguacgccguggcgacaaccgucaucacacccaugcugagacauaccauugagaacagcacggccaaugugucucucgcugccaucgcuaaccaagccguugugcugaugggacuugauaagggcuggccuauuagcaaaauggaccugggggucccgcuccuggcccugggaugcuauucccaggugaacccccucacacuuaccgcggcuguccugcugcucgccacacacuacgcuaucaucggcccugggcugcaggccaaggccacccgcgaggcucagaagcggaccgccgcgggaauuaccaagaaucccacgguggauggcaucaugaccauugaccuugauccuguuaucuacgacucuaaguuugaaaaacaacugggccaggugaugcuccugguccugugugccgugcagcuccuucugaugagaacaagcugggcucugugcgaggcccucacccuggcuacagggcccauuaccacgcuuugggaaggauccccuggcaaguucuggaacacaaccaucgccguuucuauggcgaauaucuuucgcgggagcuaucuggccggagcuggccucgccuucuccauuaugaaaagcguggggaccggaaagcggggcacaggcucucagggggagacccugggagaaaaguggaaaaagaaacugaaccaacucuccagaaaggaguuugaucuuuacaaaaagagcggcaucacagaggucgaccggacggaagcuaaagaggggcugaagcgcggagaaauuaccagacacgccgugucccggggcucugcuaagcugcagugguucguggagcgcaauaugguuaucccggaagggagagucauugaucucggauguggccggggcggguggagcuauuacugcgccggacugaaaaaggugacagaggugcgcggcuauaccaaagggggacccggccaugaggaaccuguccccauguccacauacggguggaacaucguuaaacuuaugucuggaaaagacguguucuaucugccucccgagaagugugauacccuccugugcgacauuggcgaaagcuccccgagcccuacgguggaggagucuagaaccauccggguccugaagaugguggaacccuggcucaaaaauaaccaguuuuguaucaagguucuuaaucccuacaugccuacagugauugagcaccuggaacgccugcagagaaaacauggcgggaugcucguccggaacccccuguccagaaauagcacccacgagauguacuggaucucuaacggaacaggcaauauuguguccagcguuaacauggugucucgccuucugcucaaucgguucaccaugacacacagacgcccuaccaucgaaaaggaugucgaccugggggcgggaacgcggcaugugaacgccgagccggagacacccaacauggacgugauuggcgaaagaaucaaacgcaucaaggaggaacacaauagcaccuggcauuaugaugacgagaacccuuacaagaccugggcuuaucacggguccuacgaagucaaagccacaggaucugcuagcuccaugauuaauggcguugugaagcugcucacgaaacccugggauguggucccuauggugauccaaauggccaugaccgacacaacccccuuuggccagcagcggguuuucaaggagaaaguggauacaagaaccccgcgcccuaugcccgggacacggaaggucauggagauuaccgccgaauggcuguggagaacgcuuggacgcaacaagcggccuagacugugcacccgcgaggaauuuaccaagaaggugagaaccaaugcggcuaugggcgccguuuucacagaggaaaaccaaugggacagcgcccgggcugccguggaggaugaggaauuuuggaaacucgucgaccgcgagagagaacugcauaaacuugggaaauguggauccugcguguauaauaugaugggcaagcgggagaaaaagcugggggaguucggcaaggcuaaaggaucuagagccaucugguacauguggcucggcgcgcgguaucuggaauuugaggcccugggguucuuuaacgaagaucacugguucagccgcgaaaauuccuacucuggaguugaaggcgaggggcuccacaagcugggauacauucuuagagacaucagcaaaauccccggcggggcuauguaugccgaugacaccgcuggcugggacacgcggauuacagaggaugaccugcauaacgaagagaagaucacccagcagauggauccugaacaccgccagcucgccaaugcgauuuuuaaacugacauaccaaaacaagguggucaaggugcagagacccaccccgaaaggaacggucauggacaucauuucccggaaggaucagcgcggcucuggacaggugggaaccuauggccuuaauacauucaccaacauggaggcccaacugguuagacagauggaaggggagggagugcucagcaaagcugaccuggagaauccucaucugcucgaaaagaaaaucacacaguggcuggagaccaagggcgucgaacggcuuaagcgcauggccaucuccggggaugacugcguggugaaacccauugaugacagauucgcuaacgcccugcucgcucugaacgauaugggcaagguucggaaagacaucccccaguggcaaccuagcaagggauggcacgauuggcaacaggugccguuuuguucucaccauuuccacgagcuuauuaugaaagacggccgcaagcuggucgugcccugcagaccucaggacgaacucaucgggcgggcccgcauuuccagaggagcgggcuggagccugaaggagacagccugucuggggaaggcuuacgcccaaauguggucucucauguauuuucaucggagagaucugcgccuugccuccaaugcuaucugcagcgccguucccgugcacugggucccuaccucucggacgacaugguccauucaugcgcaccaccaguggaugaccaccgaggacaugcugacaguguggaacagagucuggaucgaagauaaucccuggauggaggacaagaccccugugacaacgugggaagauguucccuaccucggaaaacgcgaggaccagugguguggcagccugaucgggcuuaccucccgggcuacaugggcccaaaacauucugaccgccauccaacaggugagaagccucauuggcaaugaggaguuccuggauuauaugccgucuaugaagcgcuuuaaaaaggaggaagagagcgaaggagcuaucugguga

SEQ ID NO: 20920 - RNA, 9873 nt, Artificial Sequence
  derived and/or modified CDS sequence (opt5) from DENV-3__KJ737430__SS-prME
accucccugugccugaugaugaugcugcccgccacccuugcuuuccaccugacgucccgggacggcgaaccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauugcugaaguugagcccgaagacaucgauugcugguguaaccugaccuccacaugggugaccuauggaacgugcaaucaggccggcgagcaucggcgggacaagcgcucuguggcccuggcuccucacgucgggaugggacucgauaccagaacacagaccuggaugagcgccgagggcgcuuggagacagguggaaaaaguugagacaugggcccugcgccaucccggcuucaccauucuugcgcuguuucucgcccacuacaucgggacgucccugacacagaagguggucaucuucauucuucugaugcucgugaccccuucuauggcuaugagauguguuggagugggcaaccgggacuuugucgaagggcugagcggagccacauggguggaugugguccuggagcauggcgggugcguuaccaccauggcuaagaauaaacccacacucgacaucgagcugcagaagacggaagccacccagcuugcgacacugcgcaaacucuguauugagggaaagaucaccaacauuacaaccgauuccagaugcccuacgcagggcgaagccauccugccggaggaacaggaccagaauuauguguguaaacacacauacguggaucggggcugggggaacggaugcggccuuuucgggaagggaagccuggugacaugcgcuaaguuucaaugucucgagucuauugagggcaaagugguucagcacgaaaaucugaaguauaccgugaucaucacaguccauaccggggaccagcaccaggugggaaacgacacacaaggcguuacgguggagauuacaccccaggccuccacagucgaagcuauccugccugaguacggcacccucgggcuggaaugcagcccccgcacaggacuugauuucaaugagaugauucugcucaccaugaaaaacaaggccuggauggugcauagacagugguuuuucgaccugccucuucccuggacgucuggcgccaccacagagaccccgacauggaaucggaaagaacugcucgucaccuuuaagaacgcucacgcgaaaaagcaagaggugguugugcuggggucccaggaaggagccaugcacacggcucugacaggcgccaccgagauccagaauagcgggggcacaucuauuuucgccggacaucucaagugucgccugaaaauggauaaacuugaacugaaaggcauguccuaugcuaugugccucaacaccuuuguccugaagaaagaggugagcgagacccagcacgggacaauccugaucaagguugaauacaagggagaggacgccccuuguaaaauucccuucuccacggaagauggccaagggaaggcgcauaacggaagacuuaucaccgcuaauccuguggucaccaagaaggaggagcccgugaacauugaagccgagcccccuuucggcgaaucuaauaucgugauugggaucggcgacaaagcccucaagaucaacugguacaagaaaggaagcuccauuggcaagauguuugaggcuaccgccagaggggcuagacgcauggccauccugggagauacagcgugggacuucggcagcguugggggaguccucaauucucucggcaaaauggugcaccagauuuuuggguccgccuauaccgcucuguucagcggcgugucuuggaucaugaagauuggaaucggcguccuucugacguggauugggcucaacagcaaaaauacauccaugucuuuuagcugcaucgccaucggaauuaucacccuguaccugggcgcugugguucaggccgauauggggugugugauuaacuggaagggaaaggaacuuaaaugcggcuccgggaucuucgucaccaaugaggugcauacauggaccgagcaguauaaguuucaagcggacagcccgaaacggcucgccacagcuauugccggcgcuugggaaaacggaguuuguggcaucagaucuacgacccgcauggagaaucugcuguggaagcagaucgccaacgaacucaauuacauucugugggagaacaauaucaaacuuacaguggucgugggggauauuaucggaguucuggaacagggcaagcggacccucacaccccagccuauggagcugaaauauuccuggaagaccugggggaaggccaaaauugugacggcugagacccaaaacagcucuuucaucaucgacggacccaacacaccugaaugccccuccgcgagcagagccuggaaugucugggagguggaagacuacggcuuuggcguguucaccacaaacauuuggcugaaacuucgcgaggucuauacccaguccugugaucaccggcucaugucugcugccaucaaagacgaaagagccguucacgcugauaugggguacuggauugagagccagaagaauggauccuggaaacuggagaaggccucuuuuaucgaagugaagacaugcaccuggccgaaaagccauacgcugugguccaacggcgugcucgagagcgacaugauuaucccuaagucucuggcggggcccaucucccagcacaaucaucgcccuggauaccacacacaaaccgcuggccccuggcaccuugggaaacuggaacucgauuucaacuauugcgagggaaccacagucgugauuaccgagaauuguggcacgcggggcccuagccugagaacaaccacaguuucugggaagcugauccaugaauggugcugucgcuccugcacccuucccccgcuccgguacaugggagaggacggcuguugguaugggauggaaauuagaccuaucaacgagaaagaagagaauauggucaagagccuggucucugccggaagcggcaagguggauaacuuuacaauggggguucugugccucgccauucuguucgaggaagugaugcggggaaaauucggcaagaaacacaugaucgcuggcguccuuuuuaccuucgugcugcuccuguccgggcagauuacguggcgcgacauggcccauacccugaucaugaucggaagcaaugcgucugauagaaugggcauggggguuacauaccuugcucugauugccaccuuuaagauccagcccuuccucgcccugggauuuuuccuccggaaacugacauccagagagaaccuucugcucggcguggggcuggcuauggccaccacgcugcaacuucccgaagacauugagcagauggcuaauggaaucgcccugggccucauggcgcugaagcucauuacacaguuugaaaccuaucagcuguggacagcccuugucagccugaccuguuccaacaccaucuucacacucacgguggcuuggcgcaccgccacacugauccuggcuggcgugucucuucugccugucugccaaagcuccucuaugcggaagaccgauuggcucccgauggccguugccgcuaugggggugcccccucugccccucuuuauuuucagccugaaagacacacuuaagagacgcuccuggccucugaaugagggagugauggcggucggccuggugucuauccucgccagcucccugcuuagaaacgauguucccauggcugggccucugguggccggaggccuccugauugccuguuacgucaucaccgggacgagcgcugaccucacaguggagaaagccgcggacguuaccugggaagaggaagcugagcagaccggagugucucacaaccugaugauuacagucgaugacgauggcaccaugcggaucaaggacgaugaaacagagaauauccuuacggugcugcugaaaaccgcccuccugauugucuccggcaucuuucccuauagcauuccggccacacuucugguguggcauaccuggcagaagcagacacaacgcucugggguucucugggacgugccuucucccccugagacccagaaagcugaacuggaggaaggagucuacagaaucaagcagcagggcauuuucgggaagacgcaagugggaguuggcgugcagaaagagggggucuuucacaccauguggcacgugacacggggagccgugcucacccauaacggcaagcgccuggagcccaauugggcgagcguuaaaaaggaucuuaucagcuacggcgggggauggagacuguccgcucaguggcaaaaaggcgaagagguccaggugauugccguggaaccggggaagaacccuaagaauuuccagacaaugcccggaaucuuccagaccacaacgggcgagaucggggccauugcucuggacuuuaaaccuggaaccagcggcucccccaucauuaaccgggaaggcaaggucguggggcucuauggaaauggcguugugaccaagaacgggggauacgucagcggcaucgcccaaaccaaugcugagcccgaugggccuaccccggagcuggaagaggaaauguucaagaaacgcaaccuuacaauuauggaccugcaccccggcucuggaaagacgagaaaguaucucccugccaucgugcgggaggcgaucaaacgcagacugcggacccucauucuggcccccacaagaguuguggcugccgaaauggaggaggcucuuaagggccugccuauccgcuaccagaccacagccaccaaaagcgaacauacggggcgggagauugucgaucugaugugccacgccacauuuaccaugagacuccugucccccgugcgcguuccuaauuauaaccuuaucauuauggacgaagcucauuucaccgauccggcgucuaucgccgcucggggauacaucagcacaagagugggcaugggggaggccgccgcuauuuuuaugaccgccacacccccuggaaccgcggaggcuuucccccaguccaaugccccuauccaggacgaggagcgcgacauucccgaacggucuuggaacagcggcaaugaguggaucacggauuuugucgggaagacagugugguucgugccguccauuaaagccggcaacgacaucgcuaacugucugagaaagaauggaaagaaagucauucaacucucucgcaagaccuuugauacagaauaucagaaaaccaagcugaacgacugggauuucguugugacgaccgacaucagcgagaugggcgccaauuuuaaagcggaucgggugaucgacccuagacggugccugaagcccgucauucucacagaugggcccgagcgcgugauccuugccggaccuaugcccguuaccgcugccuccgcugcccagagacggggccgcguggggagaaacccucagaaggaaaaugaccaauacauuuucacaggacagccgcugaacaaugaugaggaccacgcucacuggaccgaagccaaaaugcugcucgacaacaucaauacacccgagggcauuaucccugcgcuguucgaacccgagcgggaaaagagcgccgcuaucgauggggaauacagacuuaaaggcgagucucgcaagaccuuugucgaacugaugcggagaggagaccucccuguguggcuggcccauaaaguugcuuccgagggcauuaaguauacggaucgcaaauggugcuucgacggggaacggaacaaucagauccuggaggagaacauggauguggaaauuuggacaaaggagggagaaagaaagaaacuccgcccccgguggcuugacgccagaaccuacagcgauccgcuggcccugaaggaguuuaaagacuucgcugcgggccgcaagucuaucgcccucgaucuggucaccgaaauugggagagugccuucccaccuugcucaucggacacgcaaugcccuggacaaccucgucaugcugcacaccagcgagcacggaggcagagccuaucggcaugcuguggaggaacugcccgagacaauggaaacgcuccuucugcugggccucaugauccugcuuaccgggggagccaugcuguuucucaucuccggcaaagggauuggaaagacaucuaucggccugauuuguguuaucgugagcuccgggaugcuguggauggcggaugugccucuccaguggauugccagcgcuaucguccuugaguucuuuaugaugguucugcugauucccgagccugaaaagcaacgcacaccccaggacaaucagcucgccuacguggugaucggaauccugacacuugcugccauugucgcggccaacgagaugggccugcucgaaaccacgaaaagagaucugggcaugucuaaggagccgggggugguuuccccuaccagcuaucuggacguggaccuccaccccgcuucugccuggacacuuuacgcugucgccaccacagugaucacccccaugcugcggcauacgauugaaaauagcacagcuaacgucucccuggccgcgaucgccaaccaagcugugguucucaugggacuggauaaaggcuggccuauuucuaagauggaccuuggggugccgcugcucgcccugggaugcuauagccaggucaauccccugacccucacagcugccgugcuucugcugguuacccacuacgccaucaucggcccugggcuccaggcgaaagcuaccagagaggcccagaagcgcacagcugccggaauuaugaagaaccccacgguggauggcaucaugaccauugaccuggauccugucaucuacgacuccaaauucgagaagcaacuuggccaggugaugcugcucgugcugugugccguucagcugcuccuuaugcggacaucuugggcucugugcgaagcccugacccucgcgacagggcccauuaccacgcugugggagggaagcccuggcaaauuuuggaauacaaccaucgccgucuccauggcuaacaucuucagagggagcuaucuugccggagcuggccuggccuuuucuauuaugaaguccguggggaccggaaaacgcggcacaggcagccagggggaaacccucggagagaaguggaagaaaaagcugaaucaacugucccggaaagaguucgaucucuacaagaaaucuggcaucacagagguggacagaacggaggcgaaggaagggcuuaaacggggagagaccacacaucacgccgucagccgcggcuccgcuaagcugcagugguuuguugaaagaaacauggugauuccggaggggcgggugaucgaucugggauguggccgcggcggguggucuuauuacugcgccggacucaagaaagucaccgaagugagaggcuauacaaaagggggacccggccacgaggagccuguucccaugagcaccuacggguggaauauugugaaacugauguccggaaaggacgucuucuaucuuccucccgaaaaaugugauacgcugcucugcgacaucggcgagagcucuccguccccuaccguggaagagagccggacaauucgcguucugaagaugguggagcccuggcugaagaacaaucaguucuguaucaaaguccucaaccccuacaugccuaccgugaucgaacaucuugagagacugcagcggaaguacggcgggaugcuggugcgcaauccccucucuagaaacuccacacacgaaauguauuggauuagcaauggaaccggcaacaucgucucuagcguuaauauggugucccggcugcuucugaacagauuuacaaugacccaucgccggccuacgauugagaaagauguggaccucggggcuggaacaagacacgucaacgccgaaccggagacccccaauauggacgugaucggcgagcgcauuaagcggaucaaagaagaacacucuagcaccuggcauuacgaugacgaaaacccuuauaagacaugggcuuaccacggguccuaugagguuaaggccacgggaagcgcguccucuaugaucaauggcguggucaaacugcugaccaagcccugggaugugguuccuauggugauucaaauggccaugacagacaccacacccuucggccagcagagagucuuuaaagaaaagguggauacccgcacaccgcggccuaugcccgggaccagaaaaguuauggagaucacggcugaguggcucuggcgcacccugggacggaacaagagaccucgccuuugcacacgggaagaguucaccaagaaagugagaacaaaugccgcuaugggcgccgucuuuaccgaagagaaccaaugggacagcgcccgcgcggcuguggaagaugaggaguucuggaagcuggucgacagagaacgggagcuccauaaacuggggaaguguggauccugcguguacaauaugaugggcaaacgcgaaaagaaacuuggggaguuuggcaaggccaagggaucuagagccauuugguauauguggcugggcgcucgguaccucgaguucgaagcccugggguuucugaacgaggaucacugguucagcagagaaaauuccuacucuggaguugagggcgaagggcuccauaaacugggauauauccuucgggacauuagcaagauccccggcggggcuauguacgccgaugacacggcgggcugggacacacgcaucaccgaggaugaccugcacaacgaggagaagauuacacagcagauggauccugagcacagacagcucgccaaugcuaucuuuaagcugaccuaucaaaacaaaguggucaaggugcagcggcccacgccgaagggaaccgugauggacauuaucucccgcaaagaucagagaggcagcgggcagguuggaacauacggccuuaauaccuucacaaacauggaagcccaacuggugcggcagauggagggggaaggaguccucucuaaggcugaccuggagaauccucaucugcucgagaaaaagauuacccaguggcuggaaacaaaaggcguggagcgccuuaagagaauggccaucuccggggaugacugcguugugaagcccaucgaugaccgguuugcgaacgcccugcucgcucugaacgauaugggcaaaguccgcaaggacauuccccaguggcaaccuagcaaaggauggcacgauuggcaacaggugccguucuguucucaucacuuccacgaacuuaucaugaaggacggcagaaaacuggucgugcccugccggccucaggacgagcucauugggcgcgccagaaucucccaaggagcuggcuggagccugaaggaaaccgccugucuggggaaggcuuaugcccagauguggucucucauguacuuucaucggcgcgaucugagacuugcguccaaugccauuugcagcgcuguucccgugcacugggucccuacgucccggacaaccuggagcauccaugcccaccaucaguggaugaccacagaggacaugcugaccguguggaacagaguuuggauugaggauaaucccuggauggaagacaaaacaccugugacgaccugggaggauguccccuaucucggaaagcgcgaagaccaaugguguggcucucugaucgggcuuacaagccgggccaccugggcucagaacauccugacagccauucaacaggugagaucccucaucggcgaugaggaguuccuggacuacaugccgucuaugaaacgcuuucggaaggaagaggaaagcgagggagcgauuugguga

SEQ ID NO: 20921 - RNA, 9873 nt, Artificial Sequence
  derived and/or modified CDS sequence (opt5) from DENV-3__AY858040__SS-prME
accagccucugccucaugaugaugcuccccgccacacuugcuuuccaccugacgucccgggacggagagccucggaugaucguggggaagaacgaacgcggaaagucucuccuguuuaagaccgccagcggaauuaauauguguacacuuaucgcgauggaucugggggagaugugcgacgauaccgugacauacaaguguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagagcucaaaccuggaugagcgccgagggcgcuuggagacagguggaaaaaguugagacaugggccuuccgccaucccggcuuuaccauucuggcgcuuuuccuggcccacuacaucgggacgucccucacacagaagguggucaucuuuauucugcuuaugcuggugaccccuucuaugacaaugagauguguuggagugggcaaccgggacuucgucgaagggcucagcggagcuaccuggguggaugugguccuggagcauggcgggugcguuaccacaauggccaagaauaaacccacgcuggacaucgagcuccagaagaccgaagcuacacaacuggccacccuucgcaaacuguguauugagggaaagaucacaaacgugaccacggauuccagaugcccuacacagggcgaagcgauucucccggaggaacaggaccagaauuauguguguaaacacaccuacgucgaucggggcugggggaacggaugcggccuguuugggaagggaagccuugugaccugcgccaaguuccaaugucuggagcucaucgagggcaaaguugugcagcacgaaaaucugaaguauacagucauuaucaccgugcauacaggggaccagcaccagguuggaaacgagacgcaaggcgugaccgcugaaaucacaccccaggccucuaccgucgaggcuauucugccugaauacggcacacucgggcuggagugcagcccccgcaccggacuugacuuuaaugagaugauccugcucacgaugaaaaacaaggccuggauggugcauagacagugguucuuugaucugccucuucccuggaccagcggcgccacaaccgaaacaccgaccuggaauaaaaaggagcugcucgucacguucaaaaacgcucacgcgaagaagcaagaagugguugugcuggggucucaggagggagccaugcacacagcucugaccggcgccacagaaauucagaccuccgggggcaccagcaucuuugccggacaucucaaaugucggcugaagauggacaaacuugagcugaagggcaugucuuaugcuaugugcuccaaugccuucguccucaaaaaggaggugagcgaaacacagcacgggacgauucugaucaagguugaguacaaaggagaagaugcgccuuguaagauccccuucuccaccgaggacggccaagggaaagcucauaacggacgccugauuacagccaacccuguggucaccaagaaagaggaacccgugaauaucgaggccgaacccccuuuuggcgagucuaacauuaucauugggaucggcgauaaggcucuuaagaucaauugguacaaaaagggaagcuccauuggcaaaauguucgaagccacagcuagaggggcccggagaauggcgauccucggagacaccgccugggauuuuggcagcgucgggggaguucugaacucucugggcaagaugguccaccagauuuucggguccgcuuauacggcccucuuuagcggcgugucuuggaucaugaaaauuggaaucggcgugcugcuuacauggauugggcugaauagcaagaacaccuccaugucuuucagcugcaucgucaucggaauuaucacccucuaccugggcgcugugguucaggccgacauggggugugugauuaauuggaagggaaaagagcugaagugcggcuccgggaucuuugucacaaacgaggugcauaccuggacagaacaguauaaauuccaagcggauagcccgaagcgccuugccacggcuauugccggcgcuugggagaauggaguuuguggcauccggucuaccacaagaauggaaaaccuccuguggaaacagaucgccaaugagcugaacuacauucucugggaaaauaacaucaagcugaccguggucgugggggacauuaucggaguucuugagcagggcaaacgcacacugacaccccagccuauggagcucaaguauuccuggaagacgugggggaaagccaagauugugaccgcugaaaaacaaaauagcucuuuuaucaucgauggacccaacacaccugagugccccaacgcgucccgggccuggaaugucugggaaguggaggacuacggcuucggcguguuuaccacaaacauuuggcugaagcugagagaaauguauacccagcuuugugaccaccgccucaugagcgcugccgucaaagaugagcgggccguucacgcugacaugggguacuggaucgagucccagaagaauggaucuuggaagcuggaaaaagccagccugauugaggugaagacaugcaccuggccgaaaucccauacgcucuggucuaacggcgugcuggaaagcgauaugaucauuccuaagucccuugcggggcccaucagccagcacaauuacagaccuggauaucauacacaaaccgcuggccccuggcaccuggggaaacucgagcuggacuucaacuacugcgagggaaccacagucgugaucaccgaaaauuguggcacgcgcggcccuucucugcggacaaccacaguuuccgggaaacuuauucacgaguggugcuguagaagcugcacccugcccccgcugcgcuauaugggagaagauggcuguugguacgggauggagauccggccuauuaacgaaaaggaggagaauauggugaaaucucuggucuccgccggaagcggcaagguggacaacuuuacaauggggguucucugccuggccauccuuuucgaagaggugaugagaggaaaauucggcaagaaacauaugauugcuggcguccuguuuaccuucgugcuccugcugucugggcagaucacguggcgggauauggcccgcacccuuauuaugaucggaagcaaugcguccgacagaaugggcauggggguuacauaucuggcucucaucgccaccuuuaagauucagcccuuccuggcccucggauuuuuccugcggaaacuuacaagcagagaaaaccugcuccugggcguggggcuggcuauggccaccacgcuucaacugcccgaggauaucgaacagauggcuaauggaauugcccucggccugauggcgcucaaacugaucacacaguuugagaccuaccagcuuuggacagcccuggucucucucauguguuccaacaccauuuucacccugacaguggcuuggcgcacggccacccugauccuugcuggcaucagccugaugccugugugccaauccucuagcaugcggaagacagacuggcucccgaugaccgucgccgccauggggguucccccucugccccucuuuauuuucucccugaaagauacacuuaagagacgcucuuggccucugaaugagggagugauggcugugggccuggucagcauccucgcguccucucugcuuagaaacgacgugcccauggccgggccucugguugcuggaggccuccugauugccuguuaugugaucaccgggacgagcgccgaucucacagucgaaaaagcugccgacgugaccugggaggaagaggcggaacagaccggaguuucccacaaccugaugauuacaguggacgaugacggcaccaugcggaucaaggaugacgagacagagaauauccuuacgguccugcugaaaaccgcucuccugauugugagcggcaucuuucccuacucuauuccggccacacuucuggucuggcauaccuggcagaagcagacacaacgcuccggggugcucugggauguuccuucucccccugaaacccagaaggccgagcuggaagagggaguguacagaaucaaacagcagggcauuuucgggaagacgcaagucggagugggcguucagaaagaggggguguuucacaccauguggcaugucacacggggagcugugcucaccuauaacggcaagcgccuggaacccaauugggccuccgugaaaaaggaccuuaucuccuacggcgggggauggagacugagcgcguauuggcagaagggcgaggaaguucaagucauugcuguggagccggggaaaaacccuaagaauuuccagacaaugcccggaaucuuccagaccacaacgggcgaaaucggggccauugcccuggauuuuaaaccuggaaccucuggcucccccaucauuaaccgggagggcaagguggucgggcucuacggaaauggcgugguuaccaagaacgggggauaugugagcggcaucgcucagaccaaugccgagcccgacgggccuaccccggaacuggaggaagagauguucaagaagcgcaaccuuacaauuauggaucugcaccccggcuccggaaaaacgagaaaguaccucccugcuaucguccgggaagccaucaaacgcagacugcggacccucauucuggcgcccacaagagugguugccgcugagauggaggaagcccuuaagggccugccugugcgcuaucaaaccacagcuaccaaaagcgagcacacggggaaggaaaucgucgaccugaugugccaugccacauuuaccaugcggcuccugucucccgugagaguuccuaauuacaaccuuauuaucauggaugaggcccacuucaccgacccggcuagcauugcggcccgcggauacaucuccacacgggugggcaugggggaagcugccgccaucuuuaugaccgcuacacccccuggaaccgccgaugcguucccccagucuaaugcuccuauucaggacgaggagagagacauccccgaacgcagcuggaacuccggcaaugauuggauuacggacuuugccgggaagacagucugguucgugccgucuaucaaagccggcaacgauauugcuaacugucugcggaagaauggcaagaaggugauccagcucagcagaaaaaccuuugacacagaguaucaaaagaccaagcugaacgauugggacuucgucguuacgaccgauauuuccgaaaugggcgccaauuuuaaagcggaccgcgugaucgauccucggagaugccugaagcccgugauccucacagacgggcccgagcgggucauucuugccggaccuaugcccgugaccguugcuucugccgcucagcgcagaggccggguggggcgcaacccucagaaagagaaugaucaguacaucuucacaggacaaccgcugaacaaugacgaagaccaugcccacuggaccgaggcuaagaugcugcucgauaacauuaauacacccgaaggcaucauuccugcccuguucgagcccgaaagagagaaaagcgcggccaucgacggggaguaucggccuaagggcgaauccagaaaaaccuuugucgagcuuaugcgccggggagaucugcccguguggcucgcucauaagguugccagcgaaggcaucaaguacacggacagaaaauggugcuucgauggggagcgcaacaaucagauucuggaagagaacauggacguggagaucuggacaaaggaaggagagaaaaagaaacugcggccgagauggcucgaugcucgcaccuauucugacccucuugcccugaaggaauuuaaggauuucgccgcuggccggaaauccauugcgcuggaccucgucaccgagaucgggagagugcccagccaccuggcccaccgcacaagaaaugcucuugauaaccuggucaugcuccauaccucugaacacggaggccgggccuaccgccaugccguggaggagcugccugaaacaauggagacgcugcuccuucugggccugaugauucuccugaccgggggagcuaugcuuuuucugaucuccggcaaggggguuggaaaaacaagcaucggccucauuugugugguggccuccucugggaugcuguggauggcggacaucccccugcaguggauugccagcgcuaucguccucgaguucuuuaugaugguucuucugauuccugagcccgagaagcagagaaccccgcaagauaaucagcuggccuauguggugaucggcauucucacacuggcugccaucgucgcggccaacgaaaugggccuucuggagaccacgaaacgggaccucggcauguccaaggaaccuggggugguuagccccaccucuuaccuggacguggaucugcaccccgcuuccgccuggacacucuacgcugucgccaccacagugaucaccccuaugcuucgccacacgauugagaauagcacagcuaacgucucucuggccgcgaucgccaaccaggcugugguucugaugggacucgacaagggcuggccgauuagcaaaauggaucugggggugccccuucuggcccucggaugcuauucccaagucaauccucugacccugacagcugccgugcuccuucugguuacccauuacgccaucauuggccccgggcugcaggcgaaggcuaccagagaagcccagaaacggacagcugccggaaucaugaagaacccuacgguggacggcaucaugaccauugaucucgaccccgucaucuaugauucuaaauucgagaagcagcugggccaagugaugcuucuggugcucugugccguucagcugcugcucaugagaacaagcugggcuuuuugcgaggcccuuacccuggcgacagggccuauuaccacgcugugggaaggauccccgggcaaguucuggaauacaaccaucgccgucucuauggcuaacauuuuucgcgggagcuaccucgccggagcuggccuggccuucuccaucaugaaaagcguggggaccggaaagcggggcacaggcucucagggggagacccuuggagaaaaauggaagaaaaagcugaaucagcucuccagaaaagaguuugaccuguauaaaaagagcggcaucacagaaguggaucgcacggaggcgaaagaggggcugaagcggggagaaauuacccaccaugccgucuccagaggcucugcuaaacuccaaugguucguugagcggaacauggugauccccgaagggcgcgugauugaccuuggauguggcagaggcggguggagcuacuauugcgccggacugaagaaagucacagaggugcggggcuacaccaaagggggaccuggccacgaagaacccguuccuauguccacauacggguggaauaucgugaagcugaugucuggaaaagaugucuucuaucugcccccggagaagugugacacccugcuuugcgauauuggcgaaagcuccccuagccccacgguggaggaaucucgcaccaucagaguucugaaaaugguggagcccuggcucaagaacaaucaguuuuguauuaaaguccugaacccuuacaugcccacagugaucgagcaucuggaacggcuccagcgcaagcacggcgggaugcuugugagaaauccucugucccggaacagcacccacgagauguauuggaucucuaauggaacaggcaacauugucuccagcguuaauauggugucucgccugcuccugaacagauucaccaugacauaccggagaccgaccaucgaaaaggacguggaccuuggggcuggaacgcgccaugucaacgccgagcccgaaacaccuaauauggaugugauuggcgagcggaucagacgcauuaaagaggaacacagcuccaccuggcauuaugacgaugagaaccccuacaagaccugggcuuaucacgggucuuacgaaguuaaagccacaggaagcgcguccagcaugaucaauggcguggucaagcugcucacgaaaccuugggacgugguucccaccgugacacagauggccaugaccgauacaaccccguuuggccaacagcgggucuucaaggagaagguggacacaagaaccccuaaacccaugccugggacgcgcaagguuauggaaaucaccgcugaguggcuguggcggacacugggaagaaacaaacgcccccggcucugcaccagagaggaauuuacaaagaaagugcgcaccaaugccgcuaugggcgccgucuucacggaggaaaaccagugggauuccgcccgggcggcuguggaggacgaagaguuuuggaagcuggucgauagagagcgcgaacuucacaaacuggggaaguguggaucuugcguguacaauaugaugggcaagagagagaaaaagcucggggaguucggcaaagccaagggaagccgggccauuugguauauguggcugggcgcucgcuaccuugaguuugaggcccugggguuccucaacgaagaccauugguuuuccagagaaaauucuuauagcggaguugaaggcgaggggcugcacaaacugggauacauccuccgggauauuuccaagaucccuggcggggcuauguaugccgacgacacagcgggcugggauaccagaauuacagaagacgaucugcauaacgaggagaagaucacccaacagauggaacccgagcaccggcagcuugccaaugcuaucuucaaacugacguaccagaacaagguggucaaagugcaacgcccgaccccuaagggaacagugauggacauuaucucuagaaaagaucagcggggcagcgggcagguuggaaccuauggccucaauacauuuaccaacauggaagcccagcugauucgccaaauggagggggaagacgugcuuuccaagacagaucuggagaauccccaucuccuggagaagaaaaucacccaguggcuggaaacgaagggagucgagagacucaaacggauggcuauuagcggcgacgauugcgugguuaagcccaucgacgaucgcuucgccaacgcgcugcuugcccugaacgacauggggaaagugagaaaggauaucccucaguggcagccgucuaagggcuggcacgacuggcaacagguccccuucuguucccaccauuuucacgaacucauuaugaaagacggacggaagcugguggucccuugccgcccccaggaugagcuuaucggcagagcucggauuagccagggggccggauggucucugaaagaaacagcuugucucggcaaggccuacgcucaaaugugggcccugauguacuuccaucgcagagaccugcggcucgcguccaaugccaucugcagcgcugugccuguucacugggugcccaccucucgcaccacaugguccauucacgcccaucaccaguggaugaccacagaggauaugcugacggucuggaacagaguguggaucgaggacaauccuuggauggaagauaaaacccccguuacaaccugggaggacgugccguaucuugggaagcgggaagaucagugguguggaagccugauuggccucacauccagagccaccugggcucaaaacauccugacggccauccagcagguccgcagccuuauugggaaugaggaguuucuggacuacaugccuucuaugaagcgguucagaaaagaagaggaaagcgagggcgcgaucugguga

SEQ ID NO: 20922 - RNA, 9873 nt, Artificial Sequence
  derived and/or modified CDS sequence (opt5) from DENV-3__AY858041__SS-prME
acaagccugugccucaugaugaugcugcccgccacacuugcuuuccaccugacgucccgggacggcgagccucggaugaucguggggaagaacgaacgcggaaagucucuccuguuuaagaccgccagcggcauuaauauguguacacuuaucgcgauggaucugggggagaugugcgacgauaccgugacauacaaauguccgcucauuaccgaaguugagcccgaagacaucgauugcugguguaaccugacauccaccugggugacguauggaaccugcaaucaggcuggcgagcaucggcgggacaagcgcucuguggcccuggccccucacgucgggaugggacucgauacaagagcucagaccuggaugagcgccgagggcgcuuggagacagguggaaaaaguugagacaugggccuuccgccaucccggcuuuaccauucuggcgcuuuuccuggcccacuacaucgggacgucccucacacagaagguggucaucuuuauucugcuuaugcuggugaccccuucuaugacaaugagauguguuggagugggcaaccgggacuucgucgaagggcucagcggagcuaccuggguggaugugguccuggagcauggcgggugcguuaccacaauggccaagaauaaacccacgcuggacaucgagcuccagaagaccgaagcuacacagcuggccacccuucgcaaacuguguauugagggaaagaucacaaacgugaccacggauuccagaugcccuacacagggcgaagcgauucucccggaggaacaggaccagaauuauguguguaaacacaccuacgucgaucggggcugggggaacggaugcggccuguuugggaagggaagccuugugaccugcgccaaguuccaaugucuggagcucaucgagggcaaaguugugcagcacgaaaaucugaaguauacagucauuaucaccgugcauacaggggaccagcaccagguuggaaacgagacgcaaggcgugaccgcugaaaucacaccccaggccucuaccgucgaggcuauucugccugaauacggcacacucgggcuggagugcagcccccgcaccggacuugacuuuaaugagaugauccugcucacgaugaaaaacaaggccuggauggugcauagacagugguucuuugaucugccucuucccuggaccagcggcgccacaaccgaaacaccgaccuggaauaaaaaggagcugcucgucacguucaaaaacgcucacgcgaagaagcaagaagugguugugcuggggucucaggagggagccaugcacacagcucugaccggcgccacagaaauucagaccuccgggggcaccagcaucuuugccggacaucucaaaugucggcugaagauggacaaacuugagcugaagggcaugucuuaugcuaugugcuccaaugccuucguccucaaaaaggaggugagcgaaacacagcacgggacgauucugaucaagguugaguacaaaggagaagaugcgccuuguaagauccccuucuccaccgaggacggccaagggcaggcucauaacggacgccugauuacagccaacccuguggucaccaaaaaggaggaacccgugaauaucgaggccgaaucucccuuuggcgagagcaacauuaucauugggaucggcgauaaagcucuuaagaucaauugguacaagaaaggauccagcauuggcaagauguucgaagccacagcuagaggggcccggagaauggcgauccucggagacaccgccugggauuuuggcucugucgggggaguucugaacucccugggcaaaaugguccaccagauuuucgggagcgcuuauacggcccucuuuucuggcgugagcuggaucaugaagauuggaaucggcgugcugcuuacauggauugggcucaauuccaaaaacaccucuaugagcuucuccugcaucgucaucggaauuaucacccucuaccugggcgcugugguucaggccgacauggggugugugauuaauuggaagggaaaggagcugaaaugcggcagcgggaucuuugucacaaacgaggugcauaccuggacagaacaauauaaguuccaggcggauucuccuaaacgccuugccacggcuauugccggcgcuugggagaauggaguuuguggcauccgguccaccacaagaauggaaaaccuccuguggaagcagaucgccaaugagcugaacuacauucucugggaaaauaacaucaaacugaccguggucgugggggacauuaucggaguucuugagcagggcaagcgcacacugaccccgcaacccauggagcucaaauauagcuggaagacgugggggaaggccaaaauugugaccgcugaaauccaaaauucuuccuuuaucauugauggaccuaacacacccgagugcccuaacgcgagccgggccuggaaugucugggaaguggaggacuacggcuucggcguguuuaccacaaacaucuggcugaagcugagagaaauguauacccagcuuugugaccaccgccucauguccgcugccgucaaagaugagcgggccguucacgcugacaugggguacuggauugagucucagaagaauggaagcuggaaacuggaaaaggccucccugaucgaggugaagacaugcaccuggcccaaaucucauacgcucuggagcaacggcgugcuggaauccgauaugauuaucccgaagucccuugcggggccuaucucucaacacaauuacagacccggauaucauacacagaccgcuggcccuuggcaccuggggaaacucgagcuggacuucaacuacugcgagggaaccacagucgugauuaccgaaaauuguggcacgcgcggccccucccugcggacaaccacaguuagcgggaaacuuauccacgaguggugcuguagaucuugcacccucccuccccugcgcuauaugggagaugacggcuguugguacgggauggaaauucggccgaucaacgagaaagaagagaauauggugaagucccuggucagcgccggaucuggcaagguggauaacuuuacaauggggguucucugccuggccauucuuuucgaggaagugaugagaggaaaauucggcaagaaacauaugaucgcuggcguccuguuuauguucgugcuccugcugagcgggcagauuaccuggcgggacauggcccgcacgcuuaucaugaucggauccaaugcgagcgauagaaugggcauggggguuaccuaucuggcucucauugccacauuuaagauccaaccuuuccuggcccucggauuuuuccugcggaaacuuaccucuagagagaaccugcuccugggcguggggcuggcuauggccacaacccuucagcugcccgaagacauugagcagauggcuaauggaaucgcccucggccugauggcgcucaagcugauuacgcaguuugaaacauaccaacuuuggaccgcccuggucucccucacauguagcaacaccaucuucacccugacaguggcuuggcgcacggccacccugauccuugcuggcauuucccugcuccccgugugccagucuagcuccaugcggaagacagauuggcugccuaugaccgucgccgccauggggguuccgccccucccucuguuuaucuucucucuuaaagacacacugaagagacgcagcuggccccugaaugagggagugauggcugugggccucgucuccauucuggcgucuagccuucugagaaacgaugugccuauggccgggccccucguugcuggaggccugcucaucgccuguuaugugauuaccgggacguccgccgaccugacagucgagaaagcugccgacgugaccugggaagaggaagcggagcagaccggaguuagccacaaccuuaugaucacaguggaugacgauggcaccaugcggaucaaggacgaugaaacagagaauauucugacgguccugcucaaaaccgcucugcuuaucgugucuggcauuuuuccuuacuccauccccgccacacugcucgucuggcauaccuggcagaagcaaacacagcgcagcggggugcugugggacguuccgucuccucccgagacccagaaagccgaacucgaggaaggaguguacagaauuaagcagcaaggcaucuucgggaagacgcaggucggagugggcguucagaaagaggggguguuucacaccauguggcaugucacacggggagcugugcugaccuauaacggcaagcgccuugagccuaauugggccuccgugaaaaaggaucugauuagcuacggcgggggauggagacugucugcgcaauggaaaaagggcgaagagguucaggucaucgcuguggaacccgggaagaacccgaaaaauuuccagacaaugccuggaaucuuccagaccacaacgggcgagauuggggccaucgcccucgacuuuaagcccggaaccuccggcagcccuauuaucaaccgggaaggcaaaguggucgggcuguauggaaauggcgugguuacaaagaacgggggauacguguccggcauugcucaaaccaaugccgagcccgaugggcccaccccugagcuugaagaggaaauguucaaaaagcgcaaccugacaaucauggaccuccacccgggcagcggaaagacgagaaaauaucugcccgcuaucguccgggaggccauuaagcgcagacuccggacccugauccuugcgccuacaagagugguugccgcugaaauggaggaggcccugaaaggccugcccauucgcuaccagaccacagcuaccaagucugaacacacggggaaagagaucguggaucucaugugccaugccacauuuaccaugcggcugcuuagcccugucagagugcccaauuauaaccugauuaucauggacgaagcccacuucaccgauccugcuuccaucgcggcccgcggauacauuucuacacggguuggcaugggggaggcugccgccaucuuuaugaccgcuacaccgcccggaaccgccgacgcguucccucagagcaaugcucccauucaggacgaagagagagauaucccugagcgcuccuggaacucuggcaaugacuggauuacggauuuugccgggaagacagugugguucguccccagcaucaaggccggcaacgacauugcuaacugucuccggaaaaauggaaagaaagugauccaacuguccagaaagaccuuugauacagaauaccagaaaaccaagcugaacgacugggauuucguggucacgaccgacaucucugagaugggcgccaauuuuaaggcggaucgcguuauugacccgcggagaugccucaaaccugugauccuuacagaugggcccgaacgggugauucuggccggacccaugccugucaccguggcuagcgccgcucagcgcagaggccggguugggcgcaacccccagaaggagaaugaccaauauaucuucacaggacagccucugaacaaugacgaggaucaugcccacuggaccgaagcuaaaaugcuccuggacaacauuaauacaccggagggcaucauccccgcccuuuucgaaccugagagagaaaaguccgcggccauugauggggaguaccggcugaaaggcgagagcagaaagaccuuuguggaacucaugcgccggggagaccugcccgucuggcuggcucauaaaguggccucugagggcaucaaguauacggauagaaaguggugcuucgacggggaacgcaacaaucagauucucgaggaaaacauggauguugagaucuggacaaaagagggagaaaagaagaaacuucggccuagauggcuggacgcucgcaccuacuccgauccccuggcccucaaagaguuuaaagacuucgccgcuggcagaaagagcauugcgcuggaucuugugaccgaaaucgggagagucccgucucaccuggcccaccgcacaagaaaugcucucgacaaccuggugaugcugcauaccuccgagcacggaggccgggccuaucgccaugccgucgaggaacugccugagacaauggaaacgcuucugcugcucggccugaugauccuucugaccgggggagcuaugcucuuucugauuagcggcaaaggggugggaaagacauccaucggccugauuuguguuguggccucuagcgggaugcucuggauggcggauaucccccuucaguggauugccuccgcuaucgugcuggaguucuuuaugaugguccugcucauuccugaacccgagaaacaaagaaccccucaggacaaucagcuggccuacguugugaucggaauccuuacacuggcugccauuguggcggccaacgagaugggccuccuggaaaccacgaagcgggaccugggcaugagcaaagagcccggggucgugucuuccaccagcuaucucgauguugaccuucacccggcuucugccuggacacuguacgcuguggccaccacagucaucaccccuaugcugcgccacacgauugaaaauagcacagcuaacgugucccucgccgcgaucgccaaccaagcugucgugcugaugggacuugauaagggcuggcccauuucuaagauggaccuggggguuccccuccuggcccugggaugcuacagccaggugaauccucucacccuuacagcugccguccugcugcucgugacccauuaugccaucaucggcccggggcugcaggcgaaagcuaccagagaggcccagaagcggacagcugccggaauuaugaaaaaccccacgguugauggcaucaugaccauugaccuugauccugugaucuacgacuccaaguucgaaaaacaacugggccaggucaugcuccuggugcugugugccgugcagcuccuucugaugagaacaucuugggcuuuuugcgaggcccugacccucgcgacagggcccauuaccacgcugugggagggaagcccuggcaaguucuggaauacaaccaucgccguuuccauggcuaacaucuuucgcgggagcuaucuugccggagcuggccuggccuucucuauuaugaaguccgucgggaccggaaaacggggcacaggcagccagggggaaacccucggagagaaguggaaaaagaaacugaaucaacuguccagaaaggaauuugaucucuacaaaaagucuggcaucacagagguggaccgcacggaagcgaaggaggggcuuaaacggggagagauuacccaccaugccgugagcagaggcuccgcuaagcugcagugguucgucgaacggaacaugguuauccccgaggggcgcgugauugaucugggauguggcagaggcggguggucuuauuacugcgccggacucaaaaaggugacagaaguccggggcuauaccaaagggggaccuggccacgaggaaccggugcccaugagcacauacggguggaauaucguuaagcugauguccggaaaggacguguucuaccuuccucccgagaaaugugauacccugcucugcgacauuggcgagagcucuccuucccccacggucgaagagagccgcaccaucagagugcugaagaugguugaaccguggcugaaaaacaaucaguuuuguaucaaggugcucaacccuuauaugcccacagucauugagcaucuugagcggcugcagcgcaaacacggcgggaugcuggugagaaauccccucucucggaacuccacccacgaaauguacuggaucagcaauggaacaggcaacauugugucuagcgucaauaugguuucccgccugcuucugaacagauucaccaugacauaucggagaccuaccaucgagaaggacguggaucucggggcuggaacgcgccaugugaacgccgaacccgagacaccuaauauggacgucauuggcgaacggaucagacgcaucaaggaggagcacucuagcaccuggcauuacgaugacgaaaacccguauaaaaccugggcuuaccacggguccuaugaggugaaggccacaggaagcgcguccucuaugauuaauggcguugugaaacugcugacgaagcccugggaugucgugccuaccguuacacaaauggccaugaccgacacaacccccuuuggccagcagcggguguucaaagaaaaggucgauacaagaaccccuaagcccaugccggggacgcgcaaagugauggagaucaccgcugaauggcucuggcggacacugggaagaaacaagcgcccucggcuuugcaccagagaggaguuuaccaagaagguucgcaccaaugccgcuaugggcgccguguucacggaagagaaccaaugggacagcgcccgggcggcugucgaagaugaggaauuuuggaaacugguggacagagagcgcgagcuccacaagcaggggaaauguggauccugcgucuacaauaugaugggcaagagagaaaagaaacugggggaguucggcaaggccaaaggaucucgggccauuugguacauguggcuuggcgcucgcuaucuggaauuugaggcccucggguuccugaacgaggaucauugguuuagcagagaaaauuccuacucuggaguggagggcgaagggcugcacaagcucggauauauccugcgggacauuagcaaaauccccggcggggcuauguacgccgacgauacagcgggcugggacaccagaaucacagaggaugaccuucauaacgaagagaagauuacccagcagauggauccugagcaccggcaacuggccaaugcuaucuucaagcucacguaucagaacaaaguugugaagguccagcgccccaccccuaaaggaacagugauggacauuaucuccagaaaggaucagcggggcagcgggcaagugggaaccuacggccugaauacauuuaccaacauggaagcccagcuuauucgccagauggagggggaaggaguucugucuaaaacagaccucgagaauccccaucugcuggaaaagaagaucacccaguggcucgagacgaaaggcguggagagacugaagcggauggcuaucuccggggaugacugcgucgugaaaccgauugaugaccgcuucgccaacgcgcuucuggcccucaacgauaugggcaagguuagaaaagacaucccucaauggcagcccagcaagggauggcacgacuggcaacaggugcccuucuguucucaccauuuucacgaacugauuaugaaggauggccggaaacuugucgugccuugccgcccgcaagacgagcugaucgggagagcucggauuucccagggagccggcuggagccucaaggaaacagcuugucuggggaaagccuaugcucagaugugggcccugauguacuuccaucgcagagaucuccggcuggcgucuaaugccaucugcuccgcuguccccgugcacuggguuccuaccagccgcaccacaugguccauucacgcccaucaccaauggaugaccacagaggacaugcuuacgguguggaacagagucuggaucgaagauaaucccuggauggaggacaagaccccugugacaaccugggaggauguucccuaccugggaaaacgggaagaccagugguguggcagccucaucgggcugacaucuagagccaccugggcucagaacauucuuacggccauccagcaagugcgcagccugauuggcaaugaggaauuucucgauuauaugccuuccaugaagcgguucagaaaggaggaggaaucugagggagcgaucugguga

SEQ ID NO: 20923 - RNA, 9873 nt, Artificial Sequence
  derived and/or modified CDS sequence (opt5) from DENV-3__KC261634__SS-prME
accagcaucugccugaugaugaugcuccccgcuacacuggcuuuccaccuuacgucccgggacggcgagccucggaugauuguggggaagaacgaacgcggaaagucucugcucuuuaagaccgccagcggcaucaauauguguacacugauugcgauggaucuuggggagaugugcgacgauaccgugacauacaaguguccgcugaucgcugaaguugagcccgaagacauugauugcugguguaaccucaccuccacaugggugaccuauggaacgugcaaucaggccggcgagcacagacgggacaagcgcucuguggcccuggcuccucacgucgggaugggacuggauaccagaacacagaccuggaugagcgccgagggcgcuuggagacagguggaaaaaguugagacaugggcccuccgccaucccggcuucaccauccuggcgcuuuuucuggcccacuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcauggcgggugcguuaccacaauggccaagaaucgccccacgcuggacauugagcuccagaaaaccgaagcuacacagcuggccacccuuagaaagcuguguaucgagggaaaaauuacaaacaucaccacggauucccggugcccuacacagggcgaagcggugcucccggaggaacaggaccagaauuauguguguaagcacaccuacgucgaucgcggcugggggaacggaugcggccuguucgggaaaggaagccuugugaccugcgccaaguuucaaugucuggagcccauugagggcaagguugugcaguaugaaaaucucaaauacacagucaucaucaccgugcacacaggggaccagcaucagguuggaaacgacacgcaaggcgugaccgucgagauuacaccucaggcuucuaccguggaagccguccugcccgaguauggcacacuggggcucgaaugcuccccuagaaccggacuggauuucaaugagaugauccuucugacgaugaagaacaaggcuuggauggugcaccggcagugguuuuucgaccucccccugccguggaccagcggcgccacaaccgagacaccuaccuggaaucgcaaggaacuucugguuacguuuaaaaacgcccaugcuaagaaacaagagguggucgugcucgggucucaggaaggagcgaugcacacagcccugaccggcgcuacagagauucaaaauuccgggggcaccagcaucuucgccggacaccugaaguguagacucaagauggauaaacuggaacuuaagggcaugucuuacgccaugugccugaacaccuuuguucucaaaaaggagguguccgagacacagcaugggacgauucugauccgggucgaauacaaaggagaggacgcucccuguaagaucccuuucagcaccgaagauggccaagggaaggcccacaacggaagacugauuacagcgaaucccguggugaccaaaaaggaggagcccguuaacaucgaagcugagccuccguucggcgaauccaauauugucaucgggacaggcgacaaagcccuuaagauuaacugguauaaaaagggaucuagcaucggcaagauguuugaggccaccgcucgcggggcccggagaauggcuauccucggagauacggccugggacuucggcuccgucggcggggugcugaauagccuggggaaaauggcgcaucagauuuuugggucugccuacacagcucucuucuccggcgucagcuggaucaugaagauuggaaucggcgugcugcuuaccuggauugggcugaacucuaaaaauaccagcauguccuuuucuugcaucguuauuggaaucaucacacucuaucugggcgccgugguccaggcugauauggggugugugauuaacuggaagggaaaagaacugaagugcggcagcgggaucuucguuaccaaugaggugcacacauggacggagcaguacaaguuucaagccgacucccccaaacgccuugcgaccgccauugcuggcgccugggaaaacggagucuguggcauccggagcacaaccagaauggagaaucuccuguggaagcagauugcuaacgaacugaauuauauccucugggagaacaauaucaaacugacagugguugugggggauauuaucggaguccuugaacagggcaagcgcacccugacgccucagcccauggagcucaaauacucuuggaagaccugggggaaagccaagauugugacagccgagauccaaaacuccagcuucauuaucgacggaccuaacacccccgaaugcccgucugcuucccgggcguggaaugugugggaggucgaagacuauggcuuuggcguuuucacaaccaacaucuggcugaagcugagagagguguacacacagagcugugaucaucgccuuauguccgccgcuauuaaagacgaacgggccgugcacgccgauaugggguacuggaucgagucucagaagaauggaagcuggaaacucgagaaggcuuccuuuauugaagucaaaaccugcacguggccuaagucucacacacuguggagcaacggcgugcuggaguccgacaugaucauucccaagagccucgccgggccuaucucucagcauaaucacagacccggauaucauacccaaaccgcgggcccuuggcaccuggggaaacuugaacuggauuucaacuacugcgagggaacaaccguugugaucacggagaauuguggcacacgcggccccucccuccggaccacaaccgucagcgggaagcugauucacgaauggugcuguagaucuugcacacugccgccucuucgguauaugggagaggacggcuguugguacgggauggaaauccgccccauuaacgagaaagaagagaauauggugaagucccucguuagcgcuggaucuggcaaaguggauaacuuuaccauggggguccugugccuggccauccucuucgaggaagugaugagaggaaaguucggcaagaaacauaugauuguuggcgugcuguuuacguucguccuucugcucagcgggcagaucaccuggcgggacaugacacacacccugauuaugaucggauccaaugccagcgauagaaugggcaugggggugacauaucuggcucuuaucgccaccuuuaagauucagcccuuccuggcgcucggauuuuuccugcgcaaacucacgucucgggagaaccugcuucugggcguggggcucgcuauggccacaacccugcaacugccugaagacaucgagcagauggccaauggaauugcucuuggccugaugacacucaagcugaucacccaguuugaaaccuaccagcucuggacagcccuggucucccuuacguguagcaacaccauuuucacacugaccguugcuuggagaacagccacccucauccuggcgggcgugucccugcuuccgcugugccaaucuagcuccaugcgcaaaacggauuggcuccccaugacaguggccgcuaugggggucccuccccugccucucuuuaucuucucucugaaggacgcccccaagaaaagaagcuggccucuuaaugagggagugauggcuguuggccugguguccauucuggccucuagccuccugcggaacgauguccccauggccgggccgcuuguggcuggaggccugcucaucgcguguuauguuauuaccgggaccuccgccgaccugacaguggagaaggcugccgacgucaccugggaagaggaagccgagcagacaggagugagccauaaccucaugaucacggucgaugacgauggcaccaugcgcauuaaagacgaugaaacagagaauauccugaccgugcuucugaagacagcucugcucaucguuucuggcauuuuuccuuacuccauccccgccacccugcuuguguggcacacguggcagaaacagacccaaagaagcgggguccugugggacgugccuucucccccggagacacagaaggcggaacucgaggaaggaguuuaccggauuaaacagcagggcaucuucgggaagacccaagugggagucggcgugcagaaggaggggguguuucauacaauguggcacguuacccgcggagcuguccugacacacaacggcaaaagacucgagccuaauugggccuccgugaagaaagaucugauuagcuauggcgggggauggcggcuuucugcccaguggcaaaagggcgaagaggugcaggucaucgcuguggaacccgggaaaaacccuaagaauuuccagacgaugcccggaauuuuccagaccacaaccggcgagaucggggccaucgcgcuggacuuuaagcccggaaccuccggcagcccuauuaucaaccgcgaaggcaaaguuguggggcuguacggaaauggcgucgugacaaagaacgggggauauguuuccggcauugcucaaacgaaugccgagccggaugggcccaccccugagcucgaagaggaaauguucaaaaagagaaaccugacaaucauggaccuucaucccggcagcggaaaaacccggaaguaccugccugccauugugcgcgaggcuaucaagagacggcucagaacacugauccucgcccccacccgcgucguggcugccgaaauggaggaggcgcugaaaggccuuccuauucgguaucagacgacagccaccaagucugaacacaccgggagagagaucguugaucugaugugccaugcuacauuuaccaugcgccugcucagcccggugcggguccccaauuacaaccugauuaucauggacgaagcccacuucacagauccugcuuccauugccgccagaggauauaucucuacccgcgugggcaugggggaggcugcggccaucuuuaugacggcuacacccccuggaaccgccgaagccuucccccagagcaaugcuccgauucaggacgaggagcgggacaucccugaaagauccuggaacucuggcaaugaguggauuacagauuuuguggggaaaaccgucugguucguucccagcaucaaggccggcaacgacauugcgaacugucuucgcaaaaauggaaagaaggugauccaacugucccggaaaacguuugauaccgaauaccagaagacaagacucaacgacugggauuucguggucaccacagacauuucugagaugggcgcuaauuuuaaagccgaucgggugaucgacccccgcagaugccugaagccuguuauccugaccgaugggcccgagcgggugauucucgccggaccuaugccggucacagcugccagcgcggcccagcgcagaggccggguggggagaaacccccagaaagaaaaugaccaauacaucuucaccggacagccucuuaacaaugaugaggaccaugcucacuggacggaagccaagaugcugcuggacaacauuaauacacccgagggcaucauuccugcucucuucgaacccgagcgcgagaaguccgccgcuaucgauggggaauaucggcugaaaggcgagagcagaaagaccuuuguugaacuuaugcgccggggagaccugccgguguggcucgcccacaaagucgcgucugagggcaucaaguacaccgauagaaaauggugcuucgacggggaacgcaacaaucagauucuggaggagaacauggauguggaaaucuggacaaaggagggagaacggaaaaagcugagaccucgcuggcucgacgccagaaccuauuccgauccccuugcucugaaggaguuuaaagacuucgccgcuggccggaaaagcauugcccuggaucucgucacagaaaucgggcgcgugccuucucaucuggcccacagaacgcggaaugcucuugacaaccugguuaugcuccauaccuccgagcacggaggccgcgcguacagacacgccguggaggaacugcccgagacaauggaaacccugcuccuucugggccugaugauucuccugacagggggagcuaugcuuuuucugaucagcggcaaagggaucggaaagaccuccauuggccucaucugugugauugucucuagcgggaugcuguggauggccgauguuccucugcaguggaucgccuccgcuauugugcucgaguucuuuaugauggugcuucugauccccgagccggaaaaacaacggacgccucaggacaaucagcuggccuaugucgugauuggaauccucacccuggcggccaucguugcugccaacgagaugggccuucuggaaacaaccaagagagaucucggcaugagcaaggagcccggggcugugucuuccacaagcuaccuggacgucgaccugcaucccgccucugcguggacccucuaugccguggcuacgacagucauuaccccuaugcuucgccacacaaucgaaaauagcaccgccaacgugucccuggcugccauugcuaaccaagccguugugcugaugggacucgauaaaggcuggccgaucucuaagauggaccugggggucccccuucuggcgcucggaugcuacagccaggugaauccucugacccugacagccgcuguucuccuucuggugacgcauuacgccauuaucggccccgggcugcaggcuaaagccacccgggaggcccagaagagaacagcggcuggaaucaugaaaaacccuaccgucgauggcauuaugacaaucgaccucgaucccgugauuuaugacuccaaguucgagaagcaacugggccaggugaugcuucugguucucugugccguccagcugcugcucaugcgcaccucuugggcucuuugcgaagcccugacgcuggccacagggccuaucaccacccucugggagggaagcccgggcaaauuuuggaauacaaccauugcuguguccauggccaacaucuuccgggggagcuaccuggcgggagccggccuugcuuuuucuaucaugaaguccguggggacaggaagacggggcacgggcagccagggggaaacccugggagagaaauggaagaaacgccucaaucaacuguccagaaaggaguucgaucuguauaagaaaucuggcauuacagaggucgaccggaccgaggccaaggaagggcucaaacgcggagagacaacccaccaugcuguuagcagaggcuccgccaaacuucagugguuuguggaacggaacauggugauccccgaggggcgcgucauugaucugggauguggcagaggcggguggucuuacuauugcgcgggacugaaaaaggugacggaaguucggggcuacaccaaagggggaccuggccacgaggagcccgugccuaugagcacauauggguggaauaucgucaagcucauguccggaaaggacguguucuaccugcccccggaaaaaugugauacccuucugugcgacauuggcgagagcucuccuucccccacaguugaagagagccgcaccaucagagugcucaagauggucgagcccuggcugaaaaacaaucaguucuguauuaaggugcugaacccuuacaugcccacagugaucgaacaccucgagcggcuucagagaaaauauggcgggaugcugguccgcaauccucugucucggaacuccacccaugaaauguacuggaucagcaauggaacgggcaacauuguuucuagcgugaauaugguguccagacuccugcuuaaccgcuuuacaaugacccaccggagaccgaccauggagaaggaugucgaccugggggccggaacacgccaugugaacgcugaacccgagacgccuaauauggacguuaucggcgagcggauuaagagaaucaaagaagaacacucuagcaccuggcacuaugaugacgaaaaccccuacaagacaugggccuaucauggguccuacgaggugaaagcuaccggaagcgccuccucuaugauuaauggcgucgugaagcuccugacaaaaccuugggauguugugcccauggucacccaaauggcuaugacagacaccacgccguucggccagcagcgcguguuuaaggaaaagguugauacccggacaccuagacccaugccugggacccgcaaagugauggagaucacagccgaguggcuguggcggacccucggaagaaacaagaaaccccgccugugcacgagagaagaguucacaaagaaaguccggaccaaugcggccaugggcgcuguguuuacagaagagaaccaaugggacagcgcccgcgcugccgucgaagaugaggaguucuggaaacuuguggacagagaacgggagcugcacagacucgggaaguguggauccugcguuuauaauaugaugggcaaacgggaaaagaaacugggggaguuuggcaaggccaaaggaucucgcgcgaucugguacauguggcuuggcgcuagauaccuggaguucgaagcccucggguuucugaacgaggaucauugguucagccgggaaaauuccuauucuggaguggagggcgaagggcugcacaagcucggauacauucugcgcgacaucagcaaaauuccuggcggggccauguaugcugaugacaccgccggcugggacacgagaaucaccgaggaugaccuucauaacgaggaaaagauuacacagcagauggaucccgagcaccggcgccuggcuuccgccaucuuuaagcucaccuaccagaauaaagucgugaaggugcaaagaccgacaccuaaaggaaccguuauggacaucauuagccggaaggaucagcgcggcucuggacaggugggaacauauggccugaacaccuucacgaauauggaagcgcagcuugucagacaaauggagggggaaggagugcuguccaaagccgaccucgaggauccccaucugcuggagaagaagaucacacaguggcucgaaaccaaaggcguugagcggcugaagcgcauggcuauuagcggggacgauugcguggucaaacccaucgacgauagauuugccaacgcccuucuggcccucaaugacaugggcaaggugcggaaagauauuccucaguggcagccgucuaagggauggcaugacuggcaacagguccccuucuguucccaccauuuccacgaacugaucaugaaggacggccgcaaacuugugguuccuugcagaccccaggaugagcugaucgggcgggcgagaauuagccagggagccggcuggucucucaaggaaaccgcuugucuggggaaagccuacgcucaaauguggucccugauguauuuucaccgccgggaccucagacuggccagcaacgcuaucugcuccgccgugccuguccauugggugcccacaagccgcaccacauggucuauucacgcgcaucaccaguggaugacgaccgaggauaugcuuacaguuuggaaccggguguggaucgaggacaauccuuggauggaagauaagacccccgucacaaccugggaggacgugccguaccugggaaaaagagaagaucagugguguggcagccucauugggcugacgucccgcgccaccugggcucaaaacauccuuacagccauucaacaggugcggucucugaucggcgacgaggaguuccucgauuacaugccuagcaugaagagauuucgcaaggaagaggaauccgagggagccaucugguga

SEQ ID NO: 20924 - RNA, 9873 nt, Artificial Sequence
  derived and/or modified CDS sequence (opt5) from DENV-3__JN662391__SS-prME
accagccugugccucaugaugauccugcccgccgcucuugccuuccaccugacauccagagacggcgagccucggaugauuguggggaagaacgaacgcggaaaaucucuccuguuuaagacggcgagcggcaucaauauguguacccuuauugcuauggaucugggggagaugugcgacgauacagucaccuacaaauguccgcauaucacagaaguugagcccgaagacauugauugcugguguaaccucaccuccacaugggugaccuauggaacgugcaaucaggccggcgagcacagacgggacaagcgcucuguggcccuggcuccucaugucgggaugggacuggauaccagaacacaaaccuggaugagcgccgagggcgcuuggcggcagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccagaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggaguacaagggagaagaugcccccuguaaaauuccuuucagcaccgaggacgagcaaggcaaggcgcauaacgggagacugaucacagcuaaucccguugugaccaaaaaggaagagcccgucaacauugaagccgagccuccguucggagaauccaauaucgugauuggcaucggggauaacgcccugaaaaucaauugguauaagaagggcucuagcauuggaaaaauguuugaggcuacggcccggggcgcuagacgcauggccauccuuggggacacagcgugggauuucggauccgugggcgggguucucaacagccugggaaagaugguccaccagauuuuuggcucugccuacaccgcucuguucuccggggugagcugggugaugaaaaucggcauuggaguccuccugaccuggaucggccuuaauucuaagaacacaagcauguccuuuucuugcauugccaucgggaucauuacccuguaucucggagcugugguucaggccgacaugggcugugugaucaauuggaaagggaaggagcugaagugcggaagcggcauuuucgucacaaacgaagugcauacguggaccgagcaguacaaauuucaagcggauucccccaagcggcuggccacagcuaucgccggggcuugggaaaauggcguuuguggaauuagaagcaccacacgcauggagaaccuucucuggaaacagaucgccaaugaacugaacuauauccugugggagaauaacauuaagcucaccguggucgugggcgacacgaucgggguucuggagcagggaaaacggacccuuacaccucagcccauggaacugaaguacucuuggaaaaccuggggcaaggccaagauugugacagcugagacccaaaacuccagcuucaucauugaugggccuaauacacccgaaugcccgucugcguccagagccuggaacgucugggagguggaagacuauggauuuggcguguucaccacgaauaucuggcucaaacugcgcgaggucuacacacagaugugugaccaccggcugaugagcgcugccguuaaggaugagagagccgugcacgcugacaugggcuacuggaucgaaucccagaaaaacgggucuuggaagcuugagaaagccagccucauugaagugaagaccugcaccuggccuaagucccauacacuguggucuaauggaguccuggagagcgauaugaucauucccaaaucccucgcgggcccuaucagccagcacaacuaucgccccggguaccauacccaaacggcuggaccuuggcaccugggcaagcuugagcuggacuuuaauuauugcgaagggacaaccgugguuauuacagagaacuguggaacccggggccccucucucagaacaaccacgguguccggcaaacugauccacgaauggugcugucgcagcugcacccugccgccucuucgguacaugggggaggauggauguugguauggcauggaaaucagacccauuucugagaaggaggaaaauauggucaaaucccucgugagcgccgggucuggaaagguugacaacuucacaaugggcgugcugugccuggccauccucuuugaggaagucaugcgggggaaguucggaaaaaagcauaugauugcuggcguguuccugaccuuuaugcuucugcucagcggccagaucacauggcgcgauauggcccacacccugauuaugaucggguccaaugcgagcgacagaaugggaaugggcguuacguaccuggcucuuauugccacauucaaaauccagcccuuucuggcccucggguucuuucugcggaagcucaccucuagagagaaccugcuucugggagugggccucgcuauggccacaaccauccaacugccugaagauauugagcagauggcuaaugggaucgcccugggacuuauggcgcugaaacucauuacccaguucgagacauaucagcuguggacggcccucaucucccugaccuguagcaacacaauuuuuacccuuacagucgcuuggcgcaccgccacgcugauccucgcuggcgugucccugcugccggugugccaaucuagcuccaugcggaagacagacuggcuucccaugaccgucgccgccaugggcguuccuccccugccucucuucaucuuuucucugaaggauacccucaaaagacgcagcuggccccugaaugaaggggugauggcugugggacuugucuccauucuggcgucuagccugcucagaaacgacgugccuauggccggcccccugguugcugggggacuucugaucgccuguuacgugauuacaggcaccuccgccgaucucacagucgagaaggcugccgacgugacgugggaagaggaagcggagcagaccgggguuagccauaaccugaugaucacaguggacgaugacggaaccaugcggauuaaagaugacgagacagaaaauauccucaccguccugcuuaagacggcucugcugaucgugucuggcauuuucccguacuccaucccugccacccuccuggucuggcacacauggcagaaacagacccaacgcagcggcgugcuuugggauguucccucuccucccgagacacagaaggccgaacuggaggaggggguguauagaauuaaacagcagggaauccucggcaagacccaagucggggugggaguucagaaggaaggcguguuucauacaauguggcacgucacgcggggggcugugcugacccacaacggaaaacgccucgagccgaauugggccuccgugaagaaagaccugauuagcuacggcggcggguggagacuuucugcgcaguggcaaaagggagaagagguucaggucaucgcuguggaaccuggcaaaaaccccaagaauuuccagacaaugccugggaccuuucagaccacaacgggagagauuggcgccaucgcccuggauuucaagcccgggaccuccggaagccccaucauuaaccgggagggcaaaguggucggccuguaugggaauggagugguuacaaagaacggcggguacguguccggaaucgcucaaaccaaugccgaaccugacggcccgacacccgagcucgaagaggaaauguucaaaaagcgcaaccugaccauuauggaucuucauccugggagcggcaaaacgagaaaguaucugcccgcuaucguccgggaggccauuaagcgcagacuccggacacugauccucgcgccuaccagagugguugccgcugagauggaagaggcccugaaaggacuucccauccgcuaccagaccacagcuaccaagucugaacacacaggccgggagauuguggaccugaugugccaugccaccuuuacgaugagacugcucagcccuguccgcgugccgaauuauaaccugaucauuauggaugaagcccacuucacagaccccgcuuccaucgcggcccggggguacauuucuaccagaguuggaaugggcgaggcugccgccaucuuuaugacagcuaccccucccgggacggccgaugcguucccucagagcaaugcucccauccaggacgaggaacgcgacauuccggagcgguccuggaacucuggaaaugaauggaucaccgauuuugccggcaaaacagugugguucgucccuagcauuaaggccgggaacgacaucgcuaacugucuuagaaaaaauggcaagaaggugauucaacugucccgcaaaaccuuugauacagaguaccagaagaccaaacucaacgacugggauuucguggucacaaccgacaucucugagaugggagccaauuuuaaggcggaucggguuauugaccccagacggugccugaaacccgugauccugacggauggcccugaacgcgugauccucgccgggcccaugccugucacaguggcuagcgccgcucagagacggggacgcguuggcagaaacccgcagaaggagaaugaccaauauauuuucaccgggcagccccuuaacaaugaugaagaccaugcccacuggaccgaggcuaagaugcugcuggacaacaucaauacaccugaaggaauuauccccgcccucuuugagccugagcgggaaaaauccgcggccauugauggcgaguacagacugaagggggaaagccgcaaaaccuucguggagcuuaugcggagaggcgaccugcccgucuggcucgcucacaagguggccucugaaggaaucaaauauacagaucgcaaguggugcuucgacggccagcggaacaaucagauccuggaggagaacauggauguugaaauuuggacgaaagagggggaaaagaagaaacugagaccgcgcuggcucgacgcucggaccuacuccgauccucuugcccugaaggaguuuaaagacuucgccgcuggaagaaagagcaucgcgcuggaucucgugacagaaauuggccgcguccccucucaucuggcccacagaacccggaaugcucuugacaaccuggugaugcuccauacauccgagcacgggggacgcgccuauagacacgccgucgaggaacugccugagaccauggaaacgcugcuccuucugggccugaugauccuccugaccggcggggcuaugcuuuuucugauuagcggaaaaggcaucgggaagacauccaucggacucauuugugugaucgccucuagcggcaugcuguggauggcggagauuccccugcaauggaucgccuccgcuauuguucucgaguucuuuaugauggugcuucugaucccugaacccgagaagcagcggaccccgcaggauaaucaacuggccuacguggucauugggauccucacacuggcugccaucauugcggccaacgaaaugggacuucuggagaccacgaaacgcgaccucggcaugagcaaggaaccuggcguugugucucccacauccuaucuggauguggaccugcaucccgcuagcgccuggacccucuacgcugucgccacaaccgugaucaccccuaugcuuagacacacaauugagaauucuacggcuaacguuagccuggccgcgaucgccaaccaggcugugguccugauggggcucgacaaaggauggccgauuuccaagauggaucugggcgugccccuucuggcccucgggugcuacucucaggucaauccucugacccugacagcugccgugcuccuucugguuacccauuaugccaucaucggacccggccugcaggcgaaagcuacacgggaggcccaaaagagaaccgcugccgggauuaugaagaacccuacgguggacggaaucauuacaaucgaucucgaccccgucauuuacgauagcaaauucgaaaagcagcugggccaggugaugcuucugguucucugugccgugcagcugcugcucaugcgcaccuccugggcucuuugcgaggcccugacccuggcgacaggcccuaucaccacacucugggaagggucuccgggaaaauuuuggaauacgaccaucgccgucagcauggcuaacauuuuccggggcuccuaucuggccggggcuggacuugccuuuagcaucaugaagucugugggcacagggaaaagaggaaccggcucccaaggcgagacacugggggaaaaguggaagaaaaagcucaaucagcugagccgcaaagaguucgaccuguacaagaaauccggaauuaccgagguggaucggacggaagcgaaggagggccucaaaagaggggaaaccacacaccaugccguuucucggggaagcgcuaagcuucagugguuugucgagcgcaacauggugauccccgaaggcagagugauugaccugggguguggacggggcggcugguccuauuacugcgccgggcugaagaaagucaccgagguucgcggauauacaaagggcgggccuggacacgaggaacccgugccuaugucuacccacggcuggaauaucgugaaacucaugagcgggaaggaugucuucuaccugcccccggagaaaugugacacacuucugugcgauauuggagaauccagcccuucucccaccguggaggaguccagaacgauccggguucucaagaugguggaacccuggcugaagaacaaucaguuuuguaucaaaguccugaacccuuacaugcccgcugugauugagcaucucgaacgccuucaaagaaagcacggcggcaugcugguucggaauccucugagccgcaacucuacacaugagauguauuggaucuccaaugggaccggaaacauugugagcucugucaauauggugagcagacuccugcuuaaccgguucaccaugacacacagacgcccgacgaucgaaaaagacguggaucugggcgccgggacccggcacgucaacgcugagcccgagacaccuaauauggacguuauuggagaaagaauccgccggaucaaggaggaacauaacuccaccuggcacuacgacgaugagaaucccuauaaaacaugggccuaccauggcucuuaugaagugaaggcgaccgggagcgccuccagcaugauuaacggaguggucaagcuccugacaaaaccuugggacgugguucccauggugacccagauggcuaugacggauaccacaccguucggccagcaaagagucuuuaaggagaaaguggacacccgcacaccucggcccaugccuggcaccagaaagguuauggagaucacggccgaauggcuguggcgcacacucgggcggaauaaaagaccccgccugugcacccgggaggaauucacaaagaaggugagaaccaacgcugccaugggagccgucuuuacggaggaaaaucagugggauuccgcgaaagcugccguggaggacgaggaauucuggaagcuuguugaucgcgagagagaacugcacaaacucggcaagugugggucuugcguguacaacaugaugggaaaacgggagaagaaacugggcgaguuugggaaggccaagggcagccgcgcuauuugguauauguggcuuggagccagauaccuggaauucgaggcucucggcuuucugaaugaagaccauugguucucccgggagaacucuuacagcggggucgaaggagagggccugcacaaacucggguauauccugagagauauuuccaagaucccuggaggcgccauguacgcggacgauaccgccgggugggacacacggaucaccgaggacgaucuucacaaugaagagaaaauuacacagcagaugaaccccgaacaucgccugcucgcuaaugccaucuuuaagcugaccuaucaaaacaaaguggucaaggugcagagaccgacaccuaccggcacgguuauggacauuaucucucggaaggaucagcgcggaagcggccagguggggacauacggacuuaauaccuucaccaacauggaggcucaacuggucagacagauggaaggcgagggggugcucuccaaagccgaccuggagaacccccaccugcccgaaaagaaaauuacacaguggcucgagaccaagggaguggaacggcugaaacgcauggcgaucagcggcgaugacugcguugugaagccuaucgaugacagauuugccaaugcucuucuggcccucaacgauauggggaagguccggaaagacauuccgcaguggcaacccucuaagggcuggcaugauuggcagcaggugccuuucuguucccaccacuuucaugagcugaucaugaaagacggacgcaagcuuguugugcccugcagaccucaggaugaacugauuggccgggcucgcaucagccaaggggccggauggucucucagagagacagcuugucugggcaaagccuaugcgcagauguggucccugauguacuuccaccggcgcgaccucagacuggccagcaaugcuauuugcucugccguccccgugcauugggucccuacgucccggaccacauggagcauccacgcccaucaccaguggaugaccacagaggacaugcuuaccguguggaacagaguuuggauugaagauaaucccuggauggaggacaagacgccggugaccacaugggaaaacgucccuuaucuggggaagcgcgaggaucaaugguguggaucccucaucggccugaccagccgggcuacaugggcccagaauaucucuaccgcgauucagcaggugagaagccuuaucgggaacgaggaauuccuggacuacaugcccuccaugaaacgcuuucggaaggaggaagagucugaaggcgcuauuugguga

SEQ ID NO: 20925 - RNA, 9873 nt, Artificial Sequence
  derived and/or modified CDS sequence (opt5) from DENV-3__AY858043__SS-prME
accagccugugccucaugaugaugcugcccgccacccuugcuuuccaccugacgucccgggacggcgaaccucggaugaucguggggaagaacgaacgcggaaagucucuccuguuuaagaccgccagcggcauuaauauguguacccuuaucgcgauggaucugggggagaugugcgacgauaccgugacauacaaguguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagagcucaaaccuggaugagcgccgagggcgcuuggcggcaggccgaaaagguggagacaugggcgcugcgccaucccggcuucaccauucuugcccuguuucucgcucacuacaucgggacgucccugacacagaagguugugaucuucauucuucugaugcucgucaccccuucuaugacaaugagaugugugggaguuggcaaccgggacuuuguggaagggcugagcggagccaccugggucgauguggugcuggagcauggcgggugcgucaccacaauggcuaagaauaagcccacgcucgacaucgagcugcagaagaccgaagccacacaacuugcgacccugcgcaaacucuguauugagggaaagaucacaaacguuaccacggauuccagaugcccuacacagggcgaagccauucugccggaggaacaggaccagaauuaugugugucggcacaccuacguggaucgcggcugggggaacggaugcggccuuuucgggaaaggaagccuggugacaugcgcuaaguuucaaugucucgagcugaucgagggcaaggugguucagcacgaaaaucugaaauauacagugauuaucaccguccauacaggggaccagcaccaggugggaaacgagacgcaaggcguuaccgccgaaaucacaccccaggcuucuaccguggaggccauucucccugaauacggcacacuggggcuugagugcucccccagaaccggacuggacuucaaugagaugauccuccugacgaugaagaacaaagccuggaugguccaucggcagugguuuuucgaucuuccucugcccuggaccagcggcgcuacaaccgaaacaccgaccuggaauaagaaagagcuccuggugacguuuaagaacgcgcacgccaaaaagcaagaagucgugguucuggggucucaggagggagcuaugcacacagcccucaccggcgccacagaaauucagaccuccgggggcaccagcaucuucgcuggacaucugaagugucgccuuaaaauggacaagcuggagcucaaaggcaugucuuaugccaugugcuccaaugcguuugugcugaagaaagaggucagcgaaacacagcacgggacgauucugaucaagguggaguacaagggagaagaugcuccuuguaaaauccccuucuccaccgaggacggccaagggaagguucauaacggaagacuuauuacagccaacccuguggucaccaaaaaggaggaacccgugaauaucgaggccgaacccccuuucggcgagucuaacauuaucauugggaucggcgauaaagcucucaagaucaauugguacaagaaaggaagcuccauuggcaagauguuugaagccacagcuagaggggcuagacgcauggcgauccugggagacaccgccugggauuucggcagcgucgggggaguucugaacucucucggcaaaaugguccaccagauuuuuggguccgcuuauacggcccuguucagcggcgugucuuggaucaugaagauuggaaucggcgugcuucugacauggauugggcucaauagcaaaaacaccuccaugucuuuuagcugcaucgucaucggaauuaucacccuguaccugggcgcugugguucaggccgacauggggugugugauuaauuggaagggaaaggagcuuaaaugcggcuccgggaucuucgucacaaacgaggugcauaccuggacagaacaguauaaguuucaagcggauagcccgaaacggcucgccacggcuauugccggcgcuugggagaauggaguuuguggcaucagaucuaccacacgcauggaaaaccugcuguggaagcagaucgccaaugagcucaacuacauucugugggaaaauaacaucaaacuuaccguggucgugggggacauuaucggaguucuggagcagggcaagcggacacucacaccccagccuauggagcugaaauauuccuggaagacgugggggaaggccaaaguggucaccgcugaaauucaaaauagcucuuucaucaucgauggacccaacacaccugagugccccaacgcguccagagccuggaaugugugggaaguggaggacuacggcuuuggcgucuucaccacaaacauuuggcugaaacuucgcgaaauguauacccagcucugugaccaccggcugaugagcgcugccguuaaagaugagagagccgugcacgcugacaugggguacuggaucgagucccagaagaauggaucuuggaaacuggaaaaggccagccucauugaggugaagacaugcaccuggccgaaaucccauacgcuguggucuaacggcguccuugaaagcgauaugaucauuccuaagucccuggcggggcccaucagccagcacaauuaccgcccuggauaucauacacaaaccgcuggccccuggcaccucgggaaacuggagcuggacuuuaacuacugcgagggaaccacagugguuaucaccgaaaauuguggcacgcggggcccuucucuuagaacaaccacaguguccgggaagcucauucacgaguggugcugucgcagcugcacccugcccccgcugcgguauaugggagaagauggcuguugguacgggauggagaucagaccuauuaacgaaaaagaggagaauauggucaagucucucguguccgccggaagcggcaagguugacaacuucacaaugggggugcugugccuugccauccuguuugaagaggucaugcggggaaaauucggcaagaaacauaugauugcuggcguccucuucauguuuguucugcugcuuucugggcagaucaccuggcgcgauauggccagaacgcugauuaugaucggaagcaaugcguccgaccggaugggcaugggggugaccuaucucgcucugaucgccacauucaagauucagcccuuucucgcccugggauucuuucuuagaaaacugaccagccgcgaaaaccuccugcugggcgucgggcuugcuauggccacaacccugcaacuccccgaggauaucgaacagauggcuaauggaauugcccugggccucauggcgcugaaacuuaucacgcaguucgagacauaccagcuguggaccgcccucgugucucugacauguuccaacaccauuuuuacccugacaguggcuuggcggacggccacccuuauccuggcuggcaucagccuccugccugucugccaauccucuagcaugagaaagacagacuggcucccgaugaccguugccgccaugggggugcccccucugccccuuuucauuuuuagccugaaagauacacugaagcgcagaucuuggccucucaaugagggagugauggcugucggccuggugagcauccuugcguccucucugcuccggaacgacguucccauggccgggccucugguggcuggaggccuccugauugccuguuaugucaucaccgggacgagcgccgaucuuacaguggaaaaagcugccgacguuaccugggaggaagaggcggaacagaccggagugucccacaaccugaugauuacagucgacgaugacggcaccaugcgcaucaaggaugacgagacagagaauauccugacggugcuccugaaaaccgcccuucugauugucagcggcaucuuccccuacucuauuccggccacacuccugguguggcauaccuggcagaagcagacacaaagauccgggguucucugggaugugccuucucccccugaaacccagaaagccgagcuggaagagggagucuaccggaucaagcagcagggcauuuuugggaagacgcaagugggaguuggcgugcagaaagagggggucuuccacaccauguggcaugugacacgcggagcugugcuuaccuauaacggcaagagacuggaacccaauugggccuccguuaaaaaggaccugaucuccuacggcgggggauggcggcucagcgcgcaguggcgcaaaggcgaggaaguccaagugauugcuguggagccggggaagaacccuaagaauuuucagacaaugcccggaaucuuccagaccacaacgggcgaaaucggggccauugcccuggauuucaaaccuggaaccucuggcucccccaucauuaacagagagggcaaggucguggggcuuuauggaaauggcguugugaccaagaacgggggauacgucagcggcaucgcucagaccaaugccgagcccgacgggccuaccccggaacuggaggaagagauguuuaagaaacggaaccucacaauuauggaucugcaccccggcuccggaaagacgcgcaaguaucucccugcuaucgugagagaagccaucaaacggagacugcgcacccuuauucuggcgcccacacggguuguggccgcugagauggaggaagcccugaagggccucccuaucagauaccaaaccacagcuaccaaaagcgagcacacggggaaggaaauugucgaccugaugugccaugccacauucaccaugcgccuucugucucccgugcggguuccuaauuauaaccucaucauuauggaugaggcccacuuuaccgacccggcuagcaucgcggccagaggauacaucuccacacgcgugggcaugggggaagcugccgccauuuucaugaccgcuacacccccuggaaccgccgaugcguuuccccagucuaaugcuccuauccaggacgaggagcgggacauucccgaaagaagcuggaacuccggcaaugauuggaucacggacuucgccgggaaaacagucugguuugugccgucuauuaaggccggcaacgauaucgcuaacugucugcgcaagaauggcaaaaaggugauucagcugagccggaaaaccuucgacacagaguaccaaaagaccaaacucaacgauugggacuuugucguuacgaccgauaucuccgaaaugggagccaauuucaaggcggacagagugaucgauccucggcgcugccuuaagcccgugauucugacagacgggcccgagagagucauccuggccggaccuaugcccgugaccguugcuucugccgcucagcggcgcggcagaguggggcggaacccucagaaagagaaugaucaguauauuuuuacaggacaaccgcucaacaaugacgaagaccaugcccacuggaccgaggcuaagaugcugcuugauaacaucaauacacccgaaggcauuaucccugcccuguucgagcccgaaagagagaaaagcgcggccaucgacggggaguaccgccucaagggcgaaucccggaaaaccuucgucgagcugaugagacgcggagaucugccuguguggcucgcucauaagguugccagcgaaggcauuaaauauacggaccggaaguggugcuuugauggggagagaaacaaucagauccuugaagagaacauggacguggagauuuggacaaaggaaggagagaaaaagaaacugcgcccccgguggcuggaugcuagaaccuacucugacccgcucgcccugaaggaguucaaagauuuugccgcuggccgcaaguccaucgcgcuugaccuggucaccgagauugggagagugccuagccaccucgcccaccggacacgcaaugcucuggauaaccuggucaugcuccauaccucugaacacggaggcagagccuaucggcaugccguggaggagcuucccgaaacaauggagacguuccugcugcucggccugaugauccuucugaccgggggagcuaugcucuuucugaucuccggcaaggggguuggaaaaacaagcauuggccugaucugugugguggccuccucugggaugcucuggauggcggacauuccucuucaguggaucgccagcgcuauuguccuggaguucuuuaugaugguucugcucauccccgagccugagaagcagcgcacaccccaagauaaucagcuggccuacguggugauuggaauccuuacacuggcugccaucgucgcggccaacgaaaugggccuccuggagaccacgaaaagagaccugggcauguccaaggaaccgggggugguuagcccuaccucuuaucucgacguggaucuucaccccgcuuccgccuggacacuguacgcugucgccaccacagugauuacccccaugcugcggcacacgaucgagaauagcacagcuaacgucucucucgccgcgauugccaaccaggcugugguucugaugggacuugacaaaggcuggccuaucagcaagauggaucugggggugccgcuccuggcccugggaugcuacucccaagucaauccccucacccuuacagcugccgugcugcugcucguuacccauuaugccauuaucggcccugggcugcaggcgaaggcuaccagagaagcccagaaacgcacagcugccggaaucaugaagaaccccacgguggacggcauuaugaccaucgaucuugacccugucauuuacgauucuaaauucgagaagcagcugggccaagugaugcuccuggugcugugugccguucagcuccuucugaugcggacaagcugggcuuuuugcgaggcccugacccucgcgacagggcccaucaccacgcugugggaaggauccccuggcaaauucuggaauacaaccauugccgucucuauggcuaacaucuuuagagggagcuaucuugccggagcuggccuggccuucuccaucaugaaaagcguggggaccggaaagcgcggcacaggcucucagggggagacccucggagaaaaauggaagaaaaagcugaaucagcugucccggaaagaguuugaccucuacaagaaaagcggcauuacagaaguggauagaacggaggcgaaggaggggcuuaagcggggagaaaccacacaccaugccgucucccgcggcucugcuaaacugcaaugguucguugagagaaacauggugaucccggaagggcgggugauugaccugggauguggccgcggcggguggagcuauuacugcgccggacucaagaaagucaccgaggugagaggcuauacaaaagggggacccggccacgaagaaccuguucccauguccaccuacggguggaauaucgugaaacugaugucuggaaaggaugucuucuaccuuccucccgagaagugugacacgcugcucugcgauauuggcgaaagcuccccgagcccuaccguggaggaaucucggacaauccgcguucugaaaaugguggagcccuggcugaagaacaaucaguuuuguauuaaaguccucaaccccuauaugccuaccgugaucgagcaucuugaaagacugcagcggaagcacggcgggaugcuggugcgcaauccccucuccagaaacagcacacacgagauguacuggaucucuaauggaaccggcaacauugucuccagcguuaauauggugucucggcugcuucugaacagauucacaaugaccuaucgccggccuacgaucgaaaaagacguggaccucggggcuggaacaagacaugucaacgccgagccggaaacccccaauauggaugugauuggcgagcgcauccggagaauuaaggaggaacacagcuccaccuggcauuacgacgaugagaacccuuauaagacaugggcuuaccacgggucuuaugaaguuaaagccacgggaagcgcguccagcaugaucaauggcguggucaagcugcugaccaaacccugggacgugguuccuacagugacccagauggccaugacagauaccacacccuuuggccaacagcgcgucuucaaggagaaaguggacacccggacgccgaagccuaugcccgggaccagaaagguuauggaaaucacagcugaguggcucuggcgcacccugggacggaacaaaagaccucgccuuugcacacgggaggaauuuaccaagaaagugagaacgaaugccgcuaugggcgccgucuucacagaggaaaaccagugggauuccgcccgcgcggcuguggaggacgaagaguuuuggaagcuggucgauagagagcgggaacuccacaaacaagggaaguguggaucuugcguguacaauaugaugggcaaacgcgagaagaagcugggggaguucggcaaagccaagggaagcagagccauuugguacauguggcuuggcgcucgguaucuggaguuugaggcccucggguuccugaacgaagaccauugguuuuccagagaaaauucuuacagcggaguugaaggcgaggggcugcacaaacucggauauauccugcgggauauuuccaagauccccggcggggcuauguacgccgacgacaccgcgggcugggauacacgcauuaccgaagacgaucuucauaacgaggagaaaaucacgcagcagauggacccugaacacagacagcuggccaaugcuaucuucaagcucaccuaucaaaacaagguggucaaagugcagcggcccacaccgaagggaaccgugauggauauuaucucucgcaaagaccagagaggcagcgggcagguuggaacauacggccugaauaccuuuacaaacauggaggcccaacuuauucggcagauggaaggggagggagugcuguccaagaccgaucucgaaaauccucaucugcuggagaaaaagaucauucaguggcucgagacgaagggcgucgaacgccugaaaagaauggcuaucagcggggacgauugcgugguuaagcccaucgacgaucgguucgccaacgcgcuucuggcccucaacgacaugggcaaagugcgcaaggauauuccccaguggcaaccuucuagaggauggcacgacuggcagcaggucccguucuguucccaccauuuucacgagcugaucaugaaagacggccggaaacuugugguccccugccgcccucaggaugaacugauugggagagcucggaucagccaaggagccggcuggucucucaaggagacagcuugucuggggaaagccuaugcucagaugugggcccugauguacuuccaucgcagagaccuccggcuggcguccaaugccauuugcagcgcugugcccguucacugggugccuaccucuagaaccacaugguccauccacgcccaucaccaguggaugaccacagaagauaugcuuacggucuggaaccgcguguggauugaggacaaucccuggauggaggauaagaccccuguuacaaccugggaagacgugcccuaccugggaaaacgggaggaucaaugguguggcagccucaucgggcugacauccagagccaccugggcucagaacauccuuacggccauucagcagguccgcagccugaucggcaaugaagaguuucucgacuauaugccgucuaugaagcgguucagaaaagaggaagagagcgaaggagcgauuugguga

SEQ ID NO: 20926 - RNA, 9873 nt, Artificial Sequence
  derived and/or modified CDS sequence (opt5) from DENV-3__AY858044__SS-prME
accagccucugccucaugaugaugcugcccgccacccuugcuuuccaccugacguccagagacggagagccucggaugaucgucgggaagaacgaacgcggaaagucucuccuguuuaagaccgccagcggaauuaauauguguacccuuaucgcgauggaucugggggagaugugcgacgauaccauuacauacaaguguccgcucaucaccgaagucgagcccgaagacauugauugcugguguaaccugacauccaccuggguuacguauggaaccugcaaucaggcuggcgagcauagacgggacaagcgcucuguggcccuggccccucacguggggaugggacucgauacaagagcucaaaccuggaugagcgccgagggcgcuuggcggcaggucgaaaagguggagacaugggccuuccgccaucccggcuuuaccauccuggcgcuuuuccuggcccacuacaucgggacgucccucacacagaagguugugauuuuuauccugcuuaugcuggucaccccuucuaugacaaugagaugugugggaguuggcaaccgggacuucguggaagggcucagcggagcuaccugggucgauguggugcuggagcauggcgggugcgucaccacaauggccaagaauaaacccacgcuggacauugagcuccagaagaccgaagcuacacaacuggccacccuucgcaaacuguguaucgagggaaagauuacaaacguuaccacggauuccagaugcccuacacagggcgaagcgauccucccggaggaacaggaccagaauuauguguguaaacacaccuacguggaucggggcugggggaacggaugcggccuguuugggaagggaagccuugugaccugcgccaaguuccaaugucuggagcucauugagggcaaagugguucagcacgaaaaucugaaguauacagugaucaucaccguccauacaggggaccagcaccaggugggaaacgagacgcaaggcguuaccgcugaaauuacaccccaggccucuaccguggaggcuauccugccugaauacggcacacucgggcuggagugcagcccccgcaccggacuugacuuuaaugagaugauucugcucacgaugaaaaacaaggccuggaugguccauagacagugguucuuugaucugccucuucccuggaccagcggcgccacaaccgaaacaccgaccuggaauaaaaaggagcugcucgugacguucaaaaacgcucacgcgaagaagcaagaagucgugguucuggggucucaggagggagccaugcacacagcucugaccggcgccacagaaauccagaccuccgggggcaccagcauuuuugccggacaucucaaaugucggcugaagauggacaaacuugagcugaagggcaugucuuaugcuaugugcuccaaugccuucgugcucaaaaaggaggucagcgaaacacagcacgggacgauccugaucaagguggaguacaaaggagaagaugcgccuuguaagauucccuucuccaccgaggacggccaagggaaagcucauaacggacgccugaucacagccaacccuguugugaccaagaaagaggaacccgucaauauugaggccgaacccccuuuuggcgagucuaacaucauuaucgggaucggcgauaaggcucuuaagauuaauugguacaaaaagggaagcuccaucggcaaaauguucgaagccacagcuagaggggcccggagaauggcgauucucggagacaccgccugggauuuuggcagcgucgggggagugcugaacucucugggcaagaugguucaccagaucuucggguccgcuuauacggcccucuuuagcggcgucucuuggauuaugaaaaucggaauuggcgugcugcuuacauggaucgggcugaauagcaagaacaccuccaugucuuucagcugcaucgugauuggaaucauuacccucuaccugggcgcugucgugcaggccgacaugggguguguuaucaauuggaagggaaaagagcugaagugcggcuccgggauuuuugugacaaacgagguccauaccuggacagaacaguauaaauuccaagcggauagcccgaagcgccuugccacggcuaucgccggcgcuugggagaauggaguguguggcauccggucuaccacaagaauggaaaaccuccuguggaaacagauugccaaugagcugaacuacauccucugggaaaauaacauuaagcugaccguuguggucggggacaucauuggagugcuugagcagggcaaacgcacacugacaccccagccuauggagcucaaguauuccuggaagacgugggggaaagccaagaucguuaccgcugaaauccaaaauagcucuuuuauuaucgauggacccaacacaccugagugccccaacgcgucccgggccuggaaugugugggaagucgaggacuacggcuucggcguguuuaccacaaacauuuggcugaaacugagagaaauguauacccagcuuugugaccaccgccucaugagcgcugccgugaaggaugagcgggccguccacgcugacaugggguacuggaucgagucccagaaaaauggaucuuggaagcuggaaaaggccagccugauugagguuaaaacaugcaccuggccgaagucccauacgcucuggucuaacggcgugcuggaaagcgauaugaucaucccuaaaucccuugcggggcccauuagccagcacaauuacagaccuggauaucauacacaaaccgcuggccccuggcaccuggggaagcucgagcuggacuucaacuacugcgagggaaccacaguggucaucaccgaaaauuguggcacgcgcggcccuucucugcggacaaccacaguguccgggaaacuuauucacgaguggugcuguagaagcugcacccugcccccgcugcgcuauaugggagaagauggcuguugguacgggauggagauccggccuauuaacgaaaaggaggagaauaugguuaagucucugguguccgccggaagcggcaaagucgacaacuuuacaaugggggugcucugccuggccauccuuuucgaagagguuaugagaggaaaguucggcaaaaagcauaugauugcuggcgugcuguuuauguucguccuccugcugucugggcagaucaccuggcgggauauggcccgcacgcuuaucaugauuggaagcaaugcguccgacagaaugggcaugggggugaccuaucuggcucucaucgccacauuuaaaauucagcccuuccuggcccucggauuuuuccugcggaaacuuaccagcagagaaaaccugcuccugggcguugggcuggcuauggccacaacccuucaacugcccgaggauaucgaacagauggcuaauggaauugcccucggccugauggcgcucaagcugaucacgcaguuugagacauaccagcuuuggaccgcccuggugucucucacauguuccaacaccaucuucacccugacagucgcuuggcgcacggccacccugauucuugcuggcaucagccugcucccugugugccaauccucuagcaugcggaaaacagacuggcugccgaugaccguggccgccaugggggugcccccucucccccuguuuauuuucucccuuaaggauacacugaaaagacgcucuuggccucugaaugagggaguuauggcugugggccucgugagcauccuggcguccucucuucugagaaacgacguccccauggccgggccucucguggcuggaggccugcucauugccuguuauguuaucaccgggacgagcgccgaucugacaguggaaaaggcugccgacgucaccugggaggaagaggcggaacagaccggagugucccacaaccuuaugaucacaguugacgaugacggcaccaugcggauuaaagaugacgagacagagaauauccugacggugcugcucaagaccgcucugcuuauugucagcggcaucuuucccuacucuauuccggccacacugcucguguggcauaccuggcagaaacagacacaacgcuccgggguccugugggaugugccuucucccccugaaacccagaaggccgagcucgaagagggaguuuacagaaucaagcagcagggcauuuucgggaaaacgcaagugggagucggcgugcagaaggaggggguuuuucacaccauguggcaugugacacggggagcuguccugaccuauaacggcaaacgccuugaacccaauugggccuccgugaagaaagaccugaucuccuacggcgggggauggagacugagcgcgcaguggcaaaagggcgaggaagugcagguuaucgcugucgagccggggaagaacccuaaaaauuuccagacaaugcccggaauuuuccagaccacaacgggcgaaaucggggccauugcccucgauuuuaagccuggaaccucuggcucccccaucauuaaccgggagggcaaagugguggggcuguauggaaauggcgucgugacaaagaacgggggauacguuagcggcaucgcucaaaccaaugccgagcccgacgggccuaccccggaacuugaggaagagauguucaaaaagcgcaaccugacaaucauggaucuccaccccggcuccggaaagacgagaaaauaucugccugcuauugugcgggaagccaucaagcgcagacuccggacccugauucuugcgcccacaagagucguggccgcugagauggaggaagcccugaaaggccugccuauccgcuaccagaccacagcuaccaagagcgagcacacggggaaagaaauuguugaccucaugugccaugccacauuuaccaugcggcugcuuucucccgugagagucccuaauuauaaccugaucaucauggaugaggcccacuucaccgacccggcuagcauugcggcccgcggauacaucuccacacgggugggcaugggggaagcugccgccauuuuuaugaccgcuacacccccuggaaccgccgaugcguucccccagucuaaugcuccuauccaggacgaggagagagacauucccgaacgcagcuggaacuccggcaaugauuggaucacggacuuugccgggaagacaguuugguucgugccgucuauuaaggccggcaacgauaucgcuaacugucuccggaaaaauggaaagaaagucauccaacugagcagaaagaccuuugacacagaguaccagaaaaccaagcugaacgauugggacuucguggugacgaccgauauuuccgaaaugggcgccaauuuuaaggcggaccgcgucaucgauccucggagaugccucaaacccguuauucuuacagacgggcccgagcgggugauccuggccggaccuaugcccgugaccgucgcuucugccgcucagcgcagaggccggguggggcgcaacccucagaaggagaaugaucaauauauuuucacaggacagccgcugaacaaugacgaagaccaugcccacuggaccgaggcuaaaaugcuccuggauaacaucaauacacccgaaggcaucauuccugcccuuuucgagcccgaaagagaaaagagcgcggccaucgacggggaguaccggcugaaaggcgaauccagaaagaccuuuguugagcucaugcgccggggagaucugccuguguggcuggcucauaaagucgccagcgaaggcauuaaguauacggacagaaaguggugcuucgauggggagcgcaacaaucagauccucgaagagaacauggacguggagauuuggacaaaagaaggagagaagaagaaacuucggcccagauggcuggaugcucgcaccuacucugacccgcuggcccucaaagaauuuaaagauuucgccgcuggccggaaguccaucgcgcuggaccuuguuaccgagaucgggagagugccuagccaccuggcccaccgcacaagaaaugcucucgauaaccuggucaugcugcauaccucugaacacggaggccgggccuaucgccaugccguggaggagcuccccgaaacaauggagacgcuucugcugcucggccugaugauucuucugaccgggggagcuaugcucuuucugaucuccggcaaaggggucggaaagacaagcauuggccugaucugugugguugccuccucugggaugcucuggauggcggacauuccucuucaguggaucgccagcgcuauugugcuggaguucuuuaugauggugcugcucauccccgagccugagaaacaaagaacaccccaggauaaucagcuggccuacgucguuaucggcauucuuacacuggcugccaucguggcggccaacgaaaugggccuccuggagaccacgaagcgggaccugggcauguccaaagaaccggggguggucagcccuaccucuuaucucgacguggaucuucaccccgcuuccgccuggacacuguacgcuguugccaccacagugauuacccccaugcugcgccacacgaucgagaauagcacagcuaacgucucucucgccgcgauugccaaccaagcugugguccugaugggacuugacaagggcuggccuaucagcaagauggaucugggggugccgcuccuggcccugggaugcuacucccagguuaauccccucacccuuacagcugccgugcugcugcucgucacccauuaugccaucauuggcccugggcugcaggcgaaagcuaccagagaagcccagaagcggacagcugccggaaucaugaaaaaccccacgguggacggcauuaugaccaucgaucuugacccuguuauuuacgauucuaaguucgagaaacaacugggccaggugaugcuccugguccugugugccgugcagcuccuucugaugagaacaagcugggcuuuuugcgaggcccugacccucgcgacagggcccaucaccacgcugugggaaggauccccuggcaaguucuggaauacaaccaucgccgugucuauggcuaacauuuuucgcgggagcuaucuugccggagcuggccuggccuucuccaucaugaaaagcguugggaccggaaaacggggcacaggcucucagggggagacccucggagaaaaguggaaaaagaaacugaaucaacuguccagaaaggaguuugaccucuacaaaaagagcggcauuacagaagucgaucgcacggaggcgaaggaggggcuuaaacggggagaaaccacacaccaugccguguccagaggcucugcuaagcugcagugguucguggagcggaacauggucaucccggaagggcgcguuauugaccugggauguggcagaggcggguggagcuauuacugcgccggacucaaaaaggugaccgaggugcggggcuauacaaaagggggacccggccacgaggaaccuguccccauguccaccuacggguggaauaucgugaagcugaugucuggaaaggauguuuucuaccuuccucccgagaaaugugacacgcugcucugcgauauuggcgaaagcuccccgagcccuaccguggaggaaucucgcacaaucagaguccugaagaugguggagcccuggcugaaaaacaaucaguuuuguaucaagguucucaaccccuauaugccuaccgugauugagcaucuugaacggcugcagcgcaaacacggcgggaugcuggucagaaauccccucucccggaacagcacacacgagauguacuggaucucuaauggaaccggcaacauuguguccagcgugaauauggucucucgccugcuucugaacagauucacaaugaccuaucggagaccuacgaucgaaaaggacguugaccucggggcuggaacacgccaugugaacgccgagccggaaacccccaauauggaugugauuggcgagcggaucagacgcaucaaggaggaacacagcuccaccuggcauuacgacgaugagaacccuuauaaaacaugggcuuaccacgggucuuaugaagucaaggccacgggaagcgcguccagcaugauuaauggcgugguuaaacugcugaccaagcccugggacguggucccuacagugacccaaauggccaugacagauaccacacccuuuggccagcagcggguuuucaaagagaagguggacaccagaacgccgaagccuaugcccgggacccgcaaagucauggaaaucacagcuggauggcucuggcggacccugggcagaaacaagcgcccucggcuuugcacaagagaggaguuuaccaaaaaggugcgcacgaaugccgcuaugggggccguuuucacagaagagaaccaaugggauuccgcccgggcggcuguggaagacgaggaauuuuggaaacuggucgauagagagcgcgagcuccacaagcagggaaaauguggcucuugcguguacaauaugauggggaagagagaaaagaaacugggcgaguucggaaaggccaaaggcagccgggccauuugguacauguggcuuggggcucgcuaucuggaauuugaggcccucggauuccugaacgaggaccauugguuuuccagagaaaauucuuacagcggcgucgagggggaaggacugcacaagcucggcuauauccugcgggauauuuccaaaauccccgggggcgcuauguacgccgacgacaccgcgggaugggauacaagaaucaccgaggacgaucuucauaacgaagagaagauuacgcagcagauggacccugagcaccggcaacuggccaaugcuaucuucaagcucaccuaucagaacaaagugguuaaggugcagcgccccacaccgaaaggcaccgucauggauauuaucucuagaaaggaccagcgggggagcggacaagugggcacauacgggcugaauaccuuuacaaacauggaagcccagcuuauucgccagauggagggagaaggcgugcuguccaaaaccgaucucgagaauccucaucugcuggaaaagaagaucacgcaguggcucgagacaaaagggguugagagacugaagcggauggcuaucagcggcgacgauugcguggucaaacccauugacgaucgcuucgccaacgcgcuucuggcccucaacgacaugggaaaggugagaaaagauaucccccaauggcagccuucuaagggcuggcacgacuggcagcagguuccguucuguucccaccauuuucacgaacugauuaugaaggacgggcggaaacuugugguccccugccgcccucaagaugagcugaucggcagagcucggauuagccagggcgccggguggucucucaaggaaaccgcuugucugggaaaagccuaugcucagaugugggcccugauguacuuccaucgcagagaccuccggcuggcguccaaugccaucugcagcgcugugcccguccacugggugccuaccucucgcacaaccugguccauucacgcccaucaccaauggaugacaacggaggauaugcuuaccguuuggaacagaguguggaucgaagacaaucccuggauggaggauaagacaccugucaccacaugggaggacgugcccuaccugggcaaacgggaagaucaguggugugggagccucaucggccugaccuccagagccacgugggcucagaacauucuuaccgccauccagcaaguucgcagccugauuggaaaugaggaauuucucgacuauaugccgucuaugaagcgguucagaaaggaggaggaaagcgagggcgcgaucugguga

SEQ ID NO: 20927 - RNA, 9873 nt, Artificial Sequence
  derived and/or modified CDS sequence (opt5) from DENV-3__AY858045__SS-prME
accagccugugccucaugaugaugcugcccgccacccuugcuuuccaccugacguccagagacggagagccucggaugaucguggggaagaacgaacgcggaaaaucucuccuguuuaagaccgccagcggcauuaauauguguacacuuaucgcgauggaucugggggagaugugcgacgauaccauuacauacaaauguccgcucaucaccgaagucgagcccgaagacauugauugcugguguaaccugacauccaccuggguuacguauggaaccugcaaucaggcuggcgagcauagacgggacaagcgcucuguggcccuggccccucacguggggaugggacucgauacaagagcucaaaccuggaugagcgccgagggcgcuuggcggcaggucgaaaaaguggagacaugggccuuccgccaucccggcuuuaccauccuggcgcuuuuccuggcccacuacaucgggacgucccucacacagaagguugugauuuuuauccugcuuaugcuggucaccccuucuaugacaaugagaugugugggaguuggcaaccgggacuucguggaagggcucagcggagcuaccugggucgauguggugcuggagcauggcgggugcgucaccacaauggccaagaauaaacccacgcuggacauugagcuccagaagaccgaagcuacacaacuggccacccuucgcaaacuguguaucgagggaaagauuacaaacguuaccacggauuccagaugcccuacacagggcgaagcgauccucccggaggaacaggaccagaauuauguguguaaacacaccuacguggaucggggcugggggaacggaugcggccuguuugggaagggaagccuugucacaugcgccaaguuccaaugucuggagcucauugagggcaaagugguucagcacgaaaaucugaaguauacagugaucaucaccguccauacaggggaccagcaccaggugggaaacgagacgcaaggcguuaccgcugaaauuacaccccaggccucuaccguggaggcuauccugccugaauacggcacacucgggcuggagugcagccccagaaccggacuugacuuuaaugagaugauucugcucacgaugaaaaacaaggccuggaugguccauagacagugguucuuugaucugccucuucccuggaccagcggcgccacaaccgaaacaccgaccuggaauaaaaaggagcugcucgugacguucaaaaacgcucacgcgaagaagcaagaagucgugguucuggggucucaggagggagccaugcacacagcucugaccggcgccacagaaauccagaccuccgggggcaccagcauuuuugccggacaucucaaaugucggcugaagauggacaaacuugagcugaagggcaugucuuaugcuaugugcuccaaugccuucgugcucaaaaaggaggucagcgaaacacagcacgggacgauccugaucaagguggaguacaaaggagaagaugcgccuuguaagauucccuucuccaccgaggacggccaagggaaagcucauaacggacgccugaucacagccaacccuguugugaccaagaaagaggaacccgucaauauugaggccgaacccccuuuuggcgagucuaacaucauuaucgggaucggcgauaaggcucuuaagauuaauugguacaaaaagggaagcuccaucggcaaaauguucgaagccacagcuagaggggcccggagaauggcgauucucggagacaccgccugggauuuuggcagcgucgggggagugcugaacucucugggcaagaugguucaccagaucuucggguccgcuuauacggccauuuuuagcggcgucucuuggaucaugaaaauuggaaucggcgugcuccugacauggaucgggcuuaauagcaagaacaccuccaugucuuucagcugcauugugaucggaauuaucacccuguaccucggcgcugucgugcaggccgacaugggguguguuauuaauuggaagggaaaagagcugaagugcggcuccgggaucuuugugacaaacgagguccauaccuggacagaacaguauaaauuccaagcggauagcccgaagcgccuggccacggcuaucgccggcgcuugggagaauggaguguguggcauucggucuaccacaagaauggaaaaccuucucuggaaacagaucgccaaugagcugaacuacauucugugggaaaauaacaucaagcucaccguuguggucggggacauuaucggagugcuggagcagggcaaacgcacacuuacaccccagccuauggagcugaaguauuccuggaagacgugggggaaagccaagaucguuaccgcugaaauucaaaauagcucuuuuaucauugauggacccaacacaccugagugccccaacgcgucccgggccuggaaugugugggaagucgaggacuacggcuucggcguguuuaccacaaacaucuggcucaaacugagagaaauguauacccagcugugugaccaccgccuuaugagcgcugccgugaaggaugagcgggccguccacgcugacaugggguacuggauugagucccagaaaaauggaucuuggaagcucgaaaaggccagccugaucgagguuaaaacaugcaccuggccgaagucccauacgcuguggucuaacggcgugcucgaaagcgauaugaucauuccuaaaucccuggcggggcccaucagccagcacaauuacagaccuggauaucauacacaaaccgcuggccccuggcaccuugggaagcuggagcucgacuucaacuacugcgagggaaccacaguggucauuaccgaaaauuguggcacgcgcggcccuucucugcggacaaccacaguguccgggaaacugauccacgaguggugcuguagaagcugcacccuucccccgcuccgcuauaugggagaagauggcuguugguacgggauggagauucggccuaucaacgaaaaggaggagaauaugguuaagucucugguguccgccggaagcggcaaagucgacaacuuuacaaugggggugcugugccucgccauucuguucgaagagguuaugagaggaaaguucggcaaaaagcauaugaucgcuggcgugcuuuuuauguucguccugcuccugucugggcagaucaccuggcgggauauggcccgcacgcugauuaugaucggaagcaaugcguccgacagaaugggcaugggggugaccuaucuugcucugauugccacauuugaaauccagcccuuccucgcccugggauuuuuccuccggaaacugaccagcagagagaaccuucugcucggcguugggcuggcuauggccacaacccugcaacuucccgaagauauugagcagauggcuaauggaaucgcccugggccucauggcgcugaagcucaucacgcaguuugagacauaccagcuguggaccgcccuugugucucugacauguuccaacaccauuuucacccucacagucgcuuggcgcacggccacccugauccuggcuggcauuagccuucugccugugugccaauccucuagcaugcggaagacagacuggcucccgaugaccguggccgccaugggggugcccccucugccccucuuuaucuucucccugaaagauacacuuaagagacgcucuuggccucugaaugaaggaguuauggcugugggccuggugagcauucucgcguccucucugcuuagaaacgacguccccauggccgggccucugguggcuggaggccuccugaucgccuguuauguuaucaccgggacgagcgccgaucucacaguggagaaagcugccgacgucaccugggaagaggaagcggagcagaccggagugucccacaaccugaugauuacaguugacgaugacggcaccaugcggaucaaggaugacgagacagaaaauauucuuacggugcugcugaaaaccgcucuccugaucgucagcggcauuuuucccuacucuaucccggccacacuucugguguggcauaccuggcagaagcagacacaacgcuccgggguccucugggaugugccuucucccccugagacccagaaagccgaacuggaggagggaguuuacagaauuaagcagcagggcaucuucgggaagacgcaagugggagucggcgugcagaaagaagggguuuuucacaccauguggcaugugacacggggagcuguccucaccuauaacggcaagcgccuggagcccaauugggccuccgugaaaaaggaccuuaucuccuacggcgggggauggagacugagcgcgcaguggcaaaaaggcgaagaggugcagguuauugcugucgaaccggggaagaacccuaagaauuuccagacaaugcccggaaucuuccagaccacaacgggcgagauuggggccaucgcccuggauuuuaaaccuggaaccucuggcucccccauuaucaaccgggagggcaaggugguggggcucuauggaaauggcgucgugaccaagaacgggggauacguuagcggcaucgcucaaaccaaugccgaacccgacgggccuaccccggagcuggaagaggaaauguucaagaaacgcaaccuuacaauuauggaucugcaccccggcuccggaaagacgagaaaguaucucccugcuaucgugcgggaggccauuaaacgcagacugcggacccucauccuggcgcccacaagagucguggccgcugagauggaagaggcccuuaagggccugccuauucgcuaccagaccacagcuaccaaaagcgaacacacggggaaggagaucguugaccugaugugccaugccacauuuaccaugcggcuccugucucccgugagagucccuaauuauaaccuuaucauuauggaugaagcccacuucaccgacccggcuagcaucgcggcccgcggauacauuuccacacgggugggcaugggggaggcugccgccaucuuuaugaccgcuacacccccuggaaccgccgaugcguucccccagucuaaugcuccuauucaggacgaggaaagagacauccccgagcgcagcuggaacuccggcaaugauuggauuacggacuuugccgggaaaacaguuugguucgugccgucuaucaaggccggcaacgauaucgcuaacugucugcggaagaauggcaagaaggucauucaacucagcagaaaaaccuuugacacagaauaccagaagaccaaacugaacgauugggacuucguggugacgaccgauaucuccgagaugggcgccaauuuuaaggcggaccgcgucauugauccucggagaugccugaagcccguuauccucacagacgggcccgagcgggugauucuugccggaccuaugcccgugaccgucgcuucugccgcucagcgcagaggccggguggggcgcaacccucagaaagaaaaugaucaauauaucuucacaggacagccgcugaacaaugacgaggaccaugcccacuggaccgaagcuaagaugcugcucgauaacaucaauacacccgagggcauuaucccugcccuguucgaacccgagagagagaaaagcgcggccauugacggggaauaccggcuuaagggcgaguccagaaaaaccuuuguugaacugaugcgccggggagaucucccuguguggcuggcucauaaggucgccagcgagggcaucaaauauacggacagaaaguggugcuucgauggggaacgcaacaaucagauucuggaggagaacauggacguggaaaucuggacaaaggagggagagaaaaagaaacuccggcccagauggcuugaugcucgcaccuacucugacccgcuggcccugaaggaguuuaaagauuucgccgcuggccggaaguccaucgcgcucgaccugguuaccgaaauugggagagugccuagccaccuugcccaccgcacaagaaaugcucuggauaaccucgucaugcugcauaccucugagcacggaggccgggccuaucgccaugccguggaggaacugcccgagacaauggaaacgcuccuucugcugggccucaugauccugcuuaccgggggagcuaugcuguuucucauuuccggcaagggggucggaaaaacaagcaucggccugauuugugugguugccuccucugggaugcuguggauggcggacaucccucuccaguggauugccagcgcuaucgugcuugaguucuuuaugauggugcugcugauccccgagccugaaaagcaaagaacaccccaggauaaucagcucgccuacgucguuauuggaauccugacacuugcugccauuguggcggccaacgagaugggccugcucgaaaccacgaaacgggaccugggcauguccaaggagccggggguggucagcccuaccucuuaucuggacguggaucuccaccccgcuuccgccuggacacuuuacgcuguugccaccacagugaucacccccaugcugcgccacacgauugaaaauagcacagcuaacgucucucuggccgcgaucgccaaccaagcugugguccucaugggacuggacaaaggcuggccuaucagcaagauggaucuuggggugccgcugcucgcccugggaugcuacucccagguuaauccccugacccucacagcugccgugcuucugcuggucacccauuaugccauuaucggcccugggcuccaggcgaaggcuaccagagaggcccagaaacggacagcugccggaauuaugaagaaccccacgguggacggcaucaugaccauugaucuggacccuguuaucuacgauucuaaauucgagaagcaacuuggccaggugaugcugcucguccugugugccgugcagcugcuccuuaugagaacaagcugggcuuuuugcgaagcccugacccuggcgacagggcccaucaccacgcucugggagggauccccuggcaaauucuggaauacaaccauugccgugucuauggcuaacaucuuucgcgggagcuaucuggccggagcuggccuugccuucuccauuaugaaaagcguugggaccggaaagcggggcacaggcucucagggggaaacccugggagagaaauggaagaaaagacucaaucaacugucccgcaaggaauuugaccuguacaaaaagagcggcaucacagaggucgaucggacggaggcgaaagaagggcucaagagaggagagauuacccaccaugccgugucccggggcucugcuaaacuucagugguucguggaacgcaacauggucaucccggaggggagaguuauugaccugggauguggccggggcggguggagcuauuacugcgccggacugaaaaaggugacagaagugcgcggcuauaccaaagggggacccggccacgaggagccuguccccauguccacauacggguggaauaucgugaagcucaugucuggaaaagauguuuucuaccugccucccgaaaagugugacacccuucugugcgauaucggcgagagcuccccgagcccuacgguggaagagucuagaaccauucggguccucaagaugguggagcccuggcugaaaaacaaucaguuuuguaucaagguucugaaccccuauaugccuacagugauugaacaucucgagcgccuucagagaaaacacggcgggaugcugguccggaauccccugucccgcaacagcacccacgaaauguacuggaucucuaauggaacaggcaacauuguguccagcgugaauauggucucuagacuccugcuuaaccgguucaccaugacauauagacgcccuaccaucgagaaggacguugaccugggggcuggaacgcggcaugugaacgccgaaccggagacacccaauauggaugugaucggcgagcgcauucgccggaucaaagaagaacacagcuccaccuggcauuacgacgaugaaaacccuuauaagaccugggcuuaccacgggucuuaugaggucaaggccacaggaagcgcguccagcaugauuaauggcgugguuaaacuccugacgaagcccugggacguggucccuaccgugacacaaauggccaugaccgauacaacccccuuuggccagcagagaguuuucaaagaaaagguggacacacgcaccccgaaaccuaugcccgggacgcggaaggucauggagaucaccgcuggauggcuguggagaacacucggccgcaacaagcggccuagacugugcacccgcgaggaauuuaccaaaaaggugcggaccaaugccgcuaugggggccguuuucacggaggaaaaccaaugggauuccgccagagcggcuguggaggacgaagaguuuuggaaacuugucgaucgcgagagagaacugcacaagcagggaaaauguggcucuugcguguacaauaugauggggaagcgggagaaaaagcucggcgaguucggaaaggccaaaggcagccgcgccauuugguacauguggcugggggcuagauaucuugaguuugaggcccugggauuccucaacgaagaccauugguuuucccgggaaaauucuuacagcggcgucgaaggggagggacugcacaagcugggcuauauccucagagauaucuccaaaauucccgggggcgcuauguacgccgacgacacagcgggaugggauacccggaucacagaagacgaucugcauaacgaggagaagauuacccagcagauggacccugaacaccgccaacuugccaaugcuaucuucaaacugacguaucagaacaaggugguuaaggugcagagacccaccccgaaaggcacagucauggauauuaucucucggaaggaccagcgcgggagcggacaagugggcaccuacgggcucaauacauuuaccaacauggaggcccagcugaucagacagauggaaggagagggcgugcuuuccaaaacagaucuggaaaauccucaucuccuggagaagaaaauuacccaguggcuggagacgaaggggguugaacggcucaagcgcauggcuaucagcggcgacgauugcguggucaaacccauugacgauagauucgccaacgcgcugcuugcccugaacgacaugggaaaggugcggaaagauaucccccaauggcagccuucuaagggcuggcacgacuggcagcagguuccguucuguucccaccauuuucacgagcucauuaugaaagacgggcgcaagcuggugguccccugcagaccucaagaugaacuuaucggacgggcucgcauuagccagggcgccggguggucucugaaggagacagcuugucucggaaaagccuaugcucagaugugggcccugauguacuuccauagacgggaccugcgccucgcguccaaugccaucugcagcgcugugcccguccacugggugccuaccucuagaaccacaugguccauccacgcccaucaccaauggaugaccacagaagauaugcugacgguuuggaaccggguguggauugaggacaaucccuggauggaggauaagaccccugucacaaccugggaagacgugcccuaccuuggcaaaagagaggaucaguggugugggagccugaucggccucacaucccgcgccaccugggcucagaacauucugacggccauccagcaaguucggagccuuauuggaaaugaagaguuucuggacuauaugccgucuaugaagagauuccgcaaagaggaagagagcgaaggcgcgaucugguga

SEQ ID NO: 20928 - RNA, 9873 nt, Artificial Sequence
  derived and/or modified CDS sequence (opt5) from DENV-3__AY858046__SS-prME
accagccucugccucaugaugaugcugcccgccacccuugcuuuccaccugacgucccgggacggagagccucggaugaucguggggaagaacgaacgcggaaagucucuccuguuuaagaccgccagcggcauuaauauguguacccuuaucgcgauggaucugggggagaugugcgacgauaccauuacauacaaguguccgcucaucaccgaaguggagcccgaagacauugauugcugguguaaccugacauccaccuggguuacguauggaaccugcaaucaggugggcgagcauagacgggacaagcgcucuguggcucuggccccucacgucgggaugggacucgauacaagagcccagaccuggaugagcgcugagggcgccuggagacagguggaaaagguugagacaugggcuuuccgccaucccggcuuuaccauccuggcccuuuuccuggcgcacuacaucgggacgucccucacacagaagguggucauuuuuauccugcuuaugcuggugaccccuucuaugacaaugagauguguuggagugggcaaccgggacuucgucgaagggcucagcggagccaccuggguggaugugguccuggagcauggcgggugcguuaccacaauggcuaagaauaagcccacgcuggacauugagcuccagaagaccgaagccacacaacuggcuacccuucgcaaacuguguaucgagggaaagauuacaaacgugaccacggauuccagaugcccuacacagggcgaagccauccucccggaggaacaggaccagaauuauguguguaaacacaccuacgucgaucggggcugggggaacggaugcggccuguuugggaagggaagccuugugaccugcgcgaaguuccaaugucuggagcucauugagggcaaaguugugcagcacgaaaaucugaaguauacagucaucaucaccgugcauacaggggaccagcaccagguuggaaacgagacgcaaggcgugaccgccgaaauuacaccccaggcuucuaccgucgaggccauccugccugaauacggcacacucgggcuggagugcagcccccgcaccggacuugacuuuaaugagaugauucugcucacgaugaaaaacaaggcuuggauggugcauagacagugguucuuugaucugccucuucccuggaccagcggcgccacaaccgaaacaccgaccuggaauaaaaaggagcugcucgucacguucaaaaacgcccacgcuaagaagcaagaagugguugugcuggggucucaggagggagcgaugcacacagcccugaccggcgcuacagaaauccagaccuccgggggcaccagcauuuuugccggacaucucaaaugucggcugaagauggacaaacuugagcugaagggcaugucuuaugccaugugcuccaaugcuuucguccucaaaaaggaggugagcgaaacacagcacgggacgauccugaucaagguugaguacaaaggagaagaugccccuuguaagauucccuucuccaccgaggacggccaagggaaagcgcauaacggacgccugaucacagcuaacccuguggucaccaagaaagaggaacccgugaauauugaggccgaacccccuuuuggcgagucuaacaucauuaucgggaucggcgauaaggcccuuaagauuaauugguacaaaaagggaagcuccaucggcaaaauguucgaagcuacagccagaggggcucggagaauggccauucucggagacaccgcgugggauuuuggcagcgucgggggaguucugaacucucugggcaagaugguccaccagaucuucggguccgccuauacggcucucuuuagcggcgugucuuggauuaugaaaaucggaauuggcgugcugcuuacauggaucgggcugaauagcaagaacaccuccaugucuuucagcugcaucgucauuggaaucauuacccucuaccugggcgccgugguucaggcugacauggggugugugaucaauuggaagggaaaagagcugaagugcggcuccgggauuuuugucacaaacgaggugcauaccuggacagaacaguauaaauuccaagccgauagcccgaagcgccuugcgacggccaucgcuggcgccugggagaauggaguuuguggcauccggucuaccacaagaauggaaaaccuccuguggaaacagauugcuaaugagcugaacuacauccucugggaaaauaacauuaagcugaccguggucgugggggacaucauuggaguucuugagcagggcaaacgcacacugacaccccagccuauggagcucaaguauuccuggaagacgugggggaaagccaagaucgugaccgccgaaauccaaaauagcucuuuuauuaucgauggacccaacacaccugagugccccaacgcuucccgggcguggaaugucugggaaguggaggacuacggcuucggcguguuuaccacaaacauuuggcugaaacugagagaaauguauacccagcuuugugaccaccgccucaugagcgccgcugucaaggaugagcgggccguucacgccgacaugggguacuggaucgagucccagaaaaauggaucuuggaagcuggaaaaggcuagccugauugaggugaaaacaugcaccuggccgaagucccauacgcucuggucuaacggcgugcuggaaagcgauaugaucaucccuaaaucccuugccgggcccauuagccagcacaauuacagaccuggauaucauacacaaaccgcgggccccuggcaccuggggaagcucgagcuggacuucaacuacugcgagggaaccacagucgugaucaccgaaaauuguggcacgcgcggcccuucucugcggacaaccacaguuuccgggaaacuuauucacgaguggugcuguagaagcugcacccugcccccgcugcgcuauaugggagaagauggcuguugguacgggauggagauccggccuauuaacgaaaaggaggagaauauggugaagucucuggucuccgcuggaagcggcaaaguggacaacuuuacaauggggguucucugccuggccauccuuuucgaagaggugaugagaggaaaguucggcaaaaagcauaugauugccggcguccuguuuauguucgugcuccugcugucugggcagaucaccuggcgggauauggcucgcacgcuuaucaugauuggaagcaaugccuccgacagaaugggcauggggguuaccuaucuggcgcucaucgcuacauuuaaaauucagcccuuccuggcccucggauuuuuccugcggaaacuuaccagcagagaaaaccugcuccugggcguggggcuggccauggcuacaacccuucaacugcccgaggauaucgaacagauggccaauggaauugcucucggccugauggcccucaagcugaucacgcaguuugagacauaccagcuuuggaccgcgcuggucucucucacauguuccaacaccaucuucacccugacaguggccuggcgcacggcuacccugauucuugccggcaucagccugcucccugugugccaauccucuagcaugcggaaaacagacuggcugccgaugaccgucgcugccauggggguucccccucucccccuguuuauuuucucccuuaaggauacacugaaaagacgcucuuggccucugaaugagggagugauggccgugggccucgucagcauccuggcuuccucucuucugagaaacgacgugcccauggcggggccucucguugccggaggccugcucauugcuuguuaugugaucaccgggacgagcgccgaucugacagucgaaaaggccgcugacgugaccugggaggaagaggccgaacagaccggaguuucccacaaccuuaugaucacaguggacgaugacggcaccaugcggauuaaagaugacgagacagagaauauccugacgguccugcucaagaccgcgcugcuuauugugagcggcaucuuucccuacucuauuccggcuacacugcucgucuggcauaccuggcagaaacagacacaacgcuccggggugcugugggauguuccuucucccccugaaacccagaaggccgagcucgaagagggaguguacagaaucaagcagcagggcauuuucgggaaaacgcaagucggagugggcguucagaaggaggggguguuucacaccauguggcaugucacacggggagccgugcugaccuauaacggcaaacgccuugaacccaauugggcuuccgugaagaaagaccugaucuccuacggcgggggauggagacugagcgcccaguggcaaaagggcgaggaaguucaggucaucgcgguggagccggggaagaacccuaaaaauuuccagacaaugcccggaauuuuccagaccacaacgggcgaaaucggggcuauugcccucgauuuuaagccuggaaccucuggcucccccaucauuaaccgggagggcaaaguggucgggcuguauggaaauggcgugguuacaaagaacgggggauacgugagcggcaucgcccaaaccaaugcugagcccgacgggccuaccccggaacuugaggaagagauguucaaaaagcgcaaccugacaaucauggaucuccaccccggcuccggaaagacgagaaaauaucugccugccauuguccgggaagcuaucaagcgcagacuccggacccugauucuugcccccacaagagugguugcggccgagauggaggaagcucugaaaggccugccuauccgcuaccagaccacagccaccaagagcgagcacacggggaaagaaauuguggaccucaugugccaugcuacauuuaccaugcggcugcuuucucccgucagagugccuaauuauaaccugaucaucauggaugaggcccacuucaccgacccggccagcauugcugcgcgcggauacaucuccacacggguuggcaugggggaagccgcugccauuuuuaugaccgccacacccccuggaaccgcugaugccuucccccagucuaaugcgccuauccaggacgaggagagagacauucccgaacgcagcuggaacuccggcaaugauuggaucacggacuuugcugggaagacagugugguucgucccgucuauuaaggccggcaacgauaucgccaacugucuccggaaaaauggaaagaaagugauccaacugagcagaaagaccuuugacacagaguaccagaaaaccaagcugaacgauugggacuucguggucacgaccgauauuuccgaaaugggcgcuaauuuuaaggccgaccgcguuaucgauccucggagaugccucaaacccgugauucuuacagacgggcccgagcgggugauccuggcgggaccuaugcccgucaccguggccucugcugcccagcgcagaggccggguugggcgcaacccucagaaggagaaugaucaauauauuuucacaggacagccgcugaacaaugacgaagaccaugcucacuggaccgaggccaaaaugcuccuggauaacaucaauacacccgaaggcaucauuccugcucuuuucgagcccgaaagagaaaagagcgccgcgaucgacggggaguaccggcugaaaggcgaauccagaaagaccuuuguggagcucaugcgccggggagaucugccugucuggcuggcccauaaaguggcuagcgaaggcauuaaguauacggacagaaaguggugcuucgauggggagcgcaacaaucagauccucgaagagaacauggacguugagauuuggacaaaagaaggagagaagaagaaacuucggcccagauggcuggaugcccgcaccuacucugacccgcuggcucucaaagaauuuaaagauuucgccgccggccggaaguccaucgcucuggaccuugugaccgagaucgggagagucccuagccaccuggcgcaccgcacaagaaaugcccucgauaaccuggugaugcugcauaccucugaacacggaggccgggcuuaucgccaugccgucgaggagcuccccgaaacaauggagacgcuucugcugcucggccugaugauucuucugaccgggggagccaugcucuuucugaucuccggcaaaggggugggaaagacaagcauuggccugaucuguguuguggcuuccucugggaugcucuggauggccgacauuccucuucaguggaucgcgagcgccauugugcuggaguucuuuaugaugguccugcucauccccgagccugagaaacaaagaacaccccaggauaaucagcuggcuuacguugugaucggcauucuuacacuggccgcuaucguggccgcgaacgaaaugggcaugcucgagaccacgaagcgggaccugggcauguccaaagaaccgggggucgugagcccuaccucuuaucuggacguugaucuccaccccgccuccgcuuggacacuuuacgccguggcuaccacagucauuacccccaugcugcgccacacgaucgagaauagcacagccaacgugucucuggcugccauugcgaaccaagccgucgugcucaugggacuggacaagggcuggccuaucagcaagauggaucuugggguuccgcugcucgcucugggaugcuacucccaggugaauccccugacccucacagccgcuguccuucugcuggugacccauuaugccaucauuggcccugggcuccaggccaaagcgaccagagaagcucagaagcggacagccgcuggaaucaugaaaaaccccacgguugacggcauuaugaccaucgaucuggacccugugauuuacgauucuaaguucgagaaacaacuuggccaggucaugcugcucgugcugugugccgugcagcugcuccuuaugagaacaagcugggccuuuugcgaggcucugacccuggccacagggcccaucaccacgcucugggaaggauccccuggcaaguucuggaauacaaccaucgcgguuucuauggccaacauuuuucgcgggagcuaucuggcuggagccggccuugcuuucuccaucaugaaaagcgucgggaccggaaaacggggcacaggcucucagggggagacccugggagaaaaguggaaaaagaaacucaaucaacuguccagaaaggaguuugaccuguacaaaaagagcggcauuacagaaguggaucgcacggaggccaaggaggggcuccggagaggagaaaucacccaccaugcggugucccggggcucugccaaacuucagugguucgucgagcgcaacaugguuauuccggaagggagagugaucgaccugggauguggccggggcggguggagcuauuacugcgcuggacugaagaaagugacagagguccgcggcuauaccaaagggggacccggccacgaagaaccugugcccauguccacauacggguggaauauuguuaaacucaugucuggaaaggauguguucuaccugccucccgagaagugugacacccuucugugcgauaucggcgaaagcuccccgagcccuacggucgaggaaucuagaaccauccgggugcucaaaaugguugagcccuggcugaagaacaaucaguuuuguauuaaagugcugaaccccuauaugccuacagucaucgagcaucucgaacgccuucagagaaagcacggcgggaugcuggugcggaauccccugucccgcaacagcacccacgagauguacuggauuucuaauggaacaggcaacaucguguccagcgucaauaugguuucuagacuccugcuuaaccgguucaccaugacauauagacgcccuaccauugaaaaagacguggaccugggggccggaacgcggcaugugaacgcugagccggaaacacccaauauggaugucaucggcgagagaauccgccggauuaaggaggaacacagcuccaccuggcauuacgacgaugagaacccuuauaagaccugggccuaccacgggucuuaugaagugaaagcuacaggaagcgccuccagcaugaucaauggcguugugaagcuccugacgaaacccugggacgucgugccuaccguuacacaaauggcgaugaccgauacaacccccuuuggccagcagagaguguucaaggagaaagucgacacacgcaccccgaagccuaugcccgggacgcggaaggccauggaaauuaccgcuggauggcuguggagaacacucggccgcaacaaacggccuagacugugcacccgcgaggaguuuacaaagaaagugcggaccaaugccgcuaugggggccguuuucacggaagagaaccaaugggauuccgccagagcggcuguggaagacgaggaauuuuggaaacuugucgaucgcgagagagagcugcacaaacagggaaaguguggcucuugcguguacaauaugauggggaaacgggaaaagaagcucggcgaguucggaaaagccaagggcagccgcgccaucugguacauguggcugggggcuagauaucuugaauuugaggcccugggauuccucaacgaggaccauugguuuucccgggaaaauucuuacagcggcgucgagggggaaggacugcacaaacugggcuauauucucagagauaucuccaagauccccgggggcgcuauguacgccgacgacacagcgggaugggauacccggauuacagaggacgaucugcauaacgaagagaaaaucacccagcagauggacccugagcaccgccaacuugccaaugcuauuuucaagcugacguaucagaacaaggugguuaaagugcagagacccaccccgaagggcacagucauggauaucauuucucggaaagaccagcgcgggagcggacaagugggcaccuacgggcucaauacauuuaccaacauggaagugcagcugaucagacagauggagggagaaggcguucuuuccaagacagaucuggagaauccucaucuccuggagaagaagaucacccaguggcuggagacgaaggggguggagcggcucaaacgcauggccauuagcggcgacgauugcgucgugaagcccaucgacgauagauucgcuaacgcccugcuugcgcugaacgacaugggaaaaguucggaaggauauuccccaauggcagccuucuaaaggcuggcacgacuggcaacaggugccguucuguucccaccauuuucacgaacucaucaugaaggacgggcgcaagcuggucgugcccugcagaccucaagaugagcuuauuggacgggcccgcaucagccagggcgcuggguggucucugaaagaaacagccugucucggaaaggcuuaugcccagaugugggcucugauguacuuccauagacgggaccugcgccucgccuccaaugcgauuugcagcgccguccccgugcacuggguuccuaccucuagaaccacaugguccauccacgcucaucaccaauggaugaccacagaggauaugcugacgguguggaaccgggucuggaucgaagacaaucccuggauggaggauaaaaccccugugacaaccugggaggacguucccuaccuuggcaagagagaagaucaguggugugggagccugauuggccucacaucccgcgccaccugggcccagaacauccugacggcuauucagcaagugcggagccuuaucggaaaugaggaauuucuggacuauaugccgucuaugaaaagauuccgcaaggaggaggaaagcgagggcgccauuugguga

SEQ ID NO: 20929 - RNA, 9873 nt, Artificial Sequence
  derived and/or modified CDS sequence (opt5) from DENV-3__AY858047__SS-prME
accagccugugccucaugaugaugcugcccgccacccuugcuuuccaccugacguccagagacggagagccucggaugaucguggggaagaacgaacgcggaaaaucucuccuguuuaagaccgccagcggaauuaauauguguacacuuaucgcgauggaucugggggagaugugcgacgauaccgugacauacaaauguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagagcucagaccuggaugagcgccgagggcgcuuggcggcaaguggaaaaaguugagacaugggccuuccgccaucccggcuuuaccauucuggcgcuuuuccuggcccacuacaucgggacgucccucacacagaagguggucaucuuuauucugcuuaugcuggugaccccuucuaugacaaugagauguguuggagugggcaaccgggacuucgucgaagggcucagcggagcuaccuggguggaugugguccuggagcauggcgggugcguuaccacaauggccaagaauaaacccacgcuggacaucgagcuccagaagaccgaagcuacacaacuggccacccuucgcaaacuguguauugagggaaagaucacaaacgugaccacggauuccagaugcccuacacagggcgaagcgauucucccggaggaacaggaccagaauuauguguguaaacacaccuacgucgaucggggcugggggaacggaugcggccuguuugggaagggaagccuugugaccugcgccaaguuccaaugucuggagcucaucgagggcaaaguugugcagcacgaaaaucugaaguauacagucauuaucaccgugcauacaggggaccagcaccagguuggaaacgagacgcaaggcgugaccgcugaaaucacaccccaggccucuaccgucgaggcuauucugccugaauacggcacacucgggcuggagugcucccccagaaccggacuugacuuuaaugagaugauccugcucacgaugaaaaacaaggccuggauggugcauagacagugguucuuugaucugccucuucccuggaccagcggcgccacaaccgaaacaccgaccuggaauaaaaaggagcugcucgucacguucaaaaacgcucacgcgaagaagcaagaagugguugugcuggggucucaggagggagccaugcacacagcucugaccggcgccacagaaauucagaccuccgggggcaccagcaucuuugccggacaucucaaaugucggcugaagauggacaaacuugagcugaagggcaugucuuaugcuaugugcuccaaugccuucguccucaaaaaggaggugagcgaaacacagcacgggacgauucugaucaagguugaguacaaaggagaagaugcgccuuguaagauccccuucuccaccgaggacggccaagggaaagcucauaacggacgccugauuacagccaacccuguggucaccaagaaagaggaacccgugaauaucgaggccgaacccccuuuuggcgagucuaacauuaucauugggaucggcgauaaggcucuuaagaucaauugguacaaaaagggaagcuccauuggcaaaauguucgaagccacagcuagaggggcccggagaauggcgauccucggagacaccgccugggauuuuggcagcgucgggggaguucugaacucucugggcaagaugguccaccagauuuucggguccgcuuauacggcccucuuuagcggcgugucuuggaucaugaaaauuggaaucggcgugcugcuuacauggauugggcugaauagcaagaacaccuccaugucuuucagcugcaucgucaucggaauuaucacccucuaccugggcgcugugguucaggccgacauggggugugugauuaauuggaagggaaaagagcugaagugcggcuccgggaucuuugucacaaacgaggugcauaccuggacagaacaguauaaauuccaagcggauagcccgaagcgccuugccacggcuauugccggcgcuugggagaauggaguuuguggcauccggucuaccacaagaauggaaaaccuccuguggaaacagaucgccaaugagcugaacuacauucucugggaaaauaacaucaagcugaccguggucgugggggacauuaucggcauucuugagcagggcaaacgcacacugacaccccagccuauggagcucaaguauuccuggaagacgugggggaaagccaagaucguuaccgcugaaauccaaaauagcucuuuuauuaucgauggacccaacacaccugagugccccaacgcgucccgggccuggaaugugugggaagucgaggacuacggcuucggcguguuuaccacaaacauuuggcugaaacugagagaaauguauagccagcuuugugaccaccgccucauguccgcugccgugaaggaugagcgggccguccacgcugacaugggguacuggaucgagucucagaaaaauggaagcuggaagcuggaaaaggccucccugauugagguuaaaaccugcacauggccgaagucucauacccucuggagcaacggcgugcuggaauccgauaugaucaucccuaaaagccuugcggggcccauuucucagcacaauuacagaccuggauaucauacgcaaacagcuggccccuggcaccuggggaagcucgagcuggacuucaacuacugcgagggaaccaccguggucaucacagaaaauuguggcacccgcggcccuucccugcggacgacaaccgugagcgggaaacuuauucacgaguggugcuguagaucuugcacacugcccccgcugcgcuauaugggagaagauggcuguugguacgggauggagauccggccuauuaacgaaaaggaggagaauaugguuaagucccuggugagcgccggaucuggcaaagucgacaacuuuaccaugggggugcucugccuggccauccuuuucgaagagguuaugagaggaaaguucggcaaaaagcauaugauugcuggcgugcuguuuacauucguccuccugcugagcgggcagaucaccuggcgggauauggcccgcacgcuuaucaugauuggauccaaugcgagcgacagaaugggcaugggggugaccuaucuggcucucaucgccacauuuaaaauucagcccuuccuggcccucggauuuuuccugcggaaacuuaccucuagagaaaaccugcuccugggcguugggcuggcuauggccacaacccuucaacugcccgaggauaucgaacagauggcuaauggaauugcccucggccugauggcgcucaagcugaucacgcaguuugagacauaccagcuuuggaccgcccuggugucccucauguguagcaacacaaucuucacccugaccgucgcuuggcgcacagccacgcugauucuugcuggcaucucccugcucccucugugccaaucuagcuccaugcggaaaaccgacuggcucccgaugacaguggccgccaugggggugcccccucugccccuuuuuauuuucucucugaaggauacccugaaaagacgcagcuggccucucaaugagggagucauggcuguuggccugguguccauccuugcgucuagccugcucagaaacgacgugcccauggccgggccucuggucgcuggaggccuccugauugccuguuaugugaucacagggaccuccgccgaucuuacgguugaaaaggcugccgacgugacaugggaggaagaggcggaacagaccggagucagccacaaccugaugaucaccguggacgaugacggcacaaugcggauuaaagaugacgagaccgagaauauccugacaguucuccugaagacggcccuucucauugugucuggcaucuuucccuacuccauuccggcuacccuccuggucuggcauacauggcagaaacgcacccagagaagcggggugcucugggaugucccuucucccccugaaacacaaaaggccgagcuggaagagggaguguaccggaucaagcagcagggcauucuugggaaaacccagguuggagugggcguccaaaaggaggggguguuccacacgauguggcauguuacccgcggagcugugcugacauauaacggcaaaagacuggaacccaauugggccuccgucaagaaagaccucaucagcuacggcgggggauggcggcugucugcgcaguggcagaagggcgaggaagugcaagugaucgcuguugagccggggaagaacccuaaaaauuuucagaccaugcccggaauuuuccagacaaccacaggcgaaaucggggccauugcccuugauuucaagccuggaacguccggcagccccaucauuaaccgcgagggcaaagucguggggcuguauggaaauggcguggucaccaagaacgggggauacguguccggcaucgcucagacaaaugccgagcccgacgggccuaccccggaacucgaggaagagauguuuaaaaagagaaaccugaccaucauggaucuccaccccggcagcggaaagacacggaaauaucugccugcuauuguucgcgaagccaucaagagacggcuuagaacgcugauucuggcgcccacccgcguggucgccgcugagauggaggaagcccucaaaggccugccuauccgguaccaaacaaccgcuacaaagucugagcacaccgggaaagaaauuguggaccuuaugugccaugccacguucacaaugagacugcucagccccguucgcgugccuaauuauaaccugaucaucauggaugaggcccacuuuaccgacccggcuuccauugcggcccggggauacaucucuaccagagucggcaugggggaagcugccgccauuuucaugacagcuacacccccuggaacagccgaugcguuuccccagagcaaugcuccuauccaggacgaggagcgcgacauucccgaacgguccuggaacucuggcaaugauuggaucaccgacuucgccgggaagacggugugguuuguuccgagcauuaaggccggcaacgauaucgcuaacugucugcgcaagaauggaaagaaagugauccagcucucccgcaagacauucgacaccgaguaccagaagacgaaacuuaacgauugggacuuugucgugaccacggauauuucugaaaugggcgccaauuucaaggcggaccgggugaucgauccuagacggugccugaaacccgucauucugaccgacgggcccgagcgcguuauccucgccggaccuaugcccgugacaguggcuagcgccgcucagagacggggccgcgucgggagaaacccucagaaggagaaugaucaguauauuuuuaccggacaaccgcugaacaaugacgaagaccaugcccacuggacagaggcuaaaaugcuucuggauaacaucaauacccccgaaggcaucauuccugcccucuucgagcccgaacgggagaaguccgcggccaucgacggggaguacagacugaaaggcgaaagccgcaagacauucguggagcugaugcggagaggagaucucccuguuuggcuugcucauaaaguggccucugaaggcauuaaguauaccgaccgcaaguggugcuuugauggggagcggaacaaucagauccuggaagagaacauggacgucgagauuuggacgaaagaaggagagaagaaaaagcugagaccccgcuggcucgaugcucggacauacuccgacccgcuggcccuuaaagaguucaaggauuuugccgcuggcagaaagagcaucgcgcuggaccucgugaccgagaucgggcgcguuccuucucaccuggcccacagaacccggaaugcucuggauaaccucgugaugcuucauacauccgaacacggaggccgcgccuauagacaugccgucgaggagcugcccgaaaccauggagacacugcuccugcuuggccugaugauucuccugacagggggagugaugcuguuccucaucagcggcaaaggggucggaaagaccuccauuggccuuaucugugugguugcuucuagcgggaugcuguggauggccgacauuccucugcaguggaucgcguccgccauugugcucgaauuuuucaugauggugcugcuuauccccgagccugagaaacagcggacaccccaagauaaucagcuggcuuacgucguuaucggcauucucacccuggccgcuaucguggccgcgaacgaaaugggccugcucgagacaaccaagcgcgaccuuggcaugagcaaagaaccggggguggccucuccuacguccuaucuggacgucgaucugcaccccgcuagcgccuggacccucuacgcuguggccacaaccguuauuacacccaugcugagacacaccaucgaaaauucuacggcuaacgugagccuugccgcgauugccaaccaggcugucgugcugaugggacucgacaagggcuggccuaucuccaagauggaucugggggucccgcugcucgcccuuggaugcuacucucaagugaauccccugacacugaccgcugccguucuccugcuugugacacauuaugccaucauuggcccugggcugcaggcgaaagcuacccgggaagcccagaagagaaccgcugccggaaucaugaaaaaccccacagucgacggcauuaugacgaucgaucucgacccugugauuuacgauagcaaguuugagaaacagcugggccaaguuaugcugcucgugcuuugugccguccagcugcugcucaugcgcaccuccugggcuuucugcgaggcccugacacuugcgaccgggcccaucacaacccugugggaaggaucuccuggcaaguuuuggaauacgacaaucgccgugagcauggcuaacauuuuccggggguccuaucucgccggagcuggccuggccuuuagcaucaugaagucuguggggaccggaaaaagaggcaccggcucccagggggagacacugggagaaaaguggaaaaagaaacucaaucagcuuagccgcaaggaguucgaccuguacaaaaaguccggcauuaccgaaguugaucggacagaggcgaaggaggggcugaaaagaggagaaaucacgcaccaugccgucucucggggcagcgcuaagcuccaaugguuuguggagcgcaacauggugauuccggaagggagagucaucgaccugggauguggccggggcgggugguccuauuacugcgccggacuuaaaaagguuaccgaggugcgcggcuauacaaaagggggacccggccacgaagaaccugugcccaugucuaccuacggguggaauauugucaagcugaugagcggaaaggauguguucuaccucccucccgagaaaugugacacacugcugugcgauaucggcgaauccagcccgucuccuaccguugaggaauccagaacgauccgggugcucaagauggucgagcccuggcuuaaaaacaaucaguucuguauuaaggugcugaaccccuauaugccugcuguuaucgagcaucuggaacgccuccagagaaaacacggcgggaugcuggugcggaauccccuuagccgcaacucuacccacgagauguacuggauuuccaauggaacaggcaacaucgucagcucugugaauauggugagcagacugcuccugaaccgguuuaccaugacauauagacgcccuaccauugaaaaggacgucgaccugggggccggaacacggcauguuaacgcugagccggaaacccccaauauggaugugaucggcgagagaauccgccggauuaaggaggaacacuccucuacguggcauuacgacgaugagaacccuuauaaaacaugggccuaccacgggagcuaugaagugaaggcgaccggauccgccagcuccaugaucaauggcgucgugaaacuccugaccaagcccugggacguugugccuacagucacgcagauggcuaugaccgauacaacccccuucggccaacagagaguguuuaaagagaagguugacacacgcaccccgaagccuaugcccgggacacggaaagugauggaaauuaccgccgaguggcuuuggagaacgcugggacgcaacaagcggccuagacucugcacccgcgaggaguucaccaaaaagguccggaccaaugcugccaugggcgccguguuuacagaggaaaaccagugggauucugcgaaagcugccguugaggacgaagaguucuggaagcugguggauagagagcgcgaacuucacaaacuggggaaguguggaagcugcgucuacaauaugaugggcaagagagagaaaaagcucggggaauuuggcaaagccaagggaucccgggcuaucugguacauguggcugggcgcccgcuaucuggaguucgaggcucucggguuucugaacgaagaccauugguucucuagagagaauagcuacuccggaguggaaggcgaggggcuucacaaacugggauauauucuccgggauaucucuaagauccccggcggggccauguacgcggacgacaccgccggcugggauacgagaauuacagaagacgaucugcauaacgaggagaagaucacccaacagauggacccugaacaccggcagcuugcuaaugccauuuuuaaacugacauaucagaacaaggucgugaaaguucaacgccccaccccgaagggaacggugauggauaucauuagcagaaaagaccagcggggcuccgggcaggucggaaccuacggccucaauacauucaccaacauggaggcucagcugauccgccaaauggaaggggagggagugcugagcaagacagaucucgaaaauccucaucugcuugagaagaaaaucacccaguggcuggagacaaagggcguggaaagacucaaacggauggccauuucuggggacgauugcguugugaagcccaucgacgaucgcuuugcgaacgcccugcuugcucugaacgacaugggcaaagucagaaaggauauuccccaguggcagccuuccaagggauggcacgacuggcaacaggugccguucuguagccaccauuuccacgagcucaucaugaaagacggccggaagcugguugugcccugccgcccucaggaugaacugauugggagagcccggaucucucagggagcuggcuggucccucaaagagaccgccugucuggggaaggcuuaugcccaaaugugggcgcuuauguacuuucaucgcagagaccugcggcucgccagcaaugcuauuugcucugccguccccgugcacugggucccuacgucccgcacaaccuggagcauccacgcccaucaccaguggaugaccacagaagauaugcugaucguguggaacagaguuuggauugaggacaaucccuggauggaggauaaaaccccugugacaacgugggaagacguccccuaccuuggaaagcgggaggaucagugguguggcucccugaucgggcucaccagcagagcuacaugggcccaaaacauucugaccgcgauccaacaggugcgcucucugauuggcaaugaagaguuccucgacuauaugccgagcaugaagcgguuuagaaaagaggaagaguccgaaggagcuaucugguga

SEQ ID NO: 20930 - RNA, 9873 nt, Artificial Sequence
  derived and/or modified CDS sequence (opt5) from DENV-3__HQ332170__SS-prME
acaagccucugccucaugaugauccugcccgccgcucuugccuuccaccugacaucccgggacggcgaaccucggaugauuguggggaagaacgaacgcggaaagucucuccuguuuaagacggcgagcggcaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggcgaacaccggcgggacaagcgcucuguggcccuggcuccucaugucgggaugggacuggauacccggacacagaccuggaugagcgccgagggcgcuuggagacagguggaaaaaguugagacaugggcccuccgccaccccggcuucaccauccuggcgcuuuuucuggcccauuacaucgggacgucccucacacagaagguggucauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacaacuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucaaugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuaccacagaggcuauccugcccgaauauggcacccuggggcucgagugcuccccucgcacgggacuggacuucaaugagaugauucuucugaccaugaaaaacaaggccuggaugguccauagacagugguuuuucgaucucccccugccguggacaagcggcgccaccacagaaaccccuacguggaaucggaaagagcuucuggugacauuuaagaacgcucacgcgaaaaagcaagaagucgugguucucgggucucaggagggagccaugcacaccgcucugacaggcgccaccgaaauccaaaauuccgggggcaccagcauuuucgccggacaucugaagugucgccucaaaauggacaagcuggagcuuaaaggcaugucuuacgcuaugugcacaaacacguuugugcugaagaaagaggucuccgaaacccagcacgggacaauccucaucaagguggauuacaagggagaggacguucccuguaaaauuccuuucagcaccgaagauggccaagggaaggcccauaacggaagacugaucacagcgaaucccguggucaccaaaaaggaggagcccgugaacauugaagcugagccuccguucggcgaauccaauaucgugauugggaucggcgacaacgcccugaaaaucaauugguauaagaagggaucuagcauuggcaaaauguuugaggccacggcuagaggggccagacgcauggcuauccuuggagauacagccugggacuucggcuccguugggggaguccucaacagccugggcaagauggugcaccagauuuuugggucugcguacaccgcccuguucuccggcgugagcugggucaugaaaaucggaauuggcgugcuccugaccuggaucgggcuuaauucuaagaacacaagcauguccuuuucuugcauugcuaucggaaucauuacccuguaucucggcgccguugugcaggcugauacagggugugucaucaauuggaaaggaaaggaacugaagugcggcagcgggauuuucgugacgaacgagguucauaccuggacagagcaguacaaauuucaagccgacucccccaagcggcuggcgaccgccaucgcuggcgccugggaaaauggaguguguggcauuagaagcacaacccgcauggagaaccuucucuggaaacagaucgcuaaugaacugaacuauauccugugggagaauaacauuaagcucacggucgugguuggggauaucauuggagugcuggaacagggcaaacggacccuuacaccucagcccauggagcugaaguacucuuggaaaaccugggggaaggccaagaucgucacagccgagacccaaaacuccagcuucauuaucgacggaccuaauacacccgaaugcccgucugcuuccagagcguggaacgugugggagguggaagacuauggcuuuggcgucuucaccacgaauaucuggcucaaacugcgcgagguuuacacacagcagugugaucaccggcugaugagcgccgcugugaaggacgaaagagccgugcacgccgauaugggguacuggauugagucccagaaaaacggaucuuggaaacuugagaaagcuagccucaucgaagucaagaccugcaccuggccuaagucccauacacuguggucuaauggcgugcuggagagcgacaugauuauccccaaaucccucgccgggccuauuagccaacacaacuaucgccccggauaccauacccagacggcgggcccuuggcaccuggggaaacuugaacuggauuuuaauuauugcgagggaacaaccguugugaucacagagaacuguggcacccggggccccucucucagaacaaccacggucuccgggaaacugauccacgaauggugcugucgcagcugcacccugccgccucuucgguacaugggagaggacggcuguugguaugggauggaaauuagacccaucucugagaaggaagagaauauggugaaaucccucguuagcgcuggaucuggcgagguggauaacuucacaauggggguccugugccuggccauucucuuugaagaggugaugcggggaaaguucggcaagaaacauaugaucgccggcguuuucuuuaccuucgugcugcuucugagcgggcagauuacauggcgcgacauggcucacacccucaucaugauuggauccaaugccagcgauagaaugggcaugggggucacguaccuggcgcugaucgcuacauuuaagauccaacccuuccuugcccugggauuuuuccuccggaaacugaccucuagagaaaaccuccugcuuggcguggggcuggccauggcuacaacccuccagcugccugaggacauugaacagauggccaauggaaucgcucugggccuuauggcccugaagcucauuacccaguuugagacauaucaacuguggacggcgcucaucucccugaccuguagcaacacaauuuucacccuuacaguggccuggcgcaccgcuacgcugauccucgccggcgucucccugcugccgguuugccagucuagcuccaugcggaaaacagauuggcuucccaugaccguggcugccaugggggugccuccccugccucucuuuaucuucucucugaaggacacccucaagagacgcagcuggccccugaaugagggagucauggccgugggccuuguuuccauucuggcuucuagccugcucagaaacgaugugccuauggcggggccccuggucgccggaggccuucugaucgcuuguuacgugauuacagggaccuccgccgaccucacaguugaaaaagccgcugacgugacgugggaggaagaggccgaacagaccggagucagccauaaccugaugaucacaguggaugacgauggcaccaugcggauuaaggacgaugagacagagaauauccucaccguccugcuuaaaacggcgcugcugaucgugucuggcauuuuuccguacuccaucccugcuacccuccugguuuggcacacauggcagaagcaaacccagcgcagcggggugcuuugggacguccccucuccucccgaaacacagaaagccgagcuggaagagggaguguauagaauuaagcagcaaggcaucuucgggaaaacccagguuggagugggcguccagaaggaggggguguuucauacaauguggcacgugacgcggggagccguucucaccuacaacggcaagcgccuggaaccgaauugggcuuccgucaaaaaggaucucauuagcuauggcgggggauggagacugucugcccaauggcagaaaggcgaggaaguccaggugaucgcggucgagccugggaagaaccccaaaaauuuccagacaaugccuggaaccuuccaaaccacaacgggcgaaauuggggcuaucgcccuugacuuuaagcccggaaccuccggcagccccaucauuaaccgggagggcaaggugguugggcuguacggaaauggcguggucaccaagaacgggggauauguguccggcaucgcccagaccaaugcugagccugaugggccgacacccgaacuggaggaagagauguucaagaaacgcaaccucaccauuauggaccugcacccuggcagcggaaagacgagaaaauaccuucccgccaucguucgggaagcuauuaagcgcagacugcggacacucauccuggccccuaccagaguggucgcggccgagauggaggaagcucucaagggccugcccauccgcuaucagaccacagccaccaaaucugagcauacagggcgggaaauuguggaucuuaugugccacgcuaccuuuacgaugagacugcugagcccuguucgcgugccgaauuacaaccucaucauuauggacgaggcccauuucacagaucccgccuccaucgcugcgcggggauacauuucuaccagagucggcaugggggaagccgcugccaucuuuaugacagccaccccucccggaacggcugacgccuucccucagagcaaugcgcccauccaagacgaggagcgcgauauuccggaacgguccuggaacucuggcaaugaguggaucaccgacuuugcugggaagacagugugguucgugccuagcauuaaagccggcaacgauaucgccaacugucugagaaagaauggcaaaaaggucauucagcuuucccgcaagaccuuugacacagaauaucagaaaaccaagcugaacgauugggacuucguugugacaaccgauaucucugagaugggagcuaauuuuaaagccgaccgggugauugaucccagacggugccucaagcccgucauccugacggacgggccugagcgcgugauccuggcgggacccaugccuguuacagccgcuagcgccgcucagagacggggccgcguggggagaaacccgcaaaaagaaaaugaucaguacauuuucaccggacagccccucaacaaugacgaggaccacgcccauuggaccgaagcuaagaugcuucuggauaacaucaauacaccugagggcauuauccccgcccuguucgaaccugagcgggagaaguccgcggccauugacggggaauauagacucaaaggcgagagccgcaagaccuuugucgaacugaugcggagaggagaucuucccguguggcuggcucacaaaguugccucugagggcaucaaguacacagaccgcaaauggugcuucgaugggcagcggaacaaucaaauccucgaagagaacauggacguggagauuuggacgaaggaaggagagaaaaagaagcugagaccgcgcuggcuggaugcucggaccuauuccgacccucucgcccuuaaagaauuuaaggauuucgccgcuggcagaaaaagcaucgcgcuggaccuggucacagagauugggcgcgugcccucucaccucgcccauagaacccggaaugcucuggauaaccuugucaugcugcacacauccgaacauggaggcaaggccuaccgccacgccguggaggagcucccugaaaccauggagacgcugcugcuccuuggccugaugauccugcucaccgggggagcuaugcuguuucuuauuagcggcaaagggaucggaaagacauccaucggccugauuuguguuaucgccucuagcgggaugcucuggauggcggaaauuccccugcaguggaucgccuccgcuauugugcuggaguucuuuaugauggugcuccuuaucccugagcccgaaaagcagagaaccccgcaagacaaucagcuggccuaugucguuauuggaauccugacacucgcugccaucauugcggccaacgagaugggccugcuugaaaccacgaaacgggaucugggcaugagcaaggagccugggguggugucucccacauccuaccucgacgucgaccugcaccccgcuagcgccuggacccuguacgcuguggccacaaccguuaucaccccuaugcuccgccauacaauugaaaauucuacggcuaacgugagccuugccgcgaucgccaaccaggcugucgugcugaugggacuggauaaaggcuggccgauuuccaagauggaccucggggucccccugcuugcccugggaugcuauucucaggugaauccucucacccugacagcugccguucugcuccuuaucacccacuacgccaucauuggccccgggcugcaagcgaaagcuacaagagaggcccagaagcggaccgcugccggaaucaugaagaacccuacgguggauggcauuaugacaaucgaccuggaucccgucauuuaugacagcaaauucgagaagcagcucggccaggugaugcugcuuguucugugugccgugcaacuccugcugaugagaaccuccugggcucucugcgaagcccuuacccuggcgacagggccuaucaccacacugugggagggaucuccgggcaaauuuuggaauacgaccaucgccgucagcauggcuaacauuuuccgcggguccuaccucgccggagcuggccuggccuuuagcaucaugaagucuguggggacaggaaaacggggcaccggcucccagggggaaacacuuggagagaaguggaagaaaaagcugaaucagcucagcagaaaagaguucgaucuguauaagaaauccggcauuaccgagguggaccgcacggaggcgaaggaagggcugaaacggggagagaucacccaucacgccguuucuagaggcagcgcuaagcuccagugguuugucgaacgguccauggugauucccgaggggcgcgugaucgaucuuggauguggcagaggcggguggucuuacuauugcgccggacugaagaaagucacagaaguucggggcuacaccaaagggggaccuggccaugaggagcccgugccuaugagcacauacggguggaacauugugaaacugauguccggaaaggacgucuucuaucugcccccggaaaaaugugauacccugcuuugcgacaucggcgagagcucuccuucccccacaguggaagagagccgcaccaucagaguucugaagaugguggagcccuggcucaagaauaaccaauucuguauuaaaguccugaauccuuacaugcccacggugaucgaacaccuggagcggcuccagcgcaagcacggcgggaugcuuguuagaaacccucugucuagaaauuccacacaugaaauguauuggauuagcaacggaaccggcaauaucguggcuucugucaacauggugagccgccugcuccugaauagauuuaccaugacacaccggagaccgacgauugagaaagauguggaccuuggggccggaacccgccaugucaacgcugaacccgagacaccuaacauggacguuaucggcgagcggaucaagagaauuaaagaagaacacaauuccaccuggcacuacgaugacgaaaaccccuauaagacaugggccuaccaugggucuuaugaggugaaggcgaccggaagcgccuccagcaugaucaauggcguggucaaacugcucacaaagccuugggaugugguucccauggugacccagauggcuaugacggacaccacaccguucggccaacagcgcgucuuuaaagaaaagguggauacccggacaccuagauccaugcccgggacccgccggguuaugggaauuacggccgaguggcuguggagaacacugggccgcaacaaaaagccucggcucugcaccagagaggaguucacaaagaaagugcgcaccaaugcugccaugggggccgucuuuacggaggaaaaccagugggacucugcgaaggcugccguggaggaugaagacuucuggaaacugguugaucgggagagagagcuucacaagcugggaaaauguggcagcugcguguacaauaugauggggaagcgcgagaagaagcucggcgaguuuggaaaggccaaaggcuccagagcuaucugguacauguggcugggggcccgguaucuugaguucgaggcucugggauuucucaacgaggaccauugguucucucgcgaaaauagcuacuccggcgucgagggggaaggacugcacaagcugggcuauauucucagagauaucucuaaaauccccgggggcgccauguacgcggacgacaccgccggaugggauacacggauuaccgaggacgaucugcauaacgaagagaagaucacacagcaaauggacccugagcacaaacagcuugcuaaugccauuuuuaagcugaccuaucagaacaagguggucaaagugcagagacccacaccgaccggcacgguuauggauaucauuagccggaaggaccaacgcggguccggacaggugggcacauacgggcucaauaccuucaccaacauggaagcucagcugaucagacagauggagggagaaggcguccuuagcaaagccgaucuggagaauccucaccuccccgaaaagaaaaucacacaauggcuggagaccaaggggguggagcggcugaagcgcauggcgauuucuggcgacgauugcgugguuaaacccaucgacgauagauuugccaacgcucuccuggcccuuaacgacaugggaaaggugcggaaagauauuccucaguggcagccguccaagggcuggcaugacuggcagcaaguccccuucuguagccaccauuuccacgaacugaucaugaaagacgggcgcaagcucgugguuccuugcagaccccaggaugagcugauuggacgggcucgcaucucucagggcgccggguggucccuuagagaaacagcuugucugggaaaggccuaugcgcaaauguggagccucauguacuuucaccggcgcgaccugagacuggccucuaaugcuauuugcuccgccgugccuguccauugggugcccacgagccggaccacaugguccauccacgcccaucaccaguggaugaccacagaggauaugcucaccgucuggaaccgcguguggaucgaagacaauccuuggauggaggauaaaacgcccguuaccacaugggagaacgugccguaccugggcaagagagaagaccaguggugugggagccuuauuggccugaccucucgggcuacaugggcccagaauaucccuaccgcgauucaacaggucagaagccucaucggaaacgaggaguuccuggauuauaugcccuccaugaaacgcuuucggaaggaggaggaaucugagggcgcuauuugguga

SEQ ID NO: 20931 - RNA, 9873 nt, Artificial Sequence
  derived and/or modified CDS sequence (opt5) from DENV-3__AY858038__SS-prME
accagccugugccucaugaugaugcugcccgccacccuugcuuuccaccugacgucccgggacggagagccucggaugaucguggggaagaacgaaagaggaaagucucuccuguuuaagaccgccagcggcauuaauauguguacacuuaucgcgauggaucugggggagaugugcgacgauaccgucacauacaaauguccgcucauuaccgaaguugagcccgaagacaucgauugcugguguaaccugacauccaccugggugacguauggaaccugcaaucaggcuggcgagcacagacgggacaagcgcucuguggcccuggccccucacgucgggaugggacucgauacaagaacccagacauggaugagcgcugagggcgccuggagacagguggaaaaaguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccaacuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaaguugugcagcacgaaaaucucaaguauaccgucauuaucacagugcauacgggggaccagcaccagguuggaaacgagacccaaggcgugacagccgaaaucacaccccaggcuuccacagucgaggccauucugccugaauacggcacccuggggcucgagugcagcccccgcacgggacuggacuuuaaugagaugauccuucugaccaugaaaaacaaggcuuggauggugcauagacagugguucuuugaucucccucugcccuggacaucuggcgccaccacagaaaccccgacguggaauaaaaaggagcuucuggucacauucaaaaacgcccacgcuaagaagcaagaagugguugugcucgggucccaggagggagcgaugcacaccgcccugacaggcgcuaccgaaauucagaccagcgggggcacaucuaucuuugccggacaucugaaaugucggcucaagauggacaaacuggagcuuaagggcauguccuaugccaugugccugaaugcuuucguccucaaaaaggaggugagcgaaacgcagcacgggaccauucugaucaagguugaguacaaaggagaagaugccccuuguaagauccccuucuccacagaggacggccaagggaaagcgcauaacggacgccugauuaccgcuaacccuguggucacaaagaaagaggaacccgugaauaucgaggccgaacccccuuuuggcgagucuaacauugugaucgggauuggcgauaaggcccuuaagaucaauugguacaaaaagggaagcuccaucggcaaaauguucgaagcuaccgccagaggggcucggagaauggccauucucggagacacggcgugggauuuuggcagcguugggggaguccugaacucucugggcaagauggugcaccagaucuucggguccgccuauacagcucucuuuagcggcgugucuuggauuaugaaaaucggaauuggcguccugcuuaccuggaucgggcugaauagcaagaacaccuccaugucuuucagcugcauugccaucggaaucauuacacucuaccugggcgcugugguucaggccgacauggggugugugaucaauuggaagggaaaagagcugaagugcggcuccgggauuuuugucaccaacgaggugcauacauggacggaacaguauaaauuccaagcggauagcccgaagcgccuugccaccgcuaucgccggcgcuugggagaauggaguuuguggcauucggucuacaaccagaauggaaaaccuccuguggaaacagaucgccaaugagcugaacuacauccucugggaaaauaacauucgccugacaguggucgugggggacaccaucggaguucuucagcagggcaagcggacgcugcccccucaacccauggagcucaaauauuccuggaagaccugggggaaggccaaaauugugacagcuaagacccagaauagcucuuuuaucauugauggaccuaacacacccgaguggccguccgcgagcagagccuggaacgucugggaaguggaggacuacggcuucggcguguuuaccacaaauaucuggcugaaacugcgcgaaauguauacccagcuuugcgaccaccggcucauguccgcugccgucaaggaugagagagccguucacgcugacaugggguacuggaucgaaucucagaaaaacggaagcuggaagcuggagaaggccucccugauugaggugaaaacguguacauggccuaagucucauacccucuggagcaauggcgugcuggaauccgauaugaucauucccaaaagccuugcggggccuaucucucaacacaacuaccgccccggauaucauacccagacagcuggcccuuggcaccuggggaagcucgagcuggacuucaauuacugcgaaggaaccacggucgugauuacagagaacugcggcacccggggccccucccugagaacaaccacaguuagcgggaaacuuauccacgagugguguugccgcucuuguacccucccgccucugcgguauaugggagaagauggcugcugguacgggauggagaucagacccauuaaugaaaaggaggaaaacauggugaagucccuggucagcgccggaucuggcaaaguggacaauuuuacgauggggguucucugucuggccauccuuuucgaggaggugaugcggggaaaguucggcaaaaagcauaugauugcuggcguccuguuuaccuucgugcuccugcugagcgggcagaucacauggcgcgauauggccagaacccuuauuaugaucggauccaacgcgagcgaccggaugggcauggggguuacauaucuggcucucauugccaccuuuaaaauccaacccuuccuggcccucggauuuuuccugagaaaacuuacgucucgcgaaaaucugcuccugggcguggggcuggcuauggccacaacccuucagcugccugaggauaucgaacagauggcuaacggaauugcccucggccugauggcgcucaagcuggucacacaguuugagaccuaccaacuuuggaccgcccuggugucccucaugugcagcaauacaaucuucacgcugaccguggcuuggcggacagccacccugauucuugcuggcaucucccugcucccggucugucagucuagcuccaugagaaaaacagacuggcugcccaugaccguugccgccaugggggugccuccccucccucuguuuauuuucucucuuaaggauacgcugaaacgcagaagcuggccccugaacgaaggagugauggcugucggccucguguccauccuggcgucuagccuucugcggaaugacguuccuauggccgggccccucguggcuggaggccugcucaucgccugcuaugucauuacagggaccuccgccgaucugaccguggagaaggcugccgacguuaucugggaggaagaggcggaacagacaggagugagccacaaccuuaugauuaccgucgacgaugacggcacaaugcgcaucaaagaugacgagacggaaaacauucugaccgugcugcucaagacagcucugcuuaucgucucuggcaucuuuccguacuccauuccugccacccugcucguguggcauacauggcagaaacaaacccagagaagcgggguucugugggaugugcccucuccucccgagacgcagaaggccgagcucgaagagggagucuaccggaucaagcagcaaggcauuuucgggaaaacccaggugggaguuggcgugcagaaggaaggggucuuucacacaauguggcaugugacccgcggagcugugcugacacacaauggcaaaagacuugagccgaacugggccuccguuaagaaagaccugaucagcuauggcgggggauggcggcugucugcgcaauggcagaagggcgaggaaguccaggugauugcuguggagccugggaagaaucccaaaaacuuccagaccaugccuggaaucuuccaaacaacgaccggcgaaauuggggccaucgcccucgauuuuaagcccggaacauccggcagccccaucauuaaucgcgagggcaaagucguggggcuguacggaaacggcguugugaccaagaaugggggauaugucuccggcaucgcucagaccaacgccgaaccugacgggccgacacccgagcuugaggaagagauguucaaaaagagaaaucugacgauuauggaucuccacccuggcagcggaaagacccggaaauaccugcccgcuaucauucgcgaagccaucaagagacggcucagaacacugauccuugcgccuacccgcgugguugccgcugagauggaagaggcccugaaaggccugcccauucgguaucagacaaccgcuacgaagucugagcauacagggaaagaaaucguggaccucaugugucacgccaccuuuaccaugagacugcuuagcccuguccgcgugccgaacuacaaucugauuaucauggaugaggcccauuucacagaccccgcuuccauugcggcccggggauauaucucuaccagaguuggcaugggggaagcugccgccaucuuuaugacagcuaccccucccggaacggccgaugcguucccucagagcaacgcucccauucaagacgaggaacgcgacaucccggagcgguccuggaacucuggcaacgauuggauuacagacuuugccgggaagaccgugugguucgucccuagcaucaaggccggcaaugauauugcuaacugccuccgcaagaauggaaagaaagugauccagcugucccgcaagacauuugacaccgaguaccagcggacgaaacugaaugauugggacuucguggucaccacagauauuucugaaaugggcgccaacuuuaaggcggacagaguuaucgauccccggcgcugucucaagcccgugauccuuaccgacgggccugagagagugauucuggccggacccaugccugucacaguggcuagcgccgcucagcggcgcggcagaguugggcggaauccgcaaaaagaaaacgaucaguacaucuucaccggacagccccugaauaacgacgaggaccacgcccauuggacagaggcuaagaugcuccuggauaauauuaacaccccugaaggcaucauucccgcccuuuucgagccugaaagagagaaauccgcggccaucgacggggaauaucgccugaagggcgagagccggaaaacguuuguggagcucaugagacgcggagaucugcccgucuggcuggcucacaagguggccucugaaggcaucaaauacacagaccggaaguggugcuucgauggggagagaaauaaccagauucucgaagagaauauggacguugaaaucuggaccaaggagggagagaaaaagaaacuucgcccgcgguggcuggaugcuagaaccuauuccgacccucuggcccucaaggaauuuaaagauuucgccgcuggccgcaagagcauugcgcuggaccuugugacagagaucgggagaguccccucucaccuggcccaucggacccgcaacgcucucgauaaucuggugaugcugcacacauccgaacauggaggcagagccuaccggcacgccgucgaggaacucccugagacgauggagacccuucugcugcucggccugaugauucuucugacagggggagcuaugcucuuucugaucagcggcaaggggaucggaaaaaccuccauuggccugaucugcgugguugccucuagcgggaugcucuggauggcggacgugccccuucaauggauugccuccgcuaucgugcuggaguucuuuaugaugguccugcucauuccugagcccgaaaagcagcgcacaccgcaggauaaccaacuggccuauguugugaucggcauucuuacccuggcugccaucguggcggccaaugagaugggccuccuggagacgaccaaaagagaccugggcaugagcaaggaaccuggggucgugucucccacauccuaccucgacguugaucuucaccccgcuagcgccuggacccuguaugcuguggccacaaccgucaucacgccuaugcugcggcauacaauugagaacucuaccgcuaaugugagccucgccgcgaucgccaaccaggcugucgugcugaugggacuugacaaaggcuggccgauuuccaagauggaucuggggguuccccuccuggcccugggauguuacucucaggugaacccucucacacuuaccgcugccguccugcugcucgugacccacuacgccaucauuggccccgggcugcaggcgaaggcuacaagagaagcccaaaaacgcacggcugccggaaucaugaagaauccuaccguugacggcaucaugacaauugaucuugaccccgugaucuaugauagcaaauucgagaagcagcugggccaggucaugcuccuggugcugugcgccgugcagcuccuucugaugcggaccuccugggcuuuuugugaagcccugacacucgcgaccgggccuauuacgacacugugggagggaucuccgggcaaauucuggaacaccaccaucgccguuagcauggcuaauauuuuuagaggguccuaccuugccggagcuggccuggccuucagcaucaugaagucugucgggacaggaaagcgcggcaccggcucccaaggggagacacucggagaaaaauggaagaaaaagcugaaccagcugagccggaaagaguuugaccucuauaagaaauccggcaucacggaaguggauagaaccgaggcgaaggaagggcuuaagcggggagagauuacacaucacgccgugucucgcggcagcgcuaaacugcagugguucgucgagagaaauaugguuauccccgaagggcgggugauugaccugggaugcggccgcggcgggugguccuacuauugugccggacucaagaaagugaccgaggucagaggcuacacaaaagggggaccuggccaugaagaacccgugccuaugucuaccuauggguggaacaucguuaaacugaugagcggaaaggauguguucuaccuucccccggaaaagugcgacacgcugcucugugauauuggcgaguccagcccuucucccaccgucgaggaaucccggacaauccgcgugcugaaaaugguugagcccuggcugaagaauaaccaguuuugcauuaaagugcucaauccuuacaugcccaccgucaucgaacaccuugagagacugcaacggaagcacggcgggaugcuggugcgcaacccucucagcagaaauucuacacaugagauguauuggaucuccaacggaaccggcaauauugugagcucugucaacaugguuagccggcugcuucugaauagauucacaaugacccaccgccggccgacgaucgaaaaagacguggaccucggggcuggaacaagacaugugaacgccgagcccgaaaccccuaacauggaugucauuggcgagcgcauccggagaauuaaggaagaacacuccucuaccuggcacuacgacgaugagaaucccuauaagacaugggcuuaccaugggagcuaugaagugaaagccacgggauccgcgagcuccaugaucaacggcguugugaagcugcugaccaaaccuugggacgucgugcccacaguuacccagauggccaugacagauaccacaccguuuggccagcaacgcguguucaaggagaaagucgacacccggacgccuagacccaugccugggacccgcaaggugauggaaaucacagcugaguggcucuggcggacccugggaagaaauaagcgcccccggcuuuguacaagagaagaguuuaccaaaaagguucgcacgaacgccgcuaugggcgccguguucacagaggaaaaucagugggauucugccagagcggcugucgaggacgaagaguuuuggaaacugguggaucgggaacgcgagcuccacaagcuggggaaaugcggaagcugugucuacaacaugaugggcaagagagagaagaaacuuggggaguucggcaaagccaaaggaucccgggccauuugguauauguggcugggcgcuagauaccucgaguuugaagcccugggguuccugaaugaggaccauugguuuucucgggagaacagcuacuccggaguggaaggcgaggggcuccacaagcugggauauauccuucgcgauauuucuaaaaucccuggcggggcuauguacgccgacgacaccgcgggcugggauacaagaauuaccgaagacgaucugcauaaugaggaaaagaucacgcagcagauggaccccgagcaccggcaacucgccaacgcuaucuucaaacugaccuaucagaauaagguugugaagguccagcgcccgacaccuaaaggaaccgugauggauauuaucagcagaaaggaccagcggggcuccgggcaagugggaacauacggccuuaacaccuuuacaaauauggaggcccagcugauucgccagauggaaggggagggaguucucagcaaagcugaucuggaaaacccccaucugcucgagaagaaaaucacccaguggcuggaaacgaagggcguggagagacuuaagcggauggccauuucuggggacgauugcgucgugaaacccaucgacgaucgcuucgcgaaugcccugcucgcucugaacgacaugggcaagguuagaaaagauaucccucaauggcagccguccaagggauggcaugacuggcaacaggugcccuucugcagccaccauuuucacgagcuuauuaugaaagacggccggaagcuggucgugccuugucgcccccaagaugaacucaucgggagagcccggauuucucagggagcuggcuggucccugaaggagacagccugccuggggaaggcuuaugcccagaugugggcgcucauguacuuccaccgcagagaccugcggcuugccagcaacgcuaucuguucugccgucccugugcauuggguucccaccuccagaaccacauggagcauucacgcccaucaccaauggaugaccacagaagauaugcugacgguguggaaucgcgucuggaucgaggacaacccuuggauggaagauaagacccccgugacaaccugggaggacguuccguaucucggaaaacgggaggaucaguggugcggcucccugauugggcuuacaagcagagcuaccugggcccagaauauccugacggcgauccagcaagugcgcucucucauuggcaacgaagaguuucuggacuacaugccuagcaugaagcgguucagaaaagaagaggaguccgaaggagcuaucugguga

SEQ ID NO: 20932 - RNA, 9873 nt, Artificial Sequence
  derived and/or modified CDS sequence (opt5) from DENV-3__AY858039__SS-prME
accucccugugccucaugaugaugcugcccgccacccuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgugacauacaaauguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagagcucaaaccuggaugagcgccgagggcgcuuggcggcaaguggaaaaaguugagacaugggccuuccgccaucccggcuuuaccauucuggcgcuuuuccuggcccacuacaucgggacgucccucacacagaagguggucaucuuuauucugcuuaugcuggugaccccuucuaugacaaugagauguguuggagugggcaaccgggacuucgucgaagggcucagcggagcuaccuggguggaugugguccuggagcauggcgggugcguuaccacaauggccaagaauaaacccacgcuggacaucgagcuccagaagaccgaagcuacacaacuggccacccuucgcaaacuguguauugagggaaagaucacaaacgugaccacggauuccagaugcccuacacagggcgaagcgauucucccggaggaacaggaccagaauuauguguguaaacacaccuacgucgaucggggcugggggaacggaugcggccuguuugggaagggaagccuugugaccugcgccaaguuccaaugucuggagcucaucgagggcaaaguugugcagcacgaaaaucugaaguauacagucauuaucaccgugcauacaggggaccagcaccagguuggaaacgagacgcaaggcgugaccgcugaaaucacaccccaggccucuaccgucgaggcuauucugccugaauacggcacacucgggcuggagugcucccccagaaccggacuugacuuuaaugagaugauccugcucacgaugaaaaacaaggccuggauggugcauagacagugguucuuugaucugccucuucccuggaccagcggcgccacaaccgaaacaccgaccuggaauaaaaaggagcugcucgucacguucaaaaacgcucacgcgaagaagcaagaagugguugugcuggggucucaggagggagccaugcacacagcucugaccggcgccacagaaauucagaccuccgggggcaccagcaucuuugccggacaucucaaaugucggcugaagauggacaaacuugagcugaagggcaugucuuaugcuaugugcuccaaugccuucguccucaaaaaggaggugagcgaaacacagcacgggacgauucugaucaagguugaguacaaaggagaagaugcgccuuguaagauccccuucuccaccgaggacggccaagggaaagcucauaacggacgccugauuacagccaacccuguggucaccaagaaagaggaacccgugaauaucgaggccgaacccccuuuuggcgagucuaacauuaucauugggaucggcgauaaggcucuuaagaucaauugguacaaaaagggaagcuccauuggcaaaauguucgaagccacagcuagaggggcccggagaauggcgauccucggagacaccgccugggauuuuggcagcgucggagggguucugaacucucugggcaagaugguccaccagauuuucggguccgcuuauacggcccucuuuagcggcgugucuuggaucaugaaaauuggaaucggcgugcugcuuacauggauugggcugaauagcaagaacaccuccaugucuuucagcugcaucgucaucggaauuaucacccucuaccugggcgcugugguucaggccgacauggggugugugauuaauuggaagggaaaagagcugaagugcggcuccgggaucuuugucacaaacgaggugcauaccuggacagaacaguauaaauuccaagcggauagcccgaagcgccuugccacggcuauugccggcgcuugggagaauggaguuuguggcauccggucuaccacaagaauggaaaaccuccuguggaaacagaucgccaaugagcugaacuacauucucugggaaaauaacaucaagcugaccguggucgugggggacauuaucggaguucuugagcagggcaaacgcacacugacaccccagccuauggagcucaaguauuccuggaagacgugggggaaagccaagauugugaccgcugaaauccaaaauagcucuuuuaucauugauggacccaacacaccugagugccccaacgcgucccgggccuggaaugucugggaaguggaggacuacggcuucggcguguuuaccacaaacaucuggcugaaacugagagaaauguauacccagcuuugugaccaccgccucaugagcgcugccgucaaggaugagcgggccguucacgcugacaugggguacuggauugagucccagaaaaauggaucuuggaagcuggaaaaggccagccugaucgaggugaaaacaugcaccuggccgaagucccauacgcucuggucuaacggcgugcuggaaagcgauaugauuaucccuaaaucccuugcggggcccaucagccagcacaauuacagaccuggauaucauacacaaaccgcuggccccuggcaccuggggaagcucgagcuggacuucaacuacugcgagggaaccacagucgugauuaccgaaaauuguggcacgcgcggcccuucucugcggacaaccacaguuuccgggaaacuuauccacgaguggugcuguagaagcugcacccugcccccgcugcgcuauaugggagaagauggcuguugguacgggauggagauucggccuaucaacgaaaaggaggagaauauggugaagucucuggucuccgccggaagcggcaaaguggacaacuuuacaauggggguucucugccuggccauucuuuucgaagaggugaugagaggaaaguucggcaaaaagcauaugaucgcuggcguccuguuuauuuucgugcuccugcugucugggcagaucaccuggcgggauauggcccgcacgcuuaucaugauuggaagcaaugcguccgacagaaugggcauggggguuaccuaucuggcucucaucgccacauuuaaaauucagcccuuccuggcccucggauuuuuccugcggaaacuuaccagcagagaaaaccugcuccugggcguggggcuggcuauggccacaacccuucaacugcccgaggauaucgaacagauggcuaauggaauugcccucggccugauggcgcucaagcugaucacgcaguuugagacauaccagcuuuggaccgcccuggucucucucacauguuccaacaccaucuucacccugacaguggcuuggcgcacggccacccugauucuugcuggcaucagccugcucccugugugccaauccucuagcaugcggaaaacagacuggcugccgaugaccgucgccgccauggggguucccccuagcccccucuuuauuuucucucugaaggauacacuuaaaagacgcagcuggccucugaaugagggagugauggcugugggccuggucuccauccucgcgucuagccugcuuagaaacgacgugcccauggccgggccucugguugcuggaggccuccugauugccuguuaugugaucaccgggacguccgccgaucucacagucgaaaaggcugccgacgugaccugggaggaagaggcggaacagaccggaguuagccacaaccugaugaucacaguggacgaugacggcaccaugcggauuaaagaugacgagacagagaauauccuuacgguccugcugaagaccgcucuccugauugugucuggcaucuuucccuacuccauuccggccacacuucuggucuggcauaccuggcagaaacagacacaacgcagcggggugcucugggauguuccuucucccccugaaacccagaaggccgagcuggaagagggaguguacagaaucaagcagcggggcauuuucgggaaaacgcaggucggagugggcguucaaaaggaggggguguuucacaccauguggcaugucacacgcggagcugugcucaccuauaacggcaaaagacuggaacccaauugggccuccgugaagaaagaccuuaucagcuacggcgggggauggcggcugucugcgcaguggcagaagggcgaggaaguucaagucaucgcuguggagccggggaagaacccuaaaaauuuccagacaaugcccggaauuuuccagaccacaacgggcgaaaucggggccauugcccuggauuuuaagccuggaaccuccggcagccccaucauuaaccgcgagggcaaaguggucgggcucuauggaaauggcgugguuacaaagaacgggggauacguguccggcaucgcucagaccaaugccgagcccgacgggccuaccccggaacuggaggaagagauguucaaaaagagaaaccuuacaaucauggaucugcaccccggcagcggaaagacgcggaaauaucucccugcuauuguccgcgaagccaucaagagacggcugagaacccucauucuggcgcccacacgcgugguugccgcugagauggaggaagcccuuaaaggccugccuauccgguaccaaaccacagcuaccaagucugagcacacggggaaagaaauuguggaccugaugugccaugccacauuuaccaugagacuccugagccccguccgcgugccuaauuauaaccuuaucaucauggaugaggcccacuucaccgacccggcuuccauugcggcccggggauacaucucuacaagaguuggcaugggggaagcugccgccauuuuuaugaccgcuacacccccuggaaccgccgaugcguucccccagagcaaugcuccuauccaggacgaggagcgcgacauucccgaacgguccuggaacucuggcaaugauuggaucacggacuuugccgggaagacagugugguucgucccgagcauuaaggccggcaacgauaucgcuaacugucugcgcaagaauggaaagaaagugauccagcucucccgcaagaccuuugacacagaguaccagaagaccaagcugaacgauugggacuucguggucacgaccgauauuucugaaaugggcgccaauuuuaaggcggaccggguuaucgauccuagacggugccugaaacccgugauucucacagacgggcccgagcgcgugauccuugccggaccuaugcccgucaccguggcuagcgccgcucagagacggggccgcguugggagaaacccucagaaggagaaugaucaguauauuuucacaggacaaccgcugaacaaugacgaagaccaugcccacuggaccgaggcuaaaaugcugcucgauaacaucaauacacccgaaggcaucauuccugcccuguucgagcccgaacgggagaaguccgcggccaucgacggggaguacagacuuaaaggcgaaagccgcaagaccuuuguggagcugaugcggagaggagaucucccugucuggcuggcucauaaaguggccucugaaggcauuaaguauacggaccgcaaguggugcuucgauggggagcggaacaaucagauccuggaagagaacauggacguugagauuuggacaaaagaaggagagaagaaaaagcucagaccccgcuggcuugaugcucggaccuacuccgacccgcuggcccugaaagaauuuaaggauuucgccgcuggcagaaagagcaucgcgcucgaccuggugaccgagaucgggcgcgucccuucucaccuugcccacagaacacggaaugcucuggauaaccucgugaugcugcauaccuccgaacacggaggccgcgccuauagacaugccgucgaggagcugcccgaaacaauggagacgcuccuucugcugggccucaugauucugcuuaccgggggagcuaugcuguuucucaucagcggcaaaggggugggaaagacauccauuggccugaucuguguuguggccucuagcgggaugcuguggauggcggacauuccucuccaguggaucgccuccgcuauugugcuugaguucuuuaugaugguccugcugauccccgagccugagaaacagcggacaccccaggauaaucagcucgccuacguugugaucgggauucucacacuugcugccaucguggcggccaacgaaaugggccugcucgagaccacgaagcgcgaccugggcaugagcaaagaaccgggggucgugucuccuaccuccuaucuggacguugaucuccaccccgcuagcgccuggacacuuuacgcuguggccaccacagucauuacccccaugcugagacacacgaucgaaaauucuacagcuaacgugagccuggccgcgauugccaaccaggcugucgugcucaugggacuggacaagggcuggccuaucuccaagauggaucuugggguuccgcugcucgcccugggaugcuacucucaagugaauccccugacccucacagcugccguccuucugcuggugacccauuaugccaucauuggcccugggcuccaggcgaaagcuacccgggaagcccagaagagaacagcugccggaaucaugaaaaaccccacgguugacggcauuaugaccaucgaucuggacccugugauuuacgauagcaaguucgagaaacagcuuggccaagucaugcugcucgugcugugugccgugcagcugcuccuuaugcgcacauccugggcuuuuugcgaggcccugacccuggcgacagggcccaucaccacgcucugggaaggaucuccuggcaaguucuggaauacaaccaucgccguuagcauggcuaacauuuuucggggguccuaucuggccggagcuggccuugccuucagcaucaugaagucugucgggaccggaaaaagaggcacaggcucccagggggagacccugggagaaaaguggaaaaagaaacucaaucagcugagccgcaaggaguuugaccuguacaaaaaguccggcauuacagaaguggaucggacggaggcgaaggaggggcucaaaagaggagaaaucacccaccaugccgugucucggggcagcgcuaaacuucaaugguucgucgagcgcaacaugguuauuccggaagggagagugaucgaccugggauguggccggggcgggugguccuauuacugcgccggacugaaaaaggugacagagguccgcggcuauaccaaagggggacccggccacgaagaaccugugcccaugucuacauacggguggaauauuguuaagcucaugagcggaaaggauguguucuaccugccucccgagaaaugugacacccuucugugcgauaucggcgaauccagcccgucuccuacggucgaggaauccagaaccauccgggugcucaagaugguugagcccuggcugaaaaacaaucaguuuuguauuaaggugcugaaccccuauaugccuacagucaucgagcaucucgaacgccuucagagaaaacacggcgggaugcuggugcggaauccccugagccgcaacucuacccacgagauguacuggauuuccaauggaacaggcaacaucgugagcucugucaauaugguuagcagacuccugcuuaaccgguucaccaugacauauagacgcccuaccauugaaaaggacguggaccugggggcuggaacgcggcaugugaacgccgagccggaaacacccaauauggaugucaucggcgagagaauccgccggauuaaggaggaacacuccucuaccuggcauuacgacgaugagaacccuuauaaaaccugggcuuaccacgggagcuaugaagugaaggccacaggauccgcgagcuccaugaucaauggcguugugaaacuccugacgaagcccugggacgucgugccuaccguuacacagauggccaugaccgauacaacccccuuuggccaacagagaguguucaaagagaaggucgacacacgcaccccgaagccuaugcccgggacgcggaaagugauggaaauuaccgcugaguggcuguggagaacacucggacgcaacaagcggccuagacugugcacccgcgaggaauuuaccaaaaagguucggaccaaugccgcuaugggcgccguguucacggaggaaaaccagugggauucugccagagcggcugucgaggacgaagaguuuuggaaacuuguggaucgcgagagagaacugcacaagcucgggaaauguggaagcugcgucuacaauaugaugggcaagcgggagaagaaacugggggaguucggcaaggccaaaggaucccgcgccaucugguacauguggcuuggcgcuagauaucuggaguuugaggcccucggguuccugaacgaagaccauugguuuucucgggagaauagcuacuccggaguggaaggcgaggggcugcacaagcucggauauauucugagagauaucucuaaaauccccggcggggcuauguacgccgacgacacagcgggcugggauacccggauuacagaagacgaucuucauaacgaggagaagaucacccaacagauggacccugaacaccgccagcuggccaaugcuauuuucaagcucacguaucagaacaaaguugugaagguccaaagacccaccccgaaaggaacagugauggauaucauuagccggaaggaccagcgcggcuccggacaggugggaaccuacggccugaauacauuuaccaacauggaggcccagcuuaucagacaaauggaaggggagggaguucugagcaaaacagaucucgaaaauccucaucugcuggagaagaagaucacccaguggcucgagacgaaaggcguggaacggcugaagcgcauggcuauuucuggggacgauugcgucgugaaacccaucgacgauagauucgccaacgcgcuucuggcccucaacgacaugggcaagguucggaaagauauuccccaguggcagccuuccaagggauggcacgacuggcaacaggugccguucuguagccaccauuuucacgagcugaucaugaaggacggccgcaaacuugucgugcccugcagaccucaggaugaacugauugggcgggcucgcaucucucagggagccggcuggucccucaaggagacagcuugucuggggaaagccuaugcucaaaugugggcccugauguacuuccauagacgggaccuccgccuggcgagcaaugccauuugcucugcuguccccgugcacuggguuccuaccuccagaaccacauggagcauccacgcccaucaccaguggaugaccacagaagauaugcuuacgguguggaaccgggucuggaucgaggacaaucccuggauggaggauaagaccccugugacaaccugggaagacguucccuaccugggaaaaagagaggaucagugguguggcucccucauugggcugacaagccgcgccaccugggcucaaaacauccuuacggccauucaacaggugcggucucugaucggcaaugaagaguuucucgacuauaugccgagcaugaagagauuccgcaaggaggaagaguccgaaggagcgauuugguga

SEQ ID NO: 20933 - RNA, 9873 nt, Artificial Sequence
  derived and/or modified CDS sequence (opt5) from DENV-3__JN368477__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauugcugaaguugagcccgaagacaucgauugcugguguaaccugaccuccacaugggugaccuauggaacgugcaaucaggccggcgagcauagacgggacaagcgcucuguggcccuggcuccucacgucgggaugggacucgauaccagaacacaaaccuggaugagcgccgagggcgcuuggcggcagguggaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaaguccaaacccacgcucgacaucgagcugcagaagaccgaagcuacacaacuugccacccugcgcaaacucuguauugagggaaagaucacaaauauuaccacggauagcagaugcccuacacagggcgaagcgacccugccggaggaacaggaccagaacuauguguguaaacacaccuacguggaucggggcugggggaauggaugcggccuuuucgggaagggaucucuggucacaugcgccaaguuucaaugucucgagcccaucgagggcaaagugguucaguaugaaaaccugaaguacaccgugauuaucacaguccacacgggggaccagcaucaggugggaaaugacacccaaggcguuacaguggagaucaccccucaggcuuccacagucgaagccgugcugcccgaguauggcacccucgggcuggaaugcagcccucgcacgggacuugauuucaacgagaugauucugcucaccaugaaaaauaaggcuuggaugguccacagacagugguuuuucgaccugccccuuccguggacaucuggcgccaccacagagaccccuacguggaaccggaaagaacugcucgugacauuuaagaaugcccaugcuaaaaagcaagagguugugguccuggggucccaggaaggagcgaugcacaccgcccugacaggcgcuaccgagauccagaacagcgggggcaccucuauuuucgccggacaccucaagugucgccugaaaauggauaagcuugaacugaaaggcauguccuacgccaugugccucaauacauuugugcugaagaaagagguuagcgagacgcagcaugggaccauccugauuaagguggaauacaagggagaggacgcucccuguaaaaucccuuucuccacagaagauggccaagggaaggcccacaacggaagacuuaucaccgcgaaccccgucgugacaaaaaaggaggagcccgugaauauugaagcugagccuccguucggcgaaucuaacaucguuauugggaucggcgacaaagcccucaagauuaauugguauaagaaaggaagcuccaucggcaagauguuugaggccaccgcucggggggccagacgcauggcuauccugggagauacggccugggacuucggcagcgucgggggagugcugaacucucucggcaaaauggugcaucagauuuuuggguccgcguacacagcccuguucagcggcgucucuuggaucaugaagauuggaaucggcgugcuucugaccuggauugggcucaauagcaaaaacaccuccaugucuuuuagcugcaucguuauuggaaucaucacacuguaucugggcgcugugguccaggccgauauggggugugugauuaauuggaagggaaaggaacuuaaaugcggcaacgggaucuucguuaccaaugaggugcacacauggacggagcaguacaaguuucaagcugacucccccaaacggcucgccaccgcgauugccggcgcuugggaaaacggagucuguggcaucagaagcacaacccgcauggagaaucugcuguggaagcagauugccaacgaacucaauuauauccugugggagaacaauaucaaacuuacagugguugugggggauauuaucggaguccuggaacagggcaagcggacccucacgccucagcccauggagcugaaauacucuuggaagaccugggggaaggcuaaaauugugacagccgagacccaaaacuccagcuucaucauugacggaccuaacacacccgaaugcccgucugccuccagagcuuggaaugugugggaggucgaagacuauggcuuuggcguuuucaccacaaacaucuggcugaagcuucgcgagguguacacccagagcugugaucaucggcucauguccgcggccaucaaagacgaaagagcugugcacgccgauaugggguacuggauugagucucagaagaauggaagcuggaaacuggagaaggccuccuuuaucgaagucaagacgugcacauggccuaaaucucacacccuguggagcaacggcgugcucgaguccgacaugauuauccccaagagccuggcugggccuauuucucagcauaaucaccgccccggauaucauacccaaacagccggcccuuggcaccuugggaaacuggaacucgauuucaacuacugcgagggaaccacgguugugaucgcggagaauuguggcacacggggccccucccugagaaccacaaccgucagcgggaagcugauccacgaauggugcugucgcucuugcacacuuccgccucuccgguauaugggagaggacggcuguugguacgggauggaaauuagacccaucaacgagaaagaagagaauauggugaagucccugguuagcgcuggaucuggcaagguggauaacuuuaccauggggguccugugccucgccauucuguucgaggaagugaugcggggaaaauucggcaagaaacauaugaucgccggcguucuuuuuacguucgugcugcuccugagcgggcagauuaccuggcgcgacauggcucacacacugaucaugauuggauccaaugccagcgauagaaugggcaugggggucacccaucuugcgcugaucgcuacauuuaagauccagcccuuccucgcccugggauuuuuccuccggaaacugaccucuagagagaaccuucugcucggcguggggcuggccauggcuacgacacugcaacuuccugaagacauugagcagauggccaauggaaucgcucugggccucaugacccugaagcucauuacacaguuugaaaccuaucagcuguggaccgcccuugugucccugacauguagcaacacgaucuucacccucacagucgcguggcgcaccgccacacugauucuggcuggcguuucccuucugccgcucugccaaucuagcuccaugcggaagaccgauuggcugcccaugacgguggccgcuaugggggugccuccccucccucuguuuaucuucucucuuaaagacacacccaagagacgcagcuggccucugaaugagggagucauggccgugggccugguuuccauccucgccucuagccugcuuagaaacgaugugcccauggcugggccgcuggucgcgggaggccuccugauugccuguuacgugaucaccgggaccuccgcugaccucacaguugagaaagccgccgacgugaccugggaagaggaagcugagcagacaggagucagccacaaccugaugauuacgguggaugacgauggcaccaugcggaucaaggacgaugaaacagagaauauucuuaccguccugcugaaaacagcccuccugaucgugucuggcaucuuuccuuauuccauucccgcgacccuucugguuuggcauacguggcagaagcagacccaacgcagcggggugcucugggacgucccuucucccccggagacacagaaagcugaacuggaggaaggaguguacagaaucaagcagcagggcauuuucgggaagacccaaguuggagugggcguccagaaagaggggguguuucacacaauguggcacgugacccggggagccguucucacacauaacggcaagcgccuggagccuaauugggccuccgucaaaaaggaucuuaucagcuacggcgggggauggagacugucugcucaguggcaaaaaggcgaagaggugcaggugauugccgucgaacccgggaagaacccuaagaauuuccagacgaugcccggaaucuuccagaccacaaccggcgagauuggggcgaucgcucuggacuuuaaacccggaaccuccggcagcccuaucauuaaccgggaaggcaaggugguugggcucuauggaaauggcguggucacaaaaaacgggggauacguguccggcaucgcccaaacgaaugccgagccggaugggcccaccccugagcuggaagaggaaauguucaagaaacgcaaccuuacaauuauggaccugcaccccggcagcggaaagaccagaaaguaucucccugcuaucguucgggaggccauuaaacgcagacugcggacacucauccuggcucccaccagaguggucgccgcggaaauggaggaggcccuuaagggccugccuauccgcuaccagacgacagcuaccaaaucugaacauaccgggcgggagauuguggaucugaugugccacgccacauuuaccaugagacuccugagcccgguucgcgugcccaauuauaaccuugucaucauggacgaagcucauuucacagauccugccuccauugccgcucggggauacaucucuaccagagugggcaugggggaggcggccgcuauuuuuaugacggccacacccccuggaaccgccgaagcuuucccccagagcaaugccccgauccaggacgaggagcgcgacaucccugaacgguccuggaacucuggcaaugaguggauuacagauuuuguggggaagaccgucugguucguucccagcaucaaagcgggcaacgacauugcuaacugucugagaaagaauggaaagaaagugauccaacucucccgcaagacguuugauaccgaauaucagaaaacacggcugaacgacugggauuucguggucaccacagacauuucugagaugggcgccaauuuuaaggccgauagagugaucgacccccggcgcugccugaaaccuguuauucucaccgaugggcccgagagagugauccuugcuggaccuaugccggucacagccgcgagcgccgcucagcggcgcggcagaguggggcggaacccccagaaggaaaaugaccaauacaucuucaccggacagccucugaacaaugaugaggaccacgcccacuggacggaagcuaagaugcugcucgacaacauuaauacacccgagggcaucauuccugcccuguucgaacccgagagagagaaauccgcugccaucgauggggaauaccgccuuaagggcgagagccggaaaaccuuuguugaacugaugagacgcggagaccucccgguguggcuggcgcauaaggucgccucugagggcauuaaauauaccgaucggaaguggugcuucgacggggaaagaaacaaucagauccuggaggagaacauggauguggaaaucuggacaaaagagggagaacgcaagaagcuccggccuagauggcuugacgcucgcaccuacuccgauccccuggcccugaaagaguuuaaggacuucgcugccggcagaaaaagcauugcccucgaucuggucacagaaaucgggcgggugccuucucaccuugcucaucgcacgagaaaugcgcuggacaaccucguuaugcugcacaccuccgagcacggaggccgggccuaucgccaugcuguggaggaacugcccgagacaauggaaacccuccuucugcugggccucaugauucugcuuacagggggagccaugcuguuucucaucagcggcaaggggauuggaaaaaccuccaucggccugaucugugugauugucucuagcgggaugcuguggauggccgauguuccucuccaguggaucgcuuccgccauugugcuugaguucuuuaugauggugcugcugauccccgagccggaaaagcaaagaacgccucaggacaaucagcucgcguacgucgugauuggaauccugacccuugccgcuauuguugccgcuaacgagaugggccugcucgaaacaaccaagcgggaucugggcaugagcaaagagcccgggguggucucucccacauccuaucuggacguggaccuccacccugccagcgcguggacccuuuacgccgucgcuacgacagugaucaccccgaugcugagacauacaaucgaaaauucuaccgccaacguuagccuggcugccauugcuaaccaagccgugguccucaugggacuggauaagggcuggcccaucuccaaaauggaccuuggggugccucugcucgcgcugggaugcuauucucagguuaauccccugacccucacagccgcugugcuucugcuggucacgcacuacgccauuaucggcccugggcuccaggcuaaggccacccgcgaggcccagaaacggacagcggcuggaauuaugaagaaccccaccguggauggcaucaugacaaucgaccuggauccugugauuuacgacagcaaguucgagaaacaacuuggccagguuaugcugcucguccugugugccgugcagcugcuccuuaugagaaccuccugggcucugugcgaagcccugacgcucgccacagggccgaucaccacccugugggagggaucucccggcaaguuuuggaauacaaccauugcugugagcauggccaacaucuuccgcggguccuaucuugcgggagccggccuggcuuuuagcauuaugaaaucugucgggacaggacggagaggcacgggcucccagggggaaacccucggagagaaguggaaaaagaagcugaaucaacugagccggaaagaauucgaucucuacaagaaauccggcaucacagagguugaccgcaccgaggccaaggaagggcuuaaaagaggagagacaacccaucacgcugugucucggggcagcgccaagcugcagugguuuguggaacgcaacauggucaucccugaggggagagugauugaucugggauguggccggggcgggugguccuauuacugcgcgggacucaaaaagguuacggaagugcgcggcuauaccaaggggggacccggccacgaggagccuguccccaugucuacauacggguggaauaucgugaaacugaugagcggaaaggacguuuucuaucuuccgccugaaaaaugugauacccugcucugcgacauuggcgaguccagccccucucccacaguggaagaguccagaaccauccggguccugaagaugguggagccuuggcugcgcaacaaucaguucuguauuaaagugcucaaccccuacaugccuacagucaucgaacaucuugagagacugcagcggaaguacggcgggaugcugguuagaaauccgcucagccgcaacucuacccacgaaauguauuggauuuccaauggaacgggcaacaucgugagcucugugaauauggucagccggcugcuucugaacagauuuacaaugacccaucgccggcccaccaucgagaaggauguggaccucggggccggaacaagacacguuaacgcugaaccugagacgcccaauauggacgugauuggcgagcgcaucaaacggauuaaggaagagcacuccucuaccuggcauuacgaugacgaaaacccuuauaaaacaugggccuaccacgggagcuaugaggucaaggcuaccggauccgccagcuccaugaucaauggcgugguuaaacugcugacaaagcccugggauguggucccgauggugacccaaauggcuaugacagacaccacgccuuucggccagcagagaguuuuuaaggaaaaaguggauacccgcacaccccggccuaugcccgggaccagaaaggucauggagauuacagccgaguggcucuggcgcacccugggacggaacaaaaagccuagacuuugcacgcgcgaagaguucacaaaaaaggugagaaccaaugcggccaugggcgcugucuuuacagaagagaaccaaugggacucugcccgggcugccguggaagaugaggaguucuggaagcugguugacaaagaacgcgagcuccauaagcuggggaaauguggaagcugcguguacaauaugaugggcaagagagaaaaaaagcuuggggaguuuggcaaagccaagggaucccgggcgaucugguauauguggcugggcgcuagauaccucgaguucgaagcccugggguuucugaacgaggaucacugguucucucgggaaaauagcuacuccggagucgagggcgaagggcuccauaagcugggauauauccuucgcgacauuucuaaaauccccggcggggccauguacgcugaugacaccgccggcugggacacgagaauuaccgaggaugaccugcacaacgaggaaaagaucacacagcagauggauccgggacaccggcagcucgcuaaugccauuuuuaaacugaccuaucaaaacaagguggugaaaguucagcgcccuacacccaagggcaccgugauggacaucaucagcagaaaggaucagcggggguccggacaggucggcacauacgggcuuaauaccuucacgaacauggaggcgcaacuggugcgccagauggaaggagagggcguucucagcaaagccgaccuggaaaauccccaucugcucgagaagaaaauuacacaguggcuggagaccaaggggguggaaagacuuaaacggauggcuaucucuggcgaugacugcgucgugaagccuauugaugaccgcuuugccaacgcucugcucgcccugaacgauaugggaaaggucagaaaagacaucccgcaguggcaacccuccaagggcuggcacgauuggcagcaggugccuuucuguagccaucacuuccacgagcuuauuaugaaagacgggcggaagcugguugugcccugccgcccucaggacgaacucaucggaagagcgcggaucucucaaggcgccggguggucccugaaagagaccgcuugucugggaaaggccuaugcucagauguggagccucauguacuuucaucgcagagaucugcggcuugccucuaaugcuauuugcuccgccguccccgugcacuggaucccuacaagcagaaccacaugguccauucaugcgcaccaucaguggaugacgaccgaagacaugcugacaguuuggaaccgcguguggaucgaggauaaucccuggauggaggacaagaccccggucacaaccugggaagaugugccuuaucucggcaaacgggaggaccaauggugugggagccugauuggccuuacgucuagagccaccugggcucagaacauccugacagccauucagcaggugcgcagccucaucggagaugaagaguuccuggacuacaugcccuccaugaagcgguuuagaaaagaggaagagaccgaaggcgccaucugguga

SEQ ID NO: 20934 - RNA, 9873 nt, Artificial Sequence
  derived and/or modified CDS sequence (opt5) from DENV-3__EF643017__SS-prME
accagccugugccucaugaugauccugcccgccgcucuugccuuccaccugacauccagagacggagaaccucggaugauuguggggaagaacgaacgcggaaaaucucuccuguuuaagacggcgagcggaaucaauauguguacccuuauugcuauggaucugggggaaaugugcgacgauacagugaccuacaaauguccgcauaucacagaaguugaacccgaagacauugauugcugguguaaccucaccuccacaugggugaccuauggaacgugcaaucaggccggagagagacggcgcgacaagagaucuguggcccuggcuccucacgucgggaugggacuggauacccggacacaaaccuggaugagcgccgagggcgcuuggcgccagguggaaaaaguugagacaugggcccucagacaucccggcuucaccauccuggcgcuuuuucuggcccacuacaucgggacgucccucacacagaagguggucauuuucauccugcuuaugcuggugaccccuucuaugacaaugcgguguguuggagugggcaaccgcgacuuugucgaagggcucagcggagcuaccuggguggaugugguccuggagcauggcgggugcguuaccacaauggccaagaauaaacccacgcuggacauugagcuccagaagaccgaagcuacacaacuggccacccuuagaaaacuguguaucgagggaaagauuacaaacaucaccacggauucccggugcccuacacagggcgaagcggugcucccggaggaacaggaccagaauuauguguguaaacacaccuacgucgaucgcggcugggggaacggaugcggccuguucgggaagggaagccuugugaccugcgccaaguuucaaugucuggagcccauugagggcaaaguugugcaguaugaaaaucucaaguacacagucaucaucaccgugcacacaggggaccagcaucagguuggaaacgagacgcaaggcgugaccgcugaaauuacaccucaggccucuaccacagaggcuauccugcccgaauauggcacccuggggcucgagugcuccccuagaacgggacuggacuucaaugagaugauucuucugaccaugaaaaacaaggccuggaugguccaccggcagugguuuuucgaucucccccugccguggacaagcggcgccaccacagaaaccccuacguggaaucgcaaagagcuucuggugacauuuaagaacgcucaugcgaaaaagcaagaagucgugguucucgggucucaggagggagccaugcacaccgcucugacaggcgccaccgaaauccaaaauagcgggggcaccagcauuuucucuggacaccugaaguguagacucaaaauggacaagcuggagcuuaaaggcauguccuacgccaugugcacaaacacguuugugcugaagaaagaggucagcgaaacccagcaugggacaauccucaucaagguggaguaccggggagaagaugcucccuguaagauuccuuucuccaccgaggacggccaagggaaagcccacaacggaagacugaucacagcgaaucccguugugaccaagaaagaggaacccgucaacauugaggcugaaccuccguucggcgagucuaauaucgugauugggaucggcgauaacgcccugaagaucaauugguauaaaaagggaagcuccauuggcaagauguuugaagccacggcucgcggggcccggagaauggcuauccuuggagacacagccugggauuucggcagcgucgggggaguucucaacucucugggcaaaaugguccaucagauuuuuggguccgcguacaccgcccuguucagcggcgugucuugggugaugaagaucggaauuggcguccuccugaccuggaucgggcuuaauagcaaaaacacauccaugucuuuuagcugcauugcuaucggaaucauuacccuguaucucggcgccgugguucaggcugacauggggugugugaucaauuggaagggaaaagagcugaagugcggcuccgggauuuucgucacaaacgaggugcacacguggaccgaacaguacaaguuucaagccgauagccccaaacgccuggcgacagccaucgcuggcgccugggagaauggaguuuguggcauucggucuaccacaagaauggaaaaccuucucuggaagcagaucgcuaaugagcugaacuauauccugugggaaaauaacauuaaacucaccguggucgugggggacaucauuggaguucuggagcagggcaagcgcacgcuuaccccucagcccauggagcugaaauacuccuggaagacaugggggaaagccaagaucgugaccgccgaaacacaaaacagcucuuucauuaucgauggaccuaauacccccgagugcccguccgcuagccgggcguggaacgucugggaaguggaggacuauggcuuuggcguguucacaaccaauaucuggcucaagcugagagaagucuacacgcagcugugugaccaucgccuuauguccgccgcuguuaaagaugagcgggccgugcacgccgacaugggguacuggauugagucucagaagaacggaagcuggaaacucgaaaaggcuucccugaucgaggugaaaacaugcaccuggccuaagucucacacccuguggagcaauggcguccucgaauccgauaugauuacacccaagagccuggccgggccuaucucucagcauaaccacagacccggauaucauacccaaacggcgggcccuuggcaccuugggaaacuggagcucgacuuuaauuacugcgagggaacaaccgugguuauuacagaaaacuguggcacccgcggccccucccugcggacaaccacggugagcgggaagcugauccacgaguggugcuguagaucuugcacccuuccgccucuccgguauaugggagaagauggcuguugguacgggauggagauccgccccauuuccgaaaaagaggagaauauggucaagagccuggugucugcuggaagcggcaaaguugacaacuucacaaugggggugcugugccucgccauccuguuugaagaggucaugagaggaaaguucggcaagaaacauaugauugccggcguguucuuuaccuucguucuucugcucuccgggcagaucacauggcgggauaugacccacacgcugauuaugaucggaagcaaugcuucugacagaaugggcaugggggugacauaucuggcccuuauugcgaccuuuaagauccagcccuuccuggcucucggauuuuuccugcgcaaacucacaucccgggaaaaccugcuucugggcgucgggcucgccauggccaccacccugcaacugccugaggauaucgaacagauggcuaauggaauugcccuuggccugauggcucucaagcugaucacacaguuugagacguaccagcucuggaccgcccugauuagccuuacauguuccaacaccauguucacacugaccguggcguggagaacggccacacucauccuggcuggcgugucucugcuuccggucugccaaagcuccucuaugcgcaaaaccgacuggcugcccauggccguugcugccaugggggugagcccucucccccuguuuauuuucucccucaaggauacccugaagagacggucuuggccucuuaaugagggagugauggccgucggccuggugagcauccuggcuuccagccuccugcgcaacgacguucccauggcggggccucuuguggccggaggccugcucaucgcuuguuaugucauuacagggaccucugccgaucugacaguggaaaaagccgcugacaucacgagagaggaagaggccgaacagaccggaguuucccauaaccucaugacaaccguggacgaugacggcacaaugcggauuaaggaugacgagaccgagaauauccugacgguccuucugaaaaccgcgcugcucauugugagcggcgucuuucccuacucuaucccggcuacacugcuuguguggcacaccuggcagaagcagacacaacgcuccgggguucugugggaugugccuucucccccugaaacccagaaagccgagcucgaagagggagucuacagaaucaagcagcagggcauuuucgggaaaacacaagugggaguuggcgugcagaaggagggggucuuucauacgauguggcacgugacccggggagccgugcugacauauaacggcaagcgccucgaacccaauugggcuuccguuaaaaaggaccugaucuccuacggcgggggauggagacuuagcgcccaguggcaaaaaggcgaggaaguccaggugauugcgguggagccggggaagaacccuaaaaauuuccagaccaugcccggaaccuuccagacaacgaccggcgaaaucggggcuauugcccuggauuuuaagccuggaacauccggcagccccaucauuaaccgggagggcaaggucguggggcuguauggaaauggcguugugaccaaaaacgggggauacgucucuggcaucgcccaaacaaaugcugagcccgacgggccuaccccggaacucgaggaagagauguucaagaaacgcaaccugacgaucauggaucuucaccccggcagcggaaagacaagaaaauaucugccugccauugugcgggaagcuaucaagagacgccuccggacccugauucucgcccccaccagaguuguggcggccgagauggaggaagcucugaagggccuuccuauccgcuaccagacaaccgccacaaaauccgagcauaccgggcgggaaauugucgaccugaugugccacgcuacguuuacaaugagacugcucucucccgugcgcguuccuaauuauaaccugaucaucauggaugaggcccauuucaccgacccggccagcauugcugcgcggggauacaucuccacaagagugggcaugggggaagccgcugccauuuuuaugaccgccacgcccccuggaaccgcugaugccuucccccagucuaaugcgccuauccaggacgaggagcgcgacauucccgaacggagcuggaacuccggcaaugaguggaucacagauuuugcugggaagaccgucugguucgugccgucuaucaaagccggcaacgacauugccaacugucuuagaaagaauggcaagaaagugauccaacugagccggaaaacauuugauaccgaauaccagaaaacaaagcucaacgacugggauuucgucguuaccacggacauuuccgagaugggcgcuaauuuuaaagccgaucgcgugaucgacccuagacggugccugaagcccgugauucugacagaugggcccgagcgcgucauccucgcgggaccuaugcccgugaccgccgcuagcgccgcucagagacggggcagaguugggcgcaacccucagaaagaaaaugaccaauauauuuucaccggacagccgcuuaacaaugaugaggaccacgcccauuggacagaagcuaagaugcugcuggacaacaucaauacccccgagggcaucauuccugcccucuucgaacccgagcgggagaagucugcggccaucgauggggaauacagacugaaaggcgagucccgcaagacauuuguggaacuuaugcggagaggagaccugccugucuggcucgcucacaaaguggccagcgagggcauuaaguauacggaucgcaaauggugcuucgacgggcagcggaacaaucagauccuggaagagaacauggauguugagauuuggaccaaggaaggagagaaaaagaagcugagaccccgcuggcucgacgcuagaacauacucugauccgcuugcccugaaagaauuuaaggacuucgccgcuggccggaaauccaucgcgcuggaucucgugaccgagaucgggcgcgucccuagccaccuggcccauagaacacggaaugcucuugacaaccuggugaugcuccacaccuccgaacauggaggccgcgccuauagacacgccgucgaggagcugcccgaaacgauggagacccugcuccuucugggccugaugauucuccugacagggggagcuaugcuuuuucugaucucuggcaaggggauuggaaaaaccagcaucggccucauuugugugaucgccuccagcgggaugucuuggauggcggaaaucccucugcaauggauugccuccgcuaucguucuggaguucuuuaugauggugcuccuuauucccgagccugaaaagcagcggacaccccaggauaaucaacuggccuacguggucaucggcauucugacccucgcugccaucauugcggccaacgagaugggccugcuugaaacgacaaagagagaccugggcaugagcaaagagccggggguugugucuccuaccagcuaucucgauguggaccugcaccccgcuuccgccuggacacuguacgcugucgccaccaccgugaucacacccaugcuccgccauacgaucgaaaauucuaccgcuaacguuagccuugccgcgauugccaaccaggcugugguccugaugggacuggacaagggcuggccuaucuccaaaauggaucucggggugccgcugcuugcccugggaugcuacucucaggucaauccccucacacugaccgcugccgugcugcuccuuauuacacacuaugccaucauuggcccugggcugcaggcgaaggcuacccgggaggcccagaaaagaacggcugccggaaucaugaagaaccccacaguugacggcaucaugaccauugaucuggacccugugaucuacgauagcaaguucgagaaacagcucggccaggucaugcugcuugugcugugugccguucagcuccugcugaugcgcaccuccugggcucucugcgaagcccuuacacuggcgaccgggcccauuacaacgcugugggagggaagcccuggcaaguuuuggaauaccacaaucgccgugucuauggcuaacauuuuccggggguccuaucucgccggagucggccuggcuuuuagcaucaugaaauccguggggaccggaaagagaggcacaggcucucaaggggaaacccuuggagagaaauggaagaagaaacugaaucagcucagccggaaggaguucgaccuguacaaaaaguccggcaucacggagguggaucgcaccgaggccaaagaagggcugaagagaggagagauuacacaucacgcgguuucucggggcagcgccaaacuccagugguuugucgaacgcaacauggugaucccggaggggagagugauugaccuuggauguggccggggcgggugguccuauuacugcgcuggacugaagaaggucaccgaaguucgcggcuauacaaaagggggacccggccaugaggagccugugcccaugagcaccuacggguggaauaucgugaagcugaugucuggaaaagaugucuucuaccucccucccgaaaagugugacacacugcuuugcgauauuggcgaguccagcccgucuccuaccguggaagaguccagaacgauccggguucugaaaaugguggagcccuggcucaagaacaaucaguucuguauuaagguccugaaccccuauaugccuacagugaucgaacaccuggagcgccuccaaagaaaacacggcgggaugcuuguucggaauccccugagcagaaacucuacccaugaaauguacuggaucagcaauggaaccggcaacauuguggccuccgucaauauggugucucgccugcuccugaaccgguuuacaaugacgcacagacgcccuaccaucgagaaggacguggaucuuggggcuggaacacggcaugucaacgccgaaccggagacccccaauauggacguuauuggcgagagaaucaaacgcauuaaggaagaacacaacagcacauggcacuaugacgaugaaaauccuuacaaaaccugggcuuaucauggguccuacgaggugaaggccacaggaagcgcguccucuaugaucaacggcguggucaagcugcucaccaaacccugggacgugguuccuauggugacgcagauggccaugaccgauacaacccccuucggccagcaacgggucuuuaaggaaaaaguggacacaagaaccccgcgcagcaugccugggacgcggagaguuaugggaaucacagcugaguggcuguggcgcacccugggccggaauaagaaacccagacucugcacacgcgaggaguucaccaagaaggugagaacgaacgccgcuaugggggccgucuuuaccgaggaaaaucagugggauuccgccaaagcggcuguggaggacgaagauuucuggaagcugguugaccgggagcgcgagcuucacaaacugggaaaguguggcucuugcguguauaacaugauggggaaaagagaaaagaaacucggcgaguuuggaaaggccaagggcagccgggccauuugguacauguggcugggggcuagauaccuugaguucgaggcccugggauuucucaaugaggaucauugguucucccgggaaaacucuuauagcggcgucgagggggaaggacugcacaaacugggcuacauccuccgcgacauuuccaagaucccugggggcgcuauguaugccgaugacacagcgggaugggacaccagaauuacagaggaugaccugcauaaugaagagaaaaucacccagcagauggaucccgagcaccggcaacuugccaacgcuaucuuuaagcugacauaccagaauaaaguggucaaggugcagcgcccuacccccacgggcacaguuauggacauuaucagcagaaaggaucagcgggggucuggacaagugggcaccuaugggcucaacaccuucacaaauauggaagcccagcugauucgccagauggagggagaaggcguccuuuccaaagcugaccuggagaacccgcaccucccugaaaagaaaaucacccaguggcuggagacaaaggggguggagagacugaaacggauggccauuagcggcgaugacugcgugguuaagcccaucgaugaccgcuuugcgaacgcccuccuggcucuuaaugauacgggaaaggugagaaaagacaucccccaauggcagccuucuaagggcuggcaugauuggcagcaggucccguucuguucccaccauuuccacgaacugauuaugaaagacgggcggaagcucgugguucccugccgcccucaagacgagcugaucggcagagcccggauuagccagggcgcuggguggucucuucgcgaaaccgccugucugggaaaggcuuacgcccagauguggucccucauguauuuucacagacgggaucugagacuggcgagcaacgccaucugcuccgcugugcccguccauugggugccuacaagccgcaccacauggucuauucacgcccaucaccaauggaugaccacggaggacaugcucaccgucuggaaucggguguggaucgaagauaaccccuggauggaggacaagacaccuguuaccacaugggagaaugugcccuaccugggcaagagagaagaucaguggugugggagccuuauuggccugaccucccgcgccacgugggcucagaacaucccgacagccauccagcaaguccggucucucauuggaaaugaggaguuccuggacuacaugccuagcaugaaaagauuucgcaaggaggaggaauccgagggcgcgaucugguga

SEQ ID NO: 20935 - RNA, 9873 nt, Artificial Sequence
  derived and/or modified CDS sequence (opt5) from DENV-3__DQ675519__SS-prME
accagcaucugccugaugaugaugcuccccgccacacuggcuuuccaccuuacgagccgggacggcgaaccucggaugauuguggggaagaacgaacgcgggaaaucucugcucuuuaagaccgccagcggcaucaauauguguacacugauugcgauggaucuuggggagaugugcgacgauaccgucacauacaaauguccgcugaucaccgaaguugagcccgaagacauugauugcugguguaaccucacauccaccugggugacguauggaaccugcaaucaggcuggcgagcaucggcgggacaagcgcucuguggcccuggccccucacgucgggaugggacuggauacaagaacccagacauggaugagcgcugagggcgccuggcggcaggucgaaaaaguugagaccugggcuuuccgccaucccggcuuuacgauccucgcccuguuccuugcgcacuacaucgggacaucccugacccagaagguggucauuuuuauccuccugaugcuugugacaccuucuaugaccaugagauguguuggagugggcaaccgggacuucgucgaagggcugagcggagccaccuggguggaugugguccucgagcauggcgggugcguuacaacgauggcuaagaauaaacccacccuggacauugagcugcagaagacagaagccacccagcucgcuacacugcgcaaacuuuguaucgagggaaagauuaccaacgugacgacagauuccagaugcccuacccagggcgaagccauccugccggaggaacaggaccagaauuauguguguaaacacaccuacgucgaucggggcugggggaacggaugcggccucuuugggaagggaagccuggugacaugcgcgaaguuccaaugucuugagucuauugagggcaaaguugugcagcacgaaaaucugaaguauaccgucaucaucacagugcauacgggggaccagcaccagguuggaaacgagacccaaggcgugacagccgaaauuacaccccaggcuuccacagucgaggccauccucccugaauacggcacccuggggcuggagugcagcccccgcacgggacucgacuuuaaugagaugauucugcuuaccaugaaaaacaaggcuuggauggugcauagacagugguucuuugaucugccucuccccuggacaucuggcgccaccacagaaaccccgacguggaauaaaaaggagcugcuugucacauucaaaaacgcccacgcuaagaagcaagaagugguugugcuggggucccaggagggagcgaugcacaccgcccucacaggcgcuaccgaaauccagaccagcgggggcacaucuauuuuugccggacaucugaaaugucggcugaagauggacaaacucgagcugaagggcauguccuaugccaugugccuuaaugcuuucguccugaaaaaggaggugagcgaaacgcagcacgggaccauccucaucaagguugaguacaaaggagaagaugccccuugucgcauucccuucuccacagaggacggccaagggaaggcgcauaacggaagacugaucaccgcuaacccuguggucaccaagaaggaggaacccgugaauauugaggccgaacccccuuuuggcgagucuaacaucgugauugggaucggcgauaaagcccugaagaucaauugguacaagaaaggaagcuccauuggcaagauguucgaagcuaccgccagaggggcuagacgcauggccauccuuggagacacggcgugggauuuuggcagcguugggggaguccucaacucucugggcaaaauggugcaccagauuuucggguccgccuauacagcucuguuuagcggcgugucuuggaucaugaagauuggaaucggcguccuccugaccuggauugggcuuaauagcaaaaacaccuccaugucuuucagcugcaucgugaucggaauuaucacacuguaccucggcgccguugugcaggcugacauggggugugucauuaauuggaagggaaaggagcugaaaugcggcaacgggaucuuugugaccaaugagguucauacauggacggaacaguauaaguuccaagccgauuccccgaaacggcuggcgaccgccauugcuggcgccugggagaacggaguguguggcaucagaagcacaacccgcauggaaaaucuucucuggaagcagaucgcuaacgagcugaauuacauucugugggaaaacaauaucaaacucacagucgugguuggggacauuaucggagugcuggagcagggcaagcggacccuuacgccccagccuauggagcugaaauauucuuggaagaccugggggaaggccaaaauugucacagccgaaacccaaaacuccagcuuuaucaucgauggacccaacacaccugagugccccucugcuuccagagcguggaaugugugggaaguggaggacuacggcuucggcgucuuuaccacaaacauuuggcucaagcugcgcgaaguuuauacccagcugugugaccaccggcuuaugagcgccgcugugaaagaugagagagccgugcacgccgacaugggguacuggaucgagucccagaagaauggaucuuggaaacucgaaaaggcuagccugauugaggucaagacgugcacauggccgaaaucccauacccuguggucuaacggcgugcucgaaagcgauaugaucauuccuaagucccuggccgggcccaucagccagcacaaucaucgcccuggauaccacacccaaacagcgggccccuggcaccuugggaaacuggagcucgacuucaacuauugcgagggaaccacgguugugaucacagaaaauuguggcacccggggcccuucucugagaacaaccacagucuccgggaagcugauucaugaguggugcugucgcagcugcacccuucccccgcuccgguacaugggagaagauggcuguugguaugggauggagaucagaccuauuaacgaaaaagaggagaauauggugaagucucugguuuccgcuggaagcggcaagguggacaacuuuacgauggggguccugugccucgccauccuguucgaagaggugaugcggggaaaauucggcaagaaacacaugauugccggcguucuuuuuaccuucgugcugcuccugucugggcagaucacauggcgcgauauggcucauacccugauuaugaucggaagcaaugccuccgacagaaugggcaugggggucacauaccuugcgcugaucgcuaccuuuaagauucagcccuuccucgcccugggauuuuuccuccggaaacugacgagcagagaaaaccuucugcucggcguggggcuggccauggcuacaacccugcaacuucccgaggauaucgaacagauggccaauggaguggcucugggccucauggcccugaagcucauuacacaguuugagaccuaucagcuguggaccgcgcuugucucucugauguguuccaacacaaucuucacgcucaccguugccuggcgcacagcuacccugauucuggccggcaucagccuucugccugugugccaauccucuagcaugcggaagacagacuggcucccgaugaccguggcugccaugggggugcccccucugccccucuuuaucuucucccugaaagauacgcuuaagagacgcucuuggccucugaaugagggagugauggccauuggccugguuagcauccucgcuuccucucugcuuagaaacgacgugcccauggcggggccucuggucgccggaggccuccugauugcuuguuacgugaucacagggaccagcgccgaucucaccguugaaaaagccgcugacgugacaugggaggaagaggccgaacagaccggagucucccacaaccugaugauuacaguggacgaugacggcacgaugcggaucaaggaugacgagaccgagaauauccuuacaguccugcugaaaaccgcgcuccugauugugagcggcaucuuucccuauucuauuccggcuacacuucugguuuggcauaccuggcagaagcagacgcaacgcuccggggugcucugggaugucccuucucccccugaaacccagaaagccgagcuggaagagggaguguacagaaucaagcagcagggcauuuucgggaagacacaaguuggagugggcauccagaaagagggggucuuucacaccauguggcacgugacacggggagccgugcucacccauaacggcaagcgccuggaacccaauugggcuuccguuaaaaaggaccuuauuuccuacggcgggggauggagacugagcgcccaguggcaaaaaggcgaggaaguccaggugaucgcgguggagccggggaagaacccuaagaauuuccagacaaugcccggaaucuuccagacgaccacaggcgaaauuggggcuaucgcccuggauuuuaaaccuggaaccucuggcucccccauuaucaaccgggagggcaaggucguggggcucuauggaaauggcguugugaccaaaaacgggggauacgucagcggcauugcccaaacaaaugcugagcccgacgggccuacgccggaacuggaggaagagauguucaagaaacgcaaccuuaccaucauggaucugcaccccggcuccggaaagacaagaaaguaucucccuaccaucgugcgggaagccauuaaacgcagacugcggacacucauccuggcucccaccagaguuguggccgcggagauggaggaagcccuuaagggccugccuauucgcuaccagacgacagcuaccaaaagcgagcauaccgggaaggaaaucgucgaccugaugugccacgccacauuuaccaugcggcuccugucucccgugagaguuccuaauuauaaccuuauuaucauggaugaggcucauuucacagacccggccagcaucgccgcucgcggauacauuuccacccgggugggcaugggggaagcggccgcuaucuuuaugacggccacacccccuggaaccgccgaugcuuucccccagucuaaugccccuauucaggacgaggagagagacauccccgaacgcagcuggaacuccggcaaugaguggauuacagauuuugucgggaaaaccgugugguucgugccgucuaucaaggcgggcaacgacauugcuaacugucugcggaagaauggcaaaaaggucauccaacucagcagaaaaacguuugauaccgaauaucagaagacaaaacugaacgacugggauuucguugugaccacagacaucuccgagaugggagccaauuuuaaggccgaucgcgugauugacccucggagaugccugaagcccgucauccucaccgaugggcccgagcgggugauucuugcuggaccuaugcccguuacaguggccucugcggcccagcgcagaggccgggucgggcgcaacccucagaaagaaaaugaccaauacaucuucaccggacagccgcugaacaaugaugaggaccacgcucacuggacggaagccaagaugcugcucgacaacauuaauacacccgagggcaucaucccugcucuguucgaacccgagagagagaaaagcgccgcuauugauggggaauaccggcuuaagggcgaguccagaaaaaccuuuguggaacugaugcgccggggagaccucccuguuuggcuggcccauaagguggcgagcgagggcaucaaauauaccgauagaaaguggugcuucgacggggaacgcaacaaucagauucuggaggagaacauggaugucgaaaucuggacaaaggagggagagaagaagaaacuccggcccagauggcuugacgcccgcaccuacucugauccgcuggcucugaaggaguuuaaagacuucgccgcuggccggaaguccauugcccucgaucuggugacagaaaucgggagagucccuagccaccuugccuaucgcacgagaucugcucuggacaaucucgugaugcugcauaccuccgagcacggaggccgggcguaccgccacgccguugaggaacugcccgagacaauggaaacccuccuucugcugggccucaugauccugcuuacagggggagcuaugcuguuucucauuagcggcaaggggaucggaaaaaccuccauuggccugaucugugugguggccucuagcgggaugcuguggauggccgaugucccucuccaguggauugcuuccgccaucguucuugaguucuuuaugauggugcugcugauucccgagccugaaaagcaaagaacgccccaggacaaccagcucgcguauguggucaucggaauccugacccuugccgcuauuguggccgcuaaugagaugggccugcucgaaacaaccaaacgggaucugggcaugagcaaggagccggggguugugucuccuacauccuaccuggacgucgaccuccaucccgccagcgcguggacccuuuaugccguggcuacgacagucaucacccccaugcugcgccacacaauugaaaacucuaccgccaaugugagccuggcugccaucgcuaaccaagccguugugcucaugggacuggauaaaggcuggccuauuuccaagauggaccuuggggucccgcugcucgcgcugggaugcuacucucaggugaacccccugacccucacagccgcuguucuucugcuggugacgcauuacgccaucaucggcccugggcuccaggcuaaggccaccagagaggcccagaaacggacagcggcuggaauuaugaagaaucccaccgucgauggcaucaugacaauugaccuggauccugugaucuaugacagcaaauucgagaagcaacuuggccaggugaugcugcucguucugugugccguccagcugcuccuuaugagaaccuccugggcuuuuugcgaagcccugacgcuggccacagggcccauuaccacccucugggagggaucuccuggcaaauucuggaacacaaccaucgcugugagcauggccaauaucuuucgcggguccuaccuggcgggagccggccuugcuuucagcauuaugaagucuguggggacaggaaagcggggcacgggcucccagggggaaacccugggagagaaauggaagaaaaagcucaaccaacugagcagaaaagaauuugaucuguauaagaaauccggcaucacagaggucgaccgcaccaaggccaaggaggggcucaaacggggagaaacaacccaccaugcuguuucuagaggcagcgccaaacuucagugguucguggagcggaauauggugauuccggaagggcgcgucaucgaucugggauguggcagaggcgggugguccuacuauugcgcgggacugaaaaaggugacggagguucggggcuacaccaaagggggacccggccacgaagaaccugugcccaugucuacauauggguggaacauugucaagcucaugagcggaaaggacguguucuaccugccucccgagaaaugugauacccuucugugcgacaucggcgaauccagcccgucuccuacaguugaggaaucccgcaccauuagagugcucaagauggucgagcccuggcugaaaaauaaccaguuuuguaucaaggugcugaaucccuacaugccuacagugaucgagcaccucgaacggcuucagcgcaaacauggcgggaugcuggucagaaacccccugagcagaaauucuacccacgagauguauuggauuuccaacggaacgggcaauaucguuagcucugugaacauggugagccgccuccugcuuaauagauucacaaugacccaucggagaccuaccauugaaaaggaugucgaccugggggccggaacacgccacgugaacgcugagccggaaacgcccaacauggacguuaucggcgagcggauuagacgcaucaaggaggaacacuccucuaccuggcauuacgaugacgagaauccuuauaaaacaugggccuaccacgggagcuaugaagugaaggcuaccggauccgccagcuccaugaucaacggcgucgugaaacuccugacaaagcccugggauguugugccuaccgucacacaaauggcuaugaccgacacgacccccuuuggccagcagcggguguucaaagagaagguugauacaagaaccccgcgcccuaugcccgggacacggaaggugauggaaauuaccgccgaguggcuguggagaacgcucggacgcaauaaacggccuagacugugcacacgcgaggaauuuaccaagaaaguccggacaaacgcggccaugggcgcuguguucaccgaggaaaaucaaugggacucugccagagcugccgucgaggaugaagaguuuuggaaacuuguggaccgcgagagagaacugcauaaacucgggaaguguggaagcugcguuuacaacaugaugggcaaacgggagaagaagcugggggaguucggcaaagccaagggaucccgcgcgaucugguauauguggcuuggcgcuagauaccuggaguuugaggcccucggguuccugaaugaagaucacugguuuucucgggagaacagcuacuccggaguggaaggcgaggggcugcauaaacucggauauauucugagagacaucucuaagacgcccggcggggccauguacgcugaugacaccgccggcugggacacacggauuaccgaagaugaccuucacaaugaggagaaaaucacacagcagauggauccugaacaccgccagcuggcuaacgccaucuucaagcucaccuaucaaaauaaggucgugaaagugcagagacccacaccgaagggaaccguuauggacauuaucagccggaaagaucagcgcggcuccggacaggugggaacguacggccugaacacauuuaccaauauggaggcgcaacuuauuagacagauggaaggggagggaguccugagcaaggccgaccucgaaaacccucaucugcccgagaaaaagaucacccaguggcuggagacaaagggcguggaacggcucaaacgcauggcuauuucuggggaugacugcguugugaagcccaucgaugacagauucgccaaugcucugcuugcccugaacgauaugggcaaaguccggaaggacaucccucaguggcaaccguccaaaggauggcacgauuggcaacaggugcccuucuguagccaucacuuucacgagcucauuaugaaggacggccgcaagcuggucgugccuugcagaccccaggacgaacuuaucgggcgggcgcgcauuucucaaggagccggcuggucccugaaagagaccgcuugucucgggaaggccuaugcucagauguggagccugauguacuuccauagacgggaucugcgccucgccucuaacgcuaucugcuccgccguuccugugcacuggguccccacaagcagaacgaccugguccauucaugcgcaccaucaguggaugacaaccgaagacaugcugacaguguggaaucggguuuggaucgaggauaacccuuggauggaggacaaaacccccgugacgaccugggaagaugucccguaucuuggaaagagagaggaccaaugguguggcagccugauugggcucacaucucgcgccaccugggcucagaauauccugacagccauccaacaggugcggagccuuauuggcaacgaagaguuucuggauuacaugccuuccaugaaaagauuccgcaaggaggaagagucugaaggagccaucugguga

SEQ ID NO: 20936 - RNA, 9873 nt, Artificial Sequence
  derived and/or modified CDS sequence (opt5) from DENV-3__DQ675521__SS-prME
accagcuucugccugaugaugaugcuccccgccacccuggcuuuucaccuuacgucccgggacggcgagccucggaugaucguggggaagaacgaacgcggaaagucucuccuguucaagaccgccagcggcauuaauauguguacacugaucgcgauggaucuuggggagaugugcgacgauaccgugacauacaaauguccgcugauugcugaaguugagcccgaagacaucgauugcugguguaaccucaccuccacaugggugaccuauggaacgugcaaucaggccggcgagcaccggcgggacaagcgcucuguggcccuggcuccucacgucgggaugggacuggauaccagaacacagaccuggaugagcgccgagggcgcuuggcggcaggucgaaaaaguugagacaugggcccuccgccaucccggcuuuaccauucuggcgcuuuuccuggcccacuacaucgggacgucccucacacagaagguggucaucuuuauucugcuuaugcuggugaccccuucuaugacaaugagauguguuggagugggcaaccgggacuucgucgaagggcucagcggagcuaccuggguggaugugguccuggagcauggcgggugcguuaccacaauggccaagaauaaacccacgcuggacaucgagcuccagaagaccgaagcuacacagcuggccacccuucgcaaacuguguauugagggaaagaucacaaacauuaccacggauuccagaugcccuacacagggcgaagcgauccucccggaggaacaggaccagaauuauguguguaaacacaccuacguggaucggggcugggggaacggaugcggccuguuugggaagggaagccuugugaccugcgccaaguuccaaugucuggagcccauugagggcaaagugguucaguaugaaaaucucaaguacacagugaucaucaccguccacacaggggaccagcaucaggugggaaacgacacgcaaggcguuaccguggagauuacaccucaggcuucuaccgucgaagccgugcugcccgaguauggcacacuggggcucgaaugcuccccucgcaccggacuggauuuuaaugagaugauccuucugacgaugaaaaacaaggcuuggaugguccacagacagugguucuuugaccucccccugccguggaccagcggcgccacaaccgagacaccuaccuggaaucggaaagaacuucuggugacguucaagaacgcccaugcuaaaaagcaagagguugugguccucgggucucaggaaggagcgaugcacacagcccugaccggcgcuacagagauucaaaauuccgggggcaccagcaucuuugccggacaccugaagugucgccucaaaauggauaagcuggaacuuaaaggcaugucuuacgccaugugccugaacaccuucgugcucaagaaagagguuuccgagacacagcaugggacgauucugaucaagguggaauacaagggagaggacgcucccuguaaaaucccuuucagcaccgaagauggccaagggaaggcccacaacggaagacugauuacagcgaaucccgucgugaccaaaaaggaggagcccgugaacaucgaagcugagccuccguuuggcgaauccaauauuguuaucgggauuggcgacaaagcccuuaagaucaacugguauaagaaaggaucuagcaucggcaagauguucgaggccacagcuagaggggcuagacgcauggcuauucucggagauaccgccugggacuuuggcuccgucgggggagugcugaauagccugggcaaaauggugcaucagaucuucgggucugcguacacggcccucuuuuccggcgucagcuggauuaugaagaucggaauuggcgugcugcuuacauggaucgggcugaacucuaaaaauaccagcauguccuucucuugcauuguuaucggaaucauuacccucuaucugggcgcugugguccaggccgauauggggugugugaucaacuggaagggaaaggaacugaaaugcggcagcgggauuuuuguuacaaaugaggugcacaccuggacagagcaguacaaguuccaagcugacucccccaaacggcuugccacggcgaucgccggcgcuugggaaaacggagucuguggcauuagaagcaccacacgcauggagaaucuccuguggaagcagaucgccaacgaacugaauuauauccucugggagaacaauauuaaacugaccgugguugugggggauaucauuggaguccuugaacagggcaagcggacacugaccccucagcccauggagcucaaauacucuuggaagacgugggggaaggcuaaaaucgugaccgccgagauucaaaacuccagcuuuaucaucgacggaccuaacacacccgaaugcccgucugccuccagagcuuggaaugugugggaggucgaagacuauggcuucggcguuuuuaccacaaacauuuggcugaagcugcgcgagauguacacccagagcugugaucaucggcuuauguccgcggccaucaaagacgaaagagcugugcacgccgauaugggguacuggauugagucucagaagaauggaagcuggaaacucgagaaggccuccuucaucgaagugaagacaugcaccuggccuaaaucucacacgcuguggagcaacggcguccuggaguccgacaugauuauccccaagagccucgcugggccuaucucucagcauaaucaccgccccggauaucauacacaaaccgccggcccuuggcaccuggggaaacuugaacuggauuuuaacuacugcgagggaaccacagugguuauuaccgagaauuguggcacgcggggccccucccucagaacaaccacagugagcgggaagcugauccacgaauggugcugucgcucuugcacccugccgccucuucgguauaugggagaggacggcuguugguacgggauggaaauuagacccaucaacgagaaagaagagaauauggucaagucccucgugagcgcgggaucuggcaagguugauaacuucacaaugggggugcugugccuggcuauucucuucgaggaagucaugcggggaaaauuuggcaagaaacauaugaucgugggcguucuguucaccuuugugcuucugcucagcgggcagauuacguggcgcgacauggcccacacccugaucaugaucggauccaaugccagcgauagaaugggcaugggggucacauaucuggcucuuauugccaccuucaagauccagcccuuucuggcgcucggauucuuucugcggaaacucacaucuagagagaaccugcuucugggcguggggcucgcuauggccaccacgcugcaacugccugaagacauugagcagauggccaauggaaucgcucuuggccugaugacacucaagcugauuacccaguucgaaacauaccagcucuggaccgcccuggugucccuuaccuguagcaacacaaucuuuacgcugaccgucgcuuggcgcacagccacccucauccuggcgggcguuucccugcuuccgcugugccaaucuagcuccaugcggaagacagauuggcuccccaugaccguggccgcuaugggggugccuccccugccucucuucaucuuuucucugaaagacacgcccaagagacgcagcuggccucuuaaugagggagucauggccgugggccugguuuccauccuggcuucuagccuccugagaaacgaugugcccauggccgggccgcuugucgccggaggccugcucauugcuuguuaugugaucacagggaccuccgcggaccugaccguugagaaagccgcugacgugacaugggaagaggaagccgagcagaccggagucagccauaaccucaugauuacaguggaugacgauggcacgaugcggaucaaggacgaugaaaccgagaauauccugacaguccuucugaaaaccgcccugcucauugugucuggcaucuucccuuacuccauucccgcuacacugcuuguuuggcacaccuggcagaagcagacgcaacgcagcggggugcugugggacgucccuucucccccggagacccagaaagccgaacucgaggaaggaguguacagaaucaagcagcagggcauuuuugggaagacacaaguuggagugggcguccagaaagaggggguguuccauaccauguggcacgugacacggggagcgguucugacccacaacggcaagcgccucgagccuaauugggcuuccgucaaaaaggaucugaucagcuauggcgggggauggagacuuucugcccaguggcaaaaaggcgaagagguccaggugauugccgucgaacccgggaagaacccuaagaauuuccagacaaugcccggaaucuuucagacgaccacaggcgagaucggggcuauugcccuggacuucaaacccggaaccuccggcagcccuaucauuaaccgggaaggcaaggugguugggcuguacggaaauggcguggucaccaaaaacgggggauauguguccggcaucgcgcaaacaaaugcugagccggaugggcccacgccugagcucgaagaggaaauguuuaagaaacgcaaccugaccauuauggaccuucaucccggcagcggaaagacaagaaaguaccugccugccaucguucgggaggccaucaaacgcagacuccggacccugauucucgcucccacaagaguggucgccgcugaaauggaggaggcccugaagggccuuccuauccgcuaucagaccacggcgacaaaaucugaacacaccgggcgggagauuguggaucugaugugccaugccaccuucacaaugagacugcucagcccgguucgcgugcccaauuacaaccugaucauuauggacgaagcucacuuuaccgauccugccuccaucgcugcccggggauauaucucuacaagagucggcaugggggaggccgcugcgauuuucaugaccgccacgcccccuggaacagcugaagccuuuccccagagcaaugccccgauccaggacgaggagcgcgacauuccugaacgguccuggaacucuggcaaugaguggaucaccgauuucguggggaagacagugugguuuguccccagcauuaaagcuggcaacgacaucgccaacugucuuagaaagaauggaaagaaaguuauucaacugucccgcaagaccuucgauacggaauaccagaaaacccggcucaacgacugggauuuuguggugacaaccgacaucucugagaugggcgcgaauuucagagcugaucgggucaucgacccccgcagaugccugaagccugugauucugacagaugggcccgagcggguuauccucgccggaccuaugccggugaccgccgcuagcgccgcgcagcgcagaggccgggucgggagaaacccccagaaagaaaaugaccaauacauuuucacaggacagccucuuaacaaugaugaggaccaugcccacuggaccgaagcuaagaugcugcuggacaacaucaauacgcccgagggcauuaucccugcccucuuugaacccgagcgcgagaaguccgcugccaucgauggggaauaucggcugaaaggcgagagcagaaagacauucguggaacuuaugcgccggggagaccugccgguuuggcucgcucacaaaguggccucugagggcauuaaguacaccgauagaaaauggugcuuugacggggaacgcaacaaucagauccuggaggagaacauggaugucgaaauuuggaccaaggagggagaacggaaaaagcugagaccucgcuggcucgacgcgagaacauauuccgauccccuugcccugaaggaguucaaagacuuugcugccggcagaaagagcaucgcucuggaucucgugaccgaaauugggcgcgucccuucucaucuggcccacagaacacggaaugcccuugacaaccuggugaugcuccauacguccgagcacggaggccgcgcuuacagacacgcgguugaggaacugcccgagaccauggaaacacugcuccuucugggccugaugauccuccugaccgggggagccaugcuuuuccugaucagcggcaaagggauuggaaagacauccaucggccucauuugugugaucgugucuagcgggaugcuguggauggcugaugucccucugcaguggauugccuccgccaucguucucgaguuuuucaugauggugcuucugauucccgagccggaaaaacaacggaccccucaggacaaucagcuggcuuauguggucaucggaauccucacgcuggccgcgauuguggccgcuaacgagaugggccuucuggaaaccacaaagagagaucucggcaugagcaaggagcccgggguugugucucccaccuccuaccuggacgucgaccugcauccugccagcgcuuggacacucuaugccguggcgaccacggucaucacaccgaugcuucgccacaccauugaaaauucuacagccaacgugagccuggcugccaucgcuaaccaagccguugugcugaugggacucgauaaaggcuggcccauuuccaagauggaccugggggucccucuucuggcucucggaugcuacucucaggugaauccccugacccugaccgccgcgguucuccuucuggugacacauuacgccaucaucggcccugggcugcaggcuaaagccacgcgggaggcucagaagagaaccgccgccggaauuaugaaaaaccccacagucgauggcaucaugaccauugaccucgauccugugaucuaugacagcaaguuugagaagcaacugggccaggugaugcuucugguucucugugcgguccagcugcugcucaugcgcacauccugggcucuuugcgaagcccugacccuggcuacggggccgauuacaacccucugggagggaucucccggcaaauucuggaauaccacaaucgccgugagcauggccaacaucuuucggggguccuaccuggcuggagccggccuugcguucagcauuaugaagucuguggggaccggaagacggggcacaggcucccagggggaaacgcugggagagaaauggaagaaaaagcucaaucaacugagccgcaaggaauuugaucuguauaaaaaguccggcaucaccgaggucgacagaacagaggccaaagaagggcucaagcggggagagaccacacaccaugcuguuucucgcggcagcgccaaacuucagugguucguggaaagaaacauggugauuccugaggggcgggucaucgaucugggauguggccgcggcgggugguccuacuauugcgcuggacugaagaaagugaccgaaguuagaggcuacacgaaaggcgggcccgggcacgaggagccugugcccaugucuaccuauggguggaauauugucaagcucaugagcggaaaagacguguucuaccugccgccugaaaagugugauacacuucugugcgacaucggcgaguccagccccucucccaccguugaagagucccggacaauucgcgugcucaaaauggucgagccuuggcugaagaacaaucaguuuuguaucaaagugcugaaccccuacaugccuaccgugaucgaacaccucgagagacuucagcggaaguauggcgggaugcuggucagaaauccgcugagccgcaacucuacacaugaaauguacuggauuuccaauggaaccggcaacaucguuagcucugugaauauggugagccggcuccugcuuaacagauucacgaugacacaccgccggcccaccauugagaaggaugucgaccugggggccggaaccagacaugugaacgcggaaccugagacacccaauauggacguuaucggcgagcgcauuaaacggaucaaggaagaacacuccucuacguggcacuaugaugacgaaaacccuuacaaaaccugggccuaucaugggagcuacgaggugaaggcuacaggauccgccagcuccaugaucaauggcgucgugaaacuccugaccaagcccugggauguugugccgauggucacacaaauggcuaugaccgacacaaccccuuuuggccagcagagaguguucaaggaaaaaguugauacgcgcacaccccggccuaugcccgggacaagaaaggugauggagauuaccgccgaguggcuguggcgcacacucggacggaacaaaaagccuagacugugcacccgcgaagaguuuacgaaaaaggucagaacaaaugcugccaugggcgcgguguucaccgaagagaaccaaugggacucugcccgggcugccgucgaagaugaggaguuuuggaaacuuguggaccgcgaaagagagcugcacaaacucgggaaguguggaagcugcguuuauaauaugaugggcaaacgggaaaagaaacugggggaguucggcaaggcuaaaggauccagagccaucugguacauguggcuuggcgcccgguaccuggaguuugaagcgcucggguuccugaacgaggaucauugguuuucucgcgaaaauagcuauuccggaguggagggcgaagggcugcacaagcucggauacauucugagagacaucucuaagauucccggcggggcuauguaugccgaugacacagccggcugggacacccggaucacggaggaugaccuucauaacgaggagaagauuacccagcagauggauccggagcaccgccagcuggcuagcgccauuuucaagcucacauaccaaaauaaagucgugaaggugcagagaccuacccccaaaggaacaguuauggacaucauuucccggaaggaucagcgcggcagcggacaggugggaaccuauggccugaacacauuuaccaauauggaagcucaacuugucagacagauggagggggaaggagugcugucuaaggccgaccucgagaacccccaucugcuggagaaaaagaucacgcaguggcucgaaacaaaaggcguugagcggcugaagcgcauggcgauuuccggggaugacugcguggucaaaccuaucgaugacagauucgccaaugcccuucuggcccucaacgauaugggcaaggugcggaaggacaucccgcaguggcaacccagcaaaggauggcaugauuggcagcaggucccuuucuguucucaccauuuucacgaacugauuaugaaggacggccgcaaacuugugguucccugcagaccucaggacgagcugaucgggcgggcucgcauuucccaaggagccggcuggagccucaaggaaaccgcgugucuggggaaagccuacgcucagauguggucucugauguauuuccacagacgggaucucagacuggccuccaacgcuaucugcagcgccgugcccguccauugggugccuaccucccgcacaaccuggagcauucacgcucaucaccaguggaugacaacggaggacaugcuuaccguuuggaaucggguguggaucgaggauaaccccuggauggaagacaagacaccggucaccacaugggaggaugugccuuaccugggaaagagagaagaccaaugguguggcucucucauugggcugaccagccgcgccacgugggcgcagaauauccuuaccgccauccaacaggugcggucccugauuggcgaugaggaguuucucgacuacaugcccucuaugaaaagauuccgcaaggaagaggaaagcgagggagcuaucugguga

SEQ ID NO: 20937 - RNA, 9873 nt, Artificial Sequence
  derived and/or modified CDS sequence (opt5) from DENV-3__DQ675522__SS-prME
accagcuucugccugaugaugaugcuccccgccacccuggcuuuucaccuuacgucccgggacggcgaaccucggaugauuguggggaagaacgaacgcggaaagucucuccuguucaagaccgccagcggcauuaauauguguacacugaucgcgauggaucuuggggagaugugcgacgauaccgugacauacaaguguccgcugauugcugaaguugagcccgaagacaucgauugcugguguaaccucaccuccacaugggugaccuauggaacgugcaaucaggccggcgagcacagacgggacaagcgcucuguggcccuggcuccucacgucgggaugggacuggauaccagaacacagaccuggaugagcgccgagggcgcuuggcggcaggucgaaaaaguugagacaugggcccuccgccaucccggcuuuaccauucuggcgcuuuuccuggcccacuacaucgggacgucccucacacagaagguggucaucuuuauucugcuuaugcuggugaccccuucuaugacaaugagauguguuggagugggcaaccgggacuucgucgaagggcucagcggagcuaccuggguggaugugguccuggagcauggcgggugcguuaccacaauggccaagaauaaacccacgcuggacaucgagcuccagaagaccgaagcuacacagcuggccacccuucgcaaacuguguauugagggaaagaucacaaacauuaccacggauuccagaugcccuacacagggcgaagcgauccucccggaggaacaggaccagaauuauguguguaaacacaccuacguggaucggggcugggggaacggaugcggccuguuugggaagggaagccuugugaccugcgccaaguuccaaugucuggagcccauugagggcaaagugguucaguaugaaaaucucaaguacacagugaucaucaccguccacacaggggaccagcaucaggugggaaacgacacgcaaggcguuaccguggagauuacaccucaggcuucuaccgucgaagccgugcugcccgaguauggcacacuggggcucgaaugcuccccucgcaccggacuggauuuuaaugagaugauccuucugacgaugaaaaacaaggcuuggaugguccacagacagugguucuuugaccucccccugccguggaccagcggcgccacaaccgagacaccuaccuggaaucggaaagaacuucuggugacguucaagaacgcccaugcuaaaaagcaagagguugugguccucgggucucaggaaggagcgaugcacacagcccugaccggcgcuacagagauucaaaauuccgggggcaccagcaucuuugccggacaccugaagugucgccucaaaauggauaagcuggaacuuaaaggcaugucuuacgccaugugccugaacaccuucgugcucaagaaagagguuuccgagacacagcaugggacgauucugaucaagguggaauacaagggagaggacgcucccuguaaaaucccuuucagcaccgaagauggccaagggaaggcccacaacggaagacugauuacagcgaaucccgucgugaccaaaaaggaggagcccgugaacaucgaagcugagccuccguuuggcgaauccaauauuguuaucgggauuggcgacaaagcccuuaagaucaacugguauaagaaaggaucuagcaucggcaagauguucgaggccacagcuagaggggcuagacgcauggcuauucucggagauaccgccugggacuuuggcuccgucgggggagugcugaauagccugggcaaaauggugcaucagaucuucgggucugcguacacggcccucuuuuccggcgucagcuggauuaugaagaucggaauuggcgugcugcuuacauggaucgggcugaacucuaaaaauaccagcauguccuucucuugcauuguuaucggaaucauuacccucuaucugggcgcugugguccaggccgauauggggugugugaucaacuggaagggaaaggaacugaaaugcggcagcgggauuuuuguuacaaaugaggugcacaccuggacagagcaguacaaguuccaagcugacucccccaaacggcuugccacggcgaucgccggcgcuugggaaaacggagucuguggcauuagaagcaccacacgcauggagaaucuccuguggaagcagaucgccaacgaacugaauuauauccucugggagaacaauauuaaacugaccgugguugugggggauaucauuggaguccuugaacagggcaagcggacacugaccccucagcccauggagcucaaauacucuuggaagacgugggggaaggcuaaaaucgugaccgccgagauucaaaacuccagcuuuaucaucgacggaccuaacacacccgaaugcccgucugccuccagagcuuggaaugugugggaggucgaagacuauggcuucggcguuuuuaccacaaacauuuggcugaagcugcgcgagauguacacccagagcugugaucaucggcuuauguccgcggccaucaaagacgaaagagcugugcacgccgauaugggguacuggauugagucucagaagaauggaagcuggaaacucgagaaggccuccuucaucgaagugaagacaugcaccuggccuaaaucucacacgcuguggagcaacggcguccuggaguccgacaugauuauccccaagagccucgcugggccuaucucucagcauaaucaccgccccggauaucauacacaaaccgccggcccuuggcaccuggggaaacuugaacuggauuuuaacuacugcgagggaaccacagugguuauuaccgagaauuguggcacgcggggccccucccucagaacaaccacagugagcgggaagcugauccacgaauggugcugucgcucuugcacccugccgccucuucgguauaugggagaggacggcuguugguacgggauggaaauuagacccaucaacgagaaagaagagaauauggucaagucccucgugagcgcgggaucuggcaagguugauaacuucacaaugggggugcugugccuggcuauucucuucgaggaagucaugcggggaaaauuuggcaagaaacauaugaucgugggcguucuguucaccuuugugcuucugcucagcgggcagauuacguggcgcgacauggcccacacccugaucaugaucggauccaaugccagcgauagaaugggcaugggggucacauaucuggcucuuauugccaccuucaagauccagcccuuucuggcgcucggauucuuucugcggaaacucacaucuagagagaaccugcuucugggcguggggcucgcuauggccaccacgcugcaacugccugaagacauugagcagauggccaauggaaucgcucuuggccugaugacacucaagcugauuacccaguucgaaacauaccagcucuggaccgcccuggugucccuuaccuguagcaacacaaucuuuacgcugaccgucgcuuggcgcacagccacccucauccuggcgggcguuucccugcuuccgcugugccaaucuagcuccaugcggaagacagauuggcuccccaugaccguggccgcuaugggggugccuccccugccucucuucaucuuuucucugaaagacacgcccaagagacgcagcuggccucuuaaugagggagucauggccgugggccugguuuccauccuggcuucuagccuccugagaaacgaugugcccauggccgggccgcuugucgccggaggccugcucauugcuuguuaugugaucacagggaccuccgcggaccugaccguugagaaagccgcugacgugacaugggaagaggaagccgagcagaccggagucagccauaaccucaugauuacaguggaugacgauggcacgaugcggaucaaggacgaugaaaccgagaauauccugacaguccuucugaaaaccgcccugcucauugugucuggcaucuucccuuacuccauucccgcuacacugcuuguuuggcacaccuggcagaagcagacgcaacgcagcggggugcugugggacgucccuucucccccggagacccagaaagccgaacucgaggaaggaguguacagaaucaagcagcagggcauuuuugggaagacacaaguuggagugggcguccagaaagaggggguguuccauaccauguggcacgugacacggggagcgguucugacccacaacggcaagcgccucgagccuaauugggcuuccgucaaaaaggaucugaucagcuauggcgggggauggagacuuucugcccaguggcaaaaaggcgaagagguccaggugauugccgucgaacccgggaagaacccuaagaauuuccagacaaugcccggaaucuuucagacgaccacaggcgagaucggggcuauugcccuggacuucaaacccggaaccuccggcagcccuaucauuaaccgggaaggcaaggugguugggcuguacggaaauggcguggucaccaaaaacgggggauauguguccggcaucgcgcaaacaaaugcugagccggaugggcccacgccugagcucgaagaggaaauguuuaagaaacgcaaccugaccauuauggaccuucaucccggcagcggaaagacaagaaaguaccugccugccaucguucgggaggccaucaaacgcagacuccggacccugauucucgcucccacaagaguggucgccgcugaaauggaggaggcccugaagggccuuccuauccgcuaucagaccacggcgacaaaaucugaacacaccgggcgggagauuguggaucugaugugccaugccaccuucacaaugagacugcucagcccgguucgcgugcccaauuacaaccugaucauuauggacgaagcucacuuuaccgauccugccuccaucgcugcccggggauauaucucuacaagagucggcaugggggaggccgcugcgauuuucaugaccgccacgcccccuggaacagcugaagccuuuccccagagcaaugccccgauccaggacgaggagcgcgacauuccugaacgguccuggaacucuggcaaugaguggaucaccgauuucguggggaagacagugugguuuguccccagcauuaaagcuggcaacgacaucgccaacugucuuagaaagaauggaaagaaaguuauucaacugucccgcaagaccuucgauacggaauaccagaaaacccggcucaacgacugggauuuuguggugacaaccgacaucucugagaugggcgcgaauuucaaggcugauagagucaucgacccccggcgcugccugaaaccugugauucugacagaugggcccgagagaguuauccucgccggaccuaugccggugaccgccgcuagcgccgcgcagcggcgcggcagagucgggcggaacccccagaaggaaaaugaccaauacauuuucacaggacagccucuuaacaaugaugaggaccaugcccacuggaccgaagcuaagaugcugcuggacaacaucaauacgcccgagggcauuaucccugcccucuuugaacccgagagagagaaauccgcugccaucgauggggaauaucgccugaagggcgagagccggaaaacauucguggaacuuaugagacgcggagaccugccgguuuggcucgcucacaagguggccucugagggcauuaaauacaccgaucggaaguggugcuuugacggggaaagaaacaaucagauccuggaggagaacauggaugucgaaauuuggaccaaagagggagaacgcaagaagcugcggccuagauggcucgacgcgcgcacauauuccgauccccuugcccugaaagaguucaaggacuuugcugccggcagaaaaagcaucgcucuggaucucgugaccgaaauugggcgggucccuucucaucuggcccaccgcacaagaaaugcccuugacaaccuggugaugcuccauacguccgagcacggaggccgggcuuaccgccacgcgguugaggaacugcccgagaccauggaaacacugcuccuucugggccugaugauccuccugaccgggggagccaugcuuuuccugaucagcggcaaggggauuggaaaaacauccaucggccucauuugugugaucgugucuagcgggaugcuguggauggcugaugucccucugcaguggauugccuccgccaucguucucgaguuuuucaugauggugcuucugauucccgagccggaaaagcaaagaaccccucaggacaaucagcuggcuuauguggucaucggaauccucacgcuggccgcgauuguggccgcuaacgagaugggccuucuggaaaccacaaagcgggaucucggcaugagcaaagagcccgggguugugucucccaccuccuaccuggacgucgaccugcauccugccagcgcuuggacacucuaugccguggcgaccacggucaucacaccgaugcuuagacacaccauugaaaauucuacagccaacgugagccuggcugccaucgcuaaccaagccguugugcugaugggacucgauaagggcuggcccauuuccaaaauggaccugggggucccucuucuggcucucggaugcuacucucaggugaauccccugacccugaccgccgcgguucuccuucuggugacacauuacgccaucaucggcccugggcugcaggcuaaggccacgcgcgaggcucagaaacggaccgccgccggaauuaugaagaaccccacagucgauggcaucaugaccauugaccucgauccugugaucuaugacagcaaguuugagaaacaacugggccaggugaugcuucugguucucugugcgguccagcugcugcucaugagaacauccugggcucuuugcgaagcccugacccuggcuacggggccgauuacaacccucugggagggaucucccggcaaguucuggaauaccacaaucgccgugagcauggccaacaucuuucgcggguccuaccuggcuggagccggccuugcguucagcauuaugaaaucuguggggaccggacggagaggcacaggcucccagggggaaacgcugggagagaaguggaaaaagaagcucaaucaacugagccggaaagaauuugaucuguauaagaaauccggcaucaccgaggucgaccgcacagaggccaaggaagggcucaaaagaggagagaccacacaccaugcuguuucucggggcagcgccaaacuucagugguucguggaacgcaacauggugauuccugaggggagagucaucgaucugggauguggccggggcgggugguccuacuauugcgcuggacugaaaaaggugaccgaaguucgcggcuacacgaaaggcgggcccgggcacgaggagccugugcccaugucuaccuauggguggaauauugucaaacucaugagcggaaaggacguguucuaccugccgccugaaaaaugugauacacuucugugcgacaucggcgaguccagccccucucccaccguugaagaguccagaacaauucgggugcucaagauggucgagccuuggcugaaaaacaaucaguuuuguaucaaggugcugaaccccuacaugccuaccgugaucgaacaccucgagcgccuucagagaaaguauggcgggaugcugguccggaauccgcugagcagaaacucuacacaugaaauguacuggauuuccaauggaaccggcaacaucguuagcucugugaauauggugagccgccuccugcuuaaccgguucacgaugacacacagacgccccaccauugagaaagaugucgaccugggggccggaacccggcaugugaacgcggaaccugagacacccaauauggacguuaucggcgagagaauuaagcgcaucaaagaggaacacuccucuacguggcacuaugaugacgaaaacccuuacaagaccugggccuaucaugggagcuacgaggugaaagcuacaggauccgccagcuccaugaucaauggcgucgugaagcuccugaccaagcccugggauguugugccgauggucacacaaauggcuaugaccgacacaaccccuuuuggccagcagcggguguucaaagaaaagguugauacgagaacaccccgcccuaugcccgggacacggaaagugauggagauuaccgccgaguggcuguggagaacacucggacgcaacaagaaaccucggcugugcaccagagaagaguuuacgaagaagguccgcacaaaugcugccaugggcgcgguguucaccgaagagaaccaaugggacucugccagagcugccgucgaagaugaggaguuuuggaaacuuguggaccgggaacgcgagcugcacaagcucgggaaauguggaagcugcguuuauaauaugaugggcaagagagagaagaagcugggggaguucggcaaagcuaagggaucccgggccaucugguacauguggcuuggcgccagauaccuggaguuugaagcgcucggguuccugaacgaggaucauugguuuucucgggaaaauagcuauuccggaguggagggcgaagggcugcacaagcucggauacauucugcgcgacaucucuaaaauucccggcggggcuauguaugccgaugacacagccggcugggacaccagaaucacggaggaugaccuucauaacgaggaaaagaucacccagcagauggauccggagcaccggcagcuggcuagcgccauuuucaaacucacauaccaaaauaaggucgugaaagugcagcgcccuacccccaagggaacaguuauggacaucauuuccagaaaggaucagcggggcagcggacaggugggaaccuauggccugaacacauuuaccaauauggaagcucaacuuguccgccagauggagggggaaggagugcugucuaaagccgaccucgagaacccccaucugcuggagaagaaaaucacgcaguggcucgaaacaaagggcguugagagacugaaacggauggcgauuuccggggaugacugcguggucaagccuaucgaugaccgcuucgccaaugcccuucuggcccucaacgauaugggcaaggugagaaaagacaucccgcaguggcaacccagcaagggauggcaugauuggcagcaggucccuuucuguucucaccauuuucacgaacugauuaugaaagacggccggaaacuugugguucccugccgcccucaggacgagcugaucgggagagcucggauuucccaaggagccggcuggagccucaaagaaaccgcgugucuggggaaggccuacgcucagauguggucucugauguauuuccaccgcagagaucuccggcuggccuccaacgcuaucugcagcgccgugcccguccauugggugccuaccuccagaacaaccuggagcauucacgcucaucaccaguggaugacaacggaggacaugcuuaccguuuggaaucgcguguggaucgaggauaaccccuggauggaagacaagacaccggucaccacaugggaggaugugccuuaccugggaaaacgggaagaccaaugguguggcucucucauugggcugaccagcagagccacgugggcgcagaauauccuuaccgccauccaacaggugcgcucccugauuggcgaugaggaguuucucgacuacaugcccucuaugaagcgguucagaaaagaagaggaaagcgagggagcuaucugguga

SEQ ID NO: 20938 - RNA, 9873 nt, Artificial Sequence
  derived and/or modified CDS sequence (opt5) from DENV-3__DQ675527__SS-prME
accagcuucugccugaugaugaugcuccccgccacccuggcuuuucaccuuacgucccgggacggagagccucggaugauuguggggaagaacgaacgcggaaagucucuccuguucaagaccgccagcggcauuaauauguguacacugaucgcgauggaucuuggggagaugugcgacgauaccgugacauacaaauguccgcugauugcugaaguugagcccgaagacaucgauugcugguguaaccucaccuccacaugggugaccuauggaacgugcaaucaggccggcgagcacagacgggacaagcgcucuguggcccuggcuccucacgucgggaugggacuggauaccagaacacagaccuggaugagcgccgagggcgcuuggcggcaggucgaaaaaguugagacaugggcccuccgccaucccggcuuuaccauucuggcgcuuuuccuggcccacuacaucgggacgucccucacacagaagguggucaucuuuauucugcuuaugcuggugaccccuucuaugacaaugagauguguuggagugggcaaccgggacuucgucgaagggcucagcggagcuaccuggguggaugugguccuggagcauggcgggugcguuaccacaauggccaagaauaaacccacgcuggacaucgagcuccagaagaccgaagcuacacagcuggccacccuucgcaaacuguguauugagggaaagaucacaaacauuaccacggauuccagaugcccuacacagggcgaagcgauccucccggaggaacaggaccagaauuauguguguaaacacaccuacguggaucggggcugggggaacggaugcggccuguuugggaagggaagccuugugaccugcgccaaguuccaaugucuggagcccauugagggcaaagugguucaguaugaaaaucucaaguacacagugaucaucaccguccacacaggggaccagcaucaggugggaaacgacacgcaaggcguuaccguggagauuacaccucaggcuucuaccgucgaagccgugcugcccgaguauggcacacuggggcucgaaugcuccccucgcaccggacuggauuuuaaugagaugauccuucugacgaugaaaaacaaggcuuggaugguccacagacagugguucuuugaccucccccugccguggaccagcggcgccacaaccgagacaccuaccuggaaucggaaagaacuucuggugacguucaagaacgcccaugcuaaaaagcaagagguugugguccucgggucucaggaaggagcgaugcacacagcccugaccggcgcuacagagauucaaaauuccgggggcaccagcaucuuugccggacaccugaagugucgccucaaaauggauaagcuggaacuuaaaggcaugucuuacgccaugugccugaacaccuucgugcucaagaaagagguuuccgagacacagcaugggacgauucugaucaagguggaauacaagggagaggacgcucccuguaaaaucccuuucagcaccgaagauggccaagggaaggcccacaacggaagacugauuacagcgaaucccgucgugaccaaaaaggaggagcccgugaacaucgaagcugagccuccguuuggcgaauccaauauuguuaucgggauuggcgacaaagcccuuaagaucaacugguauaagaaaggaucuagcaucggcaagauguucgaggccacagcuagaggggcuagacgcauggcuauucucggagauaccgccugggacuuuggcuccgucgggggagugcugaauagccugggcaaaauggugcaucagaucuucgggucugcguacacggcccucuuuuccggcgucagcuggauuaugaagaucggaauuggcgugcugcuuacauggaucgggcugaacucuaaaaauaccagcauguccuucucuugcauuguuaucggaaucauuacccucuaucugggcgcugugguccaggccgauauggggugugugaucaacuggaagggaaaggaacugaaaugcggcagcgggauuuuuguuacaaaugaggugcacaccuggacagagcaguacaaguuccaagcugacucccccaaacggcuugccacggcgaucgccggcgcuugggaaaacggagucuguggcauuagaagcaccacacgcauggagaaucuccuguggaagcagaucgccaacgaacugaauuauauccucugggagaacaauauuaaacugaccgugguugugggggauaucauuggaguccuugaacagggcaagcggacacugaccccucagcccauggagcucaaauacucuuggaagacgugggggaaggcuaaaaucgugaccgccgagauucaaaacuccagcuuuaucaucgacggaccuaacacacccgaaugcccgucugccuccagagcuuggaaugugugggaggucgaagacuauggcuucggcguuuuuaccacaaacauuuggcugaagcugcgcgagauguacacccagagcugugaucaucggcuuauguccgcggccaucaaagacgaaagagcugugcacgccgauaugggguacuggauugagucucagaagaauggaagcuggaaacucgagaaggccuccuucaucgaagugaagacaugcaccuggccuaaaucucacacgcuguggagcaacggcguccuggaguccgacaugauuauccccaagagccucgcugggccuaucucucagcauaaucaccgccccggauaucauacacaaaccgccggcccuuggcaccuggggaaacuugaacuggauuuuaacuacugcgagggaaccacagugguuauuaccgagaauuguggcacgcggggccccucccucagaacaaccacagugagcgggaagcugauccacgaauggugcugucgcucuugcacccugccgccucuucgguauaugggagaggacggcuguugguacgggauggaaauuagacccaucaacgagaaagaagagaauauggucaagucccucgugagcgcgggaucuggcaagguugauaacuucacaaugggggugcugugccuggcuauucucuucgaggaagucaugcggggaaaauuuggcaagaaacauaugaucgugggcguucuguucaccuuugugcuucugcucagcgggcagauuacguggcgcgacauggcccacacccugaucaugaucggauccaaugccagcgauagaaugggcaugggggucacauaucuggcucuuauugccaccuucaagauccagcccuuucuggcgcucggauucuuucugcggaaacucacaucuagagagaaccugcuucugggcguggggcucgcuauggccaccacgcugcaacugccugaagacauugagcagauggccaauggaaucgcucuuggccugaugacacucaagcugauuacccaguucgaaacauaccagcucuggaccgcccuggugucccuuaccuguagcaacacaaucuuuacgcugaccgucgcuuggcgcacagccacccucauccuggcgggcguuucccugcuuccgcugugccaaucuagcuccaugcggaagacagauuggcuccccaugaccguggccgcuaugggggugccuccccugccucucuucaucuuuucucugaaagacacgcccaagagacgcagcuggccucuuaaugagggagucauggccgugggccugguuuccauccuggcuucuagccuccugagaaacgaugugcccauggccgggccgcuugucgccggaggccugcucauugcuuguuaugugaucacagggaccuccgcggaccugaccguugagaaagccgcugacgugacaugggaagaggaagccgagcagaccggagucagccauaaccucaugauuacaguggaugacgauggcacgaugcggaucaaggacgaugaaaccgagaauauccugacaguccuucugaaaaccgcccugcucauugugucuggcaucuucccuuacuccauucccgcuacacugcuuguuuggcacaccuggcagaagcagacgcaacgcagcggggugcugugggacgucccuucucccccggagacccagaaagccgaacucgaggaaggaguguacagaaucaagcagcagggcauuuuugggaagacacaaguuggagugggcguccagaaagaggggguguuccauaccauguggcacgugacacggggagcgguucugacccacaacggcaagcgccucgagccuaauugggcuuccgucaaaaaggaucugaucagcuauggcgggggauggagacuuucugcccaguggcaaaaaggcgaagagguccaggugauugccgucgaacccgggaagaacccuaagaauuuccagacaaugcccggaaucuuucagacgaccacaggcgagaucggggcuauugcccuggacuucaaacccggaaccuccggcagcccuaucauuaaccgggaaggcaaggugguugggcuguacggaaauggcguggucaccaaaaacgggggauauguguccggcaucgcgcaaacaaaugcugagccggaugggcccacgccugagcucgaagaggaaauguuuaagaaacgcaaccugaccauuauggaccuucaucccggcagcggaaagacaagaaaguaccugccugccaucguucgggaggccaucaaacgcagacuccggacccugauucucgcucccacaagaguggucgccgcugaaauggaggaggcccugaagggccuuccuauccgcuaucagaccacggcgacaaaaucugaacacaccgggcgggagauuguggaucugaugugccaugccaccuucacaaugagacugcucagcccgguucgcgugcccaauuacaaccugaucauuauggacgaagcucacuuuaccgauccugccuccaucgcugcccggggauauaucucuacaagagucggcaugggggaggccgcugcgauuuucaugaccgccacgcccccuggaacagcugaagccuuuccccagagcaaugccccgauccaggacgaggagcgcgacauuccugaacgguccuggaacucuggcaaugaguggaucaccgauuucguggggaagacagugugguuuguccccagcauuaaagcuggcaacgacaucgccaacugucuuagaaagaauggaaagaaaguuauucaacugucccgcaagaccuucgauacggaauaccagaaaacccggcucaacgacugggauuuuguggugacaaccgacaucucugagaugggcgcgaauuucaaggcugauagagucaucgacccccggcgcugccugaaaccugugauucugacagaugggcccgagagaguuauccucgccggaccuaugccggugaccgccgcuagcgccgcgcagcggcgcggcagagucgggcggaacccccagaaggaaaaugaccaauacauuuucacaggacagccucuuaacaaugaugaggaccaugcccacuggaccgaagcuaagaugcugcuggacaacaucaauacgcccgagggcauuaucccugcccucuuugaacccgagagagagaaauccgcugccaucgauggggaauaucgccugaagggcgagagccggaaaacauucguggaacuuaugagacgcggagaccugccgguuuggcucgcucacaagguggccucugagggcauuaaauacaccgaucggaaguggugcuuugacggggaaagaaucaaccagauucuggaggagaauauggaugucgaaaucuggaccaaagagggagaacgcaagaaccugcggccuagauggcucgacgcgcgcacauauuccgauccccuugcccugaaggaguucaaagacuuugcugccggcagaaagagcauugcucuggaucucgugaccgaaaucgggcgggucccuucucaucuggcccaccgcacaagaaaugcccuugacaaccuggugaugcuccauacguccgagcacggaggccgggcuuaccgccacgcgguugaggaacugcccgagaccauggaaacacugcuccuucugggccugaugauccuccugaccgggggagccaugcuuuuccugauuagcggcaaagggaucggaaagacauccauuggccucaucugugugauugugucuagcgggaugcuguggauggcugaugucccucugcaguggaucgccuccgccauuguucucgaguuuuucaugauggugcuucugauccccgagccggaaaaacaaagaaccccucaggacaaucagcuggcuuauguggucaucggcauucucacgcuggccgcgaucguggccgcuaacgagaugggccuucuggaaaccacaaagcgggaucucggcaugagcaaggagcccgggguugugucucccaccuccuaccuggacgucgaccugcauccugccagcgcuuggacacucuaugccguggcgaccacggucauuacaccgaugcuuagacacaccaucgaaaauucuacagccaacgugagccuggcugccauugcuaaccaagccguugugcugaugggacucgauaaaggcuggcccaucuccaagauggaccugggggucccucuucuggcucucggaugcuacucucaggugaauccccugacccugaccgccgcgguucuccuucuggugacacauuacgccaucauuggcccugggcugcaggcuaaagccacgcgcgaggcucagaagcggaccgccgccggaaucaugaaaaaccccacagucgauggcauuaugaccaucgaccucgauccugugauuuaugacagcaaguuugagaagcaacugggccaggugaugcuucugguucucugugcgguccagcugcugcucaugagaacauccugggcucuuugcgaagcccugacccuggcuacggggccgaucacaacccucugggagggaucucccggcaaauucuggaauaccacaaucgccgugagcauggccaacauuuuucgcggguccuaccuggcuggagccggccuugcguucagcaucaugaagucuguggggaccggacggagaggcacaggcucccagggggaaacgcugggagagaaauggaagaaaaagcucaaucaacugagccggaaggaauuugaucuguauaaaaaguccggcauuaccgaggucgaccgcacagaggccaaagaagggcucaagagaggagagaccacacaccaugcuguuucucggggcagcgccaaacuucagugguucguggaacgcaacauggugaucccugaggggagagucauugaucugggauguggccggggcgggugguccuacuauugcgcuggacugaagaaagugaccgaaguucgcggcuacacgaaaggcgggcccgggcacgaggagccugugcccaugucuaccuauggguggaauaucgucaagcucaugagcggaaaagacguguucuaccugccgccugaaaagugugauacacuucugugcgacauuggcgaguccagccccucucccaccguugaagaguccagaacaauccgggugcucaaaauggucgagccuuggcugaagaacaaucaguuuuguaucaaagugcugaaccccuacaugccuaccgugauugaacaccucgagcgccuucagagaaaguauggcgggaugcugguccggaauccgcugagcagaaacucuacacaugaaauguacuggaucuccaauggaaccggcaacauuguuagcucugugaauauggugagccgccuccugcuuaaccgguucacgaugacacacagacgccccaccaucgagaaggaugucgaccugggggccggaacccggcaugugaacgcggaaccugagacacccaauauggacguuauuggcgagagaaucaaacgcaucaaggaagaacacuccucuacguggcacuaugaugacgaaaacccuuacaaaaccugggccuaucaugggagcuacgaggugaaggcuacaggauccgccagcuccaugauuaauggcgucgugaaacuccugaccaagcccugggauguugugccgauggucacacaaauggcuaugaccgacacaaccccuuuuggccagcagcggguguucaaggaaaaaguugauacgagaacaccccgcccuaugcccgggacacggaaggugauggagaucaccgccgaguggcuguggagaacacucggacgcaacaaaaagccucggcugugcaccagagaagaguuuacgaaaaagguccgcacaaaugcugccaugggcgcgguguucaccgaagagaaccaaugggacucugccagagcugccgucgaagaugaggaguuuuggaaacuuguggaccgggaacgcgagcugcacaaacucgggaaguguggaagcugcguuuauaauaugaugggcaaaagagaaaagaaacugggggaguucggcaaggcuaaaggaucccgggccauuugguacauguggcuuggcgccagauaccuggaguuugaagcgcucggguuccugaacgaggaucauugguuuucucgggaaaauagcuauuccggaguggagggcgaagggcugcacaagcucggauacauccugcgcgacauuucuaagauccccggcggggcuauguaugccgaugacacagccggcugggacaccagaaucacggaggaugaccuucauaacgaggagaagauuacccagcagauggauccggagcaccggcagcuggcuagcgccaucuucaagcucacauaccaaaauaaagucgugaaggugcagcgcccuacccccaaaggaacaguuauggacauuaucuccagaaaggaucagcggggcagcggacaggugggaaccuauggccugaacacauuuaccaauauggaagcucaacuuguccgccagauggagggggaaggagugcugucuaaggccgaccucgagaacccccaucugcuggagaaaaagauuacgcaguggcucgaaacaaaaggcguugagagacugaagcggauggcgaucuccggggaugacugcguggucaaaccuaucgaugaccgcuucgccaaugcccuucuggcccucaacgauaugggcaaggugagaaaggacauuccgcaguggcaacccagcaaaggauggcaugauuggcagcaggucccuuucuguucucaccauuuucacgaacugaucaugaaggacggccggaaacuugugguucccugccgcccucaggacgagcugauugggagagcucggaucucccaaggagccggcuggagccucaaggaaaccgcgugucuggggaaagccuacgcucagauguggucucugauguauuuccaccgcagagaucuccggcuggccuccaacgcuauuugcagcgccgugcccguccauugggugccuaccuccagaacaaccuggagcauccacgcucaucaccaguggaugacaacggaggacaugcuuaccguuuggaaucgcguguggauugaggauaaccccuggauggaagacaagacaccggucaccacaugggaggaugugccuuaccugggaaagcgggaagaccaaugguguggcucucucaucgggcugaccagcagagccacgugggcgcagaauauccuuaccgccauucaacaggugcgcucccugaucggcgaugaggaguuucucgacuacaugcccucuaugaaacgguucagaaaggaagaggaaagcgagggagcuauuugguga

SEQ ID NO: 20939 - RNA, 9873 nt, Artificial Sequence
  derived and/or modified CDS sequence (opt5) from DENV-3__DQ675528__SS-prME
accagcuucugccugaugaugaugcuccccgccacacuggcuuuucaccuuacguccagagacggcgagccucggaugaucguggggaagaacgaacgcggaaaaucucugcucuucaagaccgccagcggcauuaauauguguacacugaucgcgauggaucuuggggagaugugcgacgauaccgucacauacaaauguccgcugauugcugaaguugagcccgaagacaucgauugcugguguaaccucaccuccacaugggugaccuauggaacgugcaaucaggccggcgagcauagacgggacaagcgcucuguggcccuggcuccucacgucgggaugggacuggauaccagaacacaaaccuggaugagcgccgagggcgcuuggcggcagguggaaaaaguugagacaugggcccuccgccaucccggcuuuaccauucuggcgcuuuuccuggcccacuacaucgggacgucccucacacagaagguggucaucuuuauucugcuuaugcuggugaccccuucuaugacaaugagauguguuggagugggcaaccgggacuucgucgaagggcucagcggagcuaccuggguggaugugguccuggagcauggcgggugcguuaccacaauggccaagaauaaacccacgcuggacaucgagcuccagaagaccgaagcuacacaacuggccacccuucgcaaacuguguauugagggaaagaucacaaacauuaccacggauuccagaugcccuacacagggcgaagcgauccucccggaggaacaggaccagaauuauguguguaaacacaccuacguggaucggggcugggggaacggaugcggccuguuugggaagggaagccuugucaccugcgccaaguuccaaugucuggagcccauugagggcaaagugguucaguaugaaaaucucaaguacacagugaucaucaccguccacacaggggaccagcaucaggugggaaacgacacgcaaggcguuaccguggagauuacaccucaggcuucuaccgucgaagccgugcugcccgaguauggcacacuggggcucgaaugcuccccucgcaccggacuggauuuuaaugagaugauccuucugacgaugaaaaacaaggcuuggaugguccacagacagugguucuuugaccucccccugccguggaccagcggcgccacaaccgagacaccuaccuggaaucggaaagaacuucuggugacguucaagaacgcccaugcuaaaaagcaagagguugugguccucgggucucaggaaggagcgaugcacacagugcugaccggcgccacagagauucagaauuccgggggcaccagcaucuuugcuggacaccugaagugucgccucaaaauggauaagcuggaacuuaaaggcaugucuuacgccaugugccugaacaccuucguucucaagaaagagguguccgagacacagcaugggacgauucugaucaaggucgaauacaagggagaggacgcccccuguaaaaucccuuucagcaccgaagauggccaagggaaggcucacaacggaagacugauuacagccaaucccguggugaccaaaaaggaggagcccguuaacaucgaagcggagccuccguuuggcgaauccaauauugucaucgggauuggcgacaaagcucuuaagaucaacugguauaagaaaggaucuagcaucggcaagauguucgaggccacagcccggggggcuagacgcauggccauucucggagauaccgcuugggacuuuggcuccguggggggagugcugaauagccugggcaaaaugguccaucagaucuucgggucugccuacacggcgcucuuuuccggcgugagcuggauuaugaagaucggaauuggcguucugcuuacauggaucgggcugaacucuaaaaauaccagcauguccuucucuugcauugugaucggaaucauuacccucuaucugggcgccgucgugcaggcugauaugggguguguuaucaacuggaagggaaaggaacugaaaugcggcagcgggauuuuugugacaaaugagguccacaccuggacagagcaguacaaguuccaagccgacucccccaaacggcuugcuacggccaucgcgggcgccugggaaaacggaguguguggcauuagaagcaccacacgcauggagaaucuccuguggaagcagaucgcuaacgaacugaauuauauccucugggagaacaauauuaaacugaccguuguggucggggauaucauuggagugcuugaacagggcaagcggacacugaccccucagcccauggagcucaaauacucuuggaagacgugggggaaggccaaaaucgugaccgcugagauucaaaacuccagcuuuaucaucgacggaccuaacacacccgaaugcccgucugccuccagagccuggaaugucugggagguugaagacuauggcuucggcguguuuaccacaaacauuuggcugaagcugcgcgagauguacacccagagcugugaucaucggcuuauguccgcugcgaucaaagacgaaagagccgugcacgcugauaugggguacuggauugagucucagaagaauggaagcuggaaacucgagaaggccuccuucaucgaagucaagacaugcaccuggccuaaaucucacacgcuguggagcaacggcgugcuggaguccgacaugauuauccccaagagccucgccgggccuaucucucagcauaaucaccgccccggauaucauacacaaaccgcuggcccuuggcaccuggggaaacuugaacuggauuuuaacuacugcgagggaaccacaguugugauuaccgagaauuguggcacgcggggccccucccucagaacaaccacagucagcgggaagcugauccacgaauggugcugucgcucuugcacccugccgccucuucgguauaugggagaggacggcuguugguacgggauggaaauuagacccaucaacgagaaagaagagaauauggugaagucccucguuagcgccggaucuggcaagguggauaacuucacaauggggguccugugccuggcgauucucuucgaggaagugaugcggggaaaauuuggcaagaaacauaugaucguuggcgugcuguucaccuuuguccuucugcucagcgggcagauuacguggcgcgacauggcucacacccugaucaugaucggauccaaugccagcgauagaaugggcaugggggugacauaucuggcccuuauugcuaccuucaagauccagcccuuucuggcccucggauucuuucugcggaaacucacaucuagagagaaccugcuucugggcguggggcucgcgauggcuaccacgcugcaacugccugaagacauugagcagauggccaauggaaucgcccuuggccugaugacacucaagcugauuacccaguucgaaacauaccagcucuggaccgcucuggucucccuuaccuguagcaacacaaucuuuacgcugaccguugccuggcgcacagcuacccucauccuggccggcgugucccugcuuccgcugugccaaucuagcuccaugcggaagacagauuggcuccccaugaccguggcggccaugggggucccuccccugccucucuucauuuuuucucugaaagacacgcccaagagacgcagcuggccucuuaaugagggagugauggcuguuggccugguguccauccuggccucuagccuccugagaaacgauguccccauggcugggccgcuuguggccggaggccugcucauugccuguuauguuaucacagggaccuccgcugaccugaccguggagaaagcggccgacgucacaugggaagaggaagcugagcagaccggagugagccauaaccucaugauuacagucgaugacgauggcacgaugcggaucaaggacgaugaaaccgagaauauccugacagugcuucugaaaaccgcccugcucauuguuucuggcaucuucccuuacuccauucccgccacacugcuuguguggcacaccuggcagaagcagacgcaacgcagcgggguccugugggacgugccuucucccccggagacccagaaagcugaacucgaggaaggaguuuacagaaucaagcagcagggcauuuuugggaagacacaagugggagucggcgugcagaaagaggggguguuccauaccauguggcacguuacacggggagccguccugacccacaacggcaagcgccucgagccuaauugggcguccgugaaaaaggaucugaucagcuauggcgggggauggagacuuucugcucaguggcaaaaaggcgaagaggugcaggucauugccguggaacccgggaagaacccuaagaauuuccagacaaugcccggaaucuuucagacgaccacaggcgagaucggggccauugcucuggacuucaaacccggaaccuccggcagcccuaucauuaaccgggaaggcaagguuguggggcuguacggaaauggcgucgugaccaaaaacgggggauauguuuccggcaucgcccaaacaaaugcggagccggaugggcccacgccugagcucgaagaggaaauguuuaagaaacgcaaccugaccauuauggaccuucaucccggcagcggaaagacaagaaaguaccugccugcuaucgugcgggaggccaucaaacgcagacuccggacccugauucucgcccccacaagagucguggcugccgaaauggaggaggcucugaagggccuuccuauccgcuaucagaccacggccacaaaaucugaacacaccgggcgggagauuguugaucugaugugccaugcgaccuucacaaugagacugcucagcccggugcgcguccccaauuacaaccugaucauuauggacgaagcccacuuuaccgauccugcuuccaucgccgcucggggauauaucucuacaagagugggcaugggggaggccgccgcuauuuucaugaccgcgacgcccccuggaacagccgaagcuuuuccccagagcaaugccccgauccaggacgaggagcgcgacauuccugaacgguccuggaacucuggcaaugaguggaucaccgauuucguggggaagacagucugguuuguucccagcauuaaagccggcaacgacaucgcuaacugucuuagaaagaauggaaagaaagugauucaacugucccgcaagaccuucgauacggaauaccagaaaacccggcucaacgacugggauuuuguggucacaaccgacaucucugagaugggcgccaauuucaaggcggauagagugaucgacccccggcgcugccugaaaccuguuauucugacagaugggcccgagagagugauccucgcuggaccuaugccggucaccgccgccagcgcugcccagcggcgcggcagaguggggcggaacccccagaaggaaaaugaccaauacauuuucacaggacagccucuuaacaaugaugaggaccaugcgcacuggaccgaagccaagaugcugcuggacaacaucaauacgcccgagggcauuaucccugcucucuuugaacccgagagagagaaauccgccgcuaucgauggggaauaucgccugaagggcgagagccggaaaacauucguugaacuuaugagacgcggagaccugccgguguggcucgcccacaaggucgcuucugagggcauuaaauacaccgaucggaaguggugcuuugacggggaaagaaacaaucagauccuggaggagaacauggauguggaaauuuggaccaaagagggagaacgcaagaagcugcggccuagauggcucgacgcccgcacauauuccgauccccuugcgcugaaagaguucaaggacuuugccgcuggcagaaaaagcaucgcccuggaucucgucaccgaaauugggcgggugccuucucaucuggcucaccgcacaagaaaugcccuugacaaccugguuaugcuccauacguccgagcacggaggccgggccuaccgccacgcuguggaggaacugcccgagaccauggaaacacugcuccuucugggccugaugauccuccugaccgggggagcgaugcuuuuccugaucagcggcaaggggauuggaaaaacauccaucggccucauuugugugaucgucucuagcgggaugcuguggauggccgauguuccucugcaguggauugcuuccgccaucgugcucgaguuuuucaugauggugcuucugauucccgagccggaaaagcaaagaaccccucaggacaaucagcuggccuaugucgugaucggaauccucacgcuggcugccauuguugcggccaacgagaugggccuucuggaaaccacaaagcgggaucucggcaugagcaaagagcccgggguggucucucccaccuccuaccuggacguggaccugcauccugcuagcgccuggacacucuaugcugucgccaccacggugaucacaccgaugcuuagacacaccauugaaaauucuacagcgaacguuagccuggccgcuaucgccaaccaagcugugguccugaugggacucgauaagggcuggcccauuuccaaaauggaccugggggugccucuucuggcccucggaugcuacucucagguuaauccccugacccugaccgcugccgugcuccuucuggucacacauuacgcgaucaucggcccugggcugcaggccaaggcuacgcgcgaggcccagaaacggaccgcugccggaauuaugaagaaccccacaguggauggcaucaugaccauugaccucgauccugugaucuaugacagcaaguuugagaaacaacugggccagguuaugcuucugguccucugugccgugcagcugcugcucaugagaacauccugggcgcuuugcgaagcucugacccuggccacggggccgauuacaacccucugggagggaucucccggcaaguucuggaauaccacaaucgcugugagcauggccaacaucuuucgcggguccuaccuggccggagcuggccuugccuucagcauuaugaaaucugucgggaccggacggagaggcacaggcucccagggggaaacgcugggagagaaguggaaaaagaagcucaaucaacugagccggaaagaauuugaucuguauaagaaauccggcaucaccgagguugaccgcacagaggcgaaggaagggcucaaaagaggagagaccacacaccaugccgugucucggggcagcgcuaagcuucagugguucguggaacgcaacauggucauuccugaggggagagugaucgaucugggauguggccggggcgggugguccuacuauugcgccggacugaaaaagguuaccgaagugcgcggcuacacgaaggggggacccggccacgaggagccuguccccaugucuaccuauggguggaauauugugaaacucaugagcggaaaggacguuuucuaccugccgccugaaaaaugugauacacuucugugcgacaucggcgaguccagccccucucccaccguggaagaguccagaacaauucggguccucaagaugguggagccuuggcugaaaaacaaucaguuuuguaucaaggugcugaaccccuacaugccuaccgucaucgaacaccucgagcgccuucagagaaaguauggcgggaugcugguucggaauccgcugagcagaaacucuacacaugaaauguacuggauuuccaauggaaccggcaacaucgugagcucugugaauauggucagccgccuccugcuuaaccgguucacgaugacacacagacgccccaccauugagaaagauguggaccugggggcuggaacccggcauguuaacgccgaaccugagacacccaauauggacgugaucggcgagagaauuaagcgcaucaaagaagagcacuccucuacguggcacuaugaugacgaaaacccuuacaagaccugggcguaucaugggagcuacgaggucaaagccacaggauccgcuagcuccaugaucaauggcgugguuaagcuccugaccaagcccugggauguggucccgauggugacacaaauggccaugaccgacacaaccccuuuuggccagcagcggguuuucaaagaaaagguggauacgagaaccccccgcccuaugcccgggacacggaaagucauggagauuaccgcugaguggcuguggagaacacucggacgcaacaagaaaccucggcugugcaccagagaagaguuuacgaagaaggugcgcacaaaugccgcuaugggcgccgucuucaccgaagagaaccaaugggacucugcgagagccgcuguggaagaugaggaguuuuggaaacuuguugaccgggaacgcgagcugcacaagcucgggaaauguggaagcugcguguauaauaugaugggcaagagagaaaaaaagcugggggaguucggcaaagccaagggaucccgggcuaucugguacauguggcuuggcgccagauaccuggaguuugaagcccucggguuccugaacgaggaucauugguuuucucgggaaaauagcuauuccggagucgagggcgaagggcugcacaagcucggauacauucugcgcgacaucucuaaaauucccggcggggcgauguaugcugaugacacagccggcugggacaccagaaucacggaggaugaccuucauaacgaggaaaagaucacccagcagauggauccggagcaccggcagcuggccagcgcuauuuucaaacucacauaccaaaauaagguggugaaaguucagcgcccuacccccaagggaacagugauggacaucauuuccagaaaggaucagcggggcagcgggcaggucggaaccuauggccugaacacauuuaccaauauggaagcccaacuugugcgccagauggagggggaaggaguucugucuaaagcugaccucgagaacccccaccugcuggagaagaaaaucacgcaguggcucgaaacaaagggcguggagagacugaaacggauggccauuuccggggaugacugcgucgugaagccuaucgaugaccgcuucgcgaaugcccuucuggcucucaacgauaugggcaaggucagaaaagacaucccgcaguggcaacccagcaagggauggcaugauuggcagcaggugccuuucuguucucaccauuuucacgaacugauuaugaaagacggccggaagcuuguugugcccugccgcccucaggacgagcugaucgggagagcccggauuucccaaggagcuggcuggagccucaaagaaaccgccugucuggggaaggcguacgcccagauguggucucugauguauuuccaccgcagagaucuccggcuggcuuccaacgccaucugcagcgcuguccccgugcauuggguuccuaccuccagaacaaccuggagcauucacgcccaucaccaguggaugacaacggaggacaugcuuaccguguggaaucgcgucuggaucgaggauaaccccuggauggaagacaagacaccggugaccacaugggaggaugugccuuaccugggaaaacgggaagaccaaugguguggcucucucauugggcugaccagcagagcuacgugggcccagaauauccuuaccgcgauccagcagguucgcucccugauuggcgaugaggaguuucucgacuacaugcccucuaugaagcgguucagaaaagaagaggaaagcgagggagccaucugguga

SEQ ID NO: 20940 - RNA, 9873 nt, Artificial Sequence
  derived and/or modified CDS sequence (opt5) from DENV-3__DQ675530__SS-prME
accuccuucugccugaugaugaugcuccccgccacccuggcuuuucaccuuacgucccgggacggcgaaccucggaugauuguggggaagaacgaacgcggaaaaucucuccuguucaagaccgccagcggcauuaauauguguacccugaucgcgauggaucuuggggagaugugcgacgauaccgugacauacaaauguccgcugauugcugaaguugagcccgaagacaucgauugcugguguaaccucaccuccacaugggugaccuauggaacgugcaaucaggccggcgagcauagacgggacaagcgcucuguggcccuggcuccucacgucgggaugggacuggauaccagaacacagaccuggaugagcgccgagggcgcuuggcggcaggucgaaaaaguugagacaugggcccuccgccaucccggcuuuaccauucuggcgcuuuuccuggcccacuacaucgggacguccccuacacagaagguggucaucuuuauucuccugaugcuugugacccccucuaugacaaugagauguguuggagugggcaaccgggacuucgucgaagggcugagcggagcuaccuggguggaugugguccucgagcauggcgggugcguuaccacaauggccaagaauaaaccuacgcuggacaucgagcugcagaagaccgaagcuacacagcucgccacccugcgcaaacuuuguauugagggaaagaucacaaacauuaccacggauuccagaugcccgacacagggcgaagcgauccugcccgaggaacaggaccagaauuauguguguaaacacaccuacguggaucggggcugggggaacggaugcggccucuuugggaagggaagccuggugaccugcgccaaguuccaaugucuugagccuauugagggcaaagugguucaguaugaaaaucugaaguacacagugaucaucaccguccacacaggggaccagcaucaggugggaaacgacacgcaaggcguuaccguggagauuacaccccaggcuucuaccgucgaagccgugcucccugaguauggcacacuggggcuggaaugcagcccccgcaccggacucgauuuuaaugagaugauccugcuuacgaugaaaaacaaggcuuggaugguccacagacagugguucuuugaccugccgcucccuuggaccagcggcgccacaaccgagacacccaccuggaaucggaaagaacugcuugugacguucaagaacgcccaugcuaaaaagcaagagguugugguccuggggucucaggaaggagcgaugcacacagcccucaccggcgcuacagagauucaaaauuccgggggcaccagcaucuuugccggacaccugaagugucgccugaaaauggauaagcucgaacugaaaggcaugucuuacgccaugugccuuaacaccuucgugcugaagaaagagguuuccgagacacagcaugggacgauucucaucaagguggaauacaagggagaggacgcuccuuguaaaauccccuucagcaccgaagauggccaagggaaggcccacaacggaagacugauuacagcgaaucccgucgugaccaaaaaggaggagccugugaacaucgaagcugagccgcccuuuggcgaauccaauauuguuaucgggauuggcgacaaagcccugaagaucaacugguauaagaaaggaucuagcaucggcaagauguucgaggccacagcuagaggggccagacgcauggcuauucuuggagauaccgccugggacuuuggcuccgucgggggagugcucaauagccugggcaaaauggugcaucagaucuucgggucugcguacacggcccuguuuuccggcgucagcuggauuaugaagaucggaauuggcgugcuccugacauggaucgggcuuaacucuaaaaauaccagcauguccuucucuugcauuguuaucggaaucauuacccuguaucucggcgcugugguccaggccgauauggggugugugaucaacuggaagggaaaggaacugaaaugcggcagcgggauuuuuguuacaaaugaggugcacaccuggacagagcaguacaaguuccaagcugacuccccuaaacggcuggccacggcgaucgccggcgcuugggaaaacggagucuguggcauuagaagcaccacacgcauggagaaucuucucuggaagcagaucgccaacgaacugaauuauauccugugggagaacaauauuaaacucaccgugguugugggggauaucauuggaguccuggaacagggcaagcggacacuuacaccccagccuauggagcugaaauacucuuggaagacgugggggaaggcuaaaaucgugaccgccgagauucaaaacuccagcuuuaucaucgacggacccaacacaccggaaugcccuucugccuccagagcuuggaaugugugggaggucgaagacuauggcuucggcguuuuuaccacaaacauuuggcucaagcugcgcgagauguacacccagagcugugaucaucggcugauguccgcggccaucaaagacgaaagagcugugcacgccgauaugggguacuggauugagucucagaagaauggaagcuggaaacuugagaaggccuccuucaucgaagugaagacaugcaccuggcccaaaucucacacgcucuggagcaacggcguccuggaguccgacaugauuaucccuaagagccuggcugggcccaucucucagcauaaucaccgcccuggauaucauacacaaaccgccggccccuggcaccucgggaaacuggaacuugauuuuaacuacugcgagggaaccacagugguuauuaccgagaauuguggcacgcggggcccgucccugagaacaaccacagugagcgggaagcucauccacgaauggugcugucgcucuugcacccugccuccccugcgguauaugggagaggacggcuguugguacgggauggaaauuagacccaucaacgagaaagaagagaauauggucaagucccuugugagcgcgggaucuggcaagguugauaacuucacaaugggggugcucugccuggcuauucuguucgaggaagucaugcggggaaaauuuggcaagaaacauaugaucgugggcguucucuucaccuuugugcugcuucugagcgggcagauuacguggcgcgacauggcccacacccucaucaugaucggauccaaugccagcgauagaaugggcaugggggucacauaucuggcucugauugccaccuucaagauccagccuuuucuugcgcugggauucuuucuccggaaacugacaucuagagagaaccuccugcuuggcguggggcuggcuauggccaccacgcuccaacugccggaagacauugagcagauggccaauggaaucgcucugggccuuaugacacugaagcucauuacccaguucgaaacauaccagcuguggaccgcccucgugucccugaccuguagcaacacaaucuuuacgcuuaccgucgcuuggcgcacagccacccugauccucgcgggcguuucccugcugccccuuugccaaucuagcuccaugcggaagacagauuggcugccuaugaccguggccgcuaugggggugcccccucucccccuguucaucuuuucucucaaagacacgccuaagagacgcagcuggccccugaaugagggagucauggccgugggccuuguuuccauccuggcuucuagccugcucagaaacgaugugccgauggccgggccucuggucgccggaggccuucugauugcuuguuaugugaucacagggaccuccgcggaccucaccguugagaaagccgcugacgugacaugggaagaggaagccgagcagaccggagucagccauaaccugaugauuacaguggaugacgauggcacgaugcggaucaaggacgaugaaaccgagaauauccucacaguccugcuuaaaaccgcccugcugauugugucuggcaucuuccccuacuccauuccugcuacacuccugguuuggcacaccuggcagaagcagacgcaacgcagcggggugcuuugggacguccccucuccgccugagacccagaaagccgaacuggaggaaggaguguacagaaucaagcagcagggcauuuuugggaagacacaaguuggagugggcguccagaaagaggggguguuccauaccauguggcacgugacacggggagcgguucucacccacaacggcaagcgccuggagcccaauugggcuuccgucaaaaaggaucucaucagcuauggcgggggauggagacugucugcccaguggcaaaaaggcgaagagguccaggugauugccgucgaaccugggaagaaccccaagaauuuccagacaaugcccggaaucuuucagacgaccacaggcgagaucggggcuauugcccuugacuucaaaccuggaaccuccggcagcccgaucauuaaccgggaaggcaaggugguugggcuguacggaaauggcguggucaccaaaaacgggggauauguguccggcaucgcgcaaacaaaugcugagcccgaugggccuacgcccgagcuggaagaggaaauguuuaagaaacgcaaccucaccauuauggaccugcauccuggcagcggaaagacaagaaaguaccuucccgccaucguucgggaggccaucaaacgcagacugcggacccucauucuggcuccuacaagaguggucgccgcugaaauggaggaggcccucaagggccugccgauccgcuaucagaccacggcgacaaaaucugaacacaccgggcgggagauuguggaucuuaugugccaugccaccuucacaaugagacugcugagccccguucgcgugccuaauuacaaccucaucauuauggacgaagcucacuuuaccgaucccgccuccaucgcugcccggggauauaucucuacaagagucggcaugggggaggccgcugcgauuuucaugaccgccacgccucccggaacagcugaagccuuuccgcagagcaaugccccuauccaggacgaggagcgcgacauucccgaacgguccuggaacucuggcaaugaguggaucaccgauuucguggggaagacagugugguuuguccccagcauuaaagcuggcaacgacaucgccaacugucugagaaagaauggaaagaaaguuauucaacuuucccgcaagaccuucgauacggaauaccagaaaacccggcugaacgacugggauuuuguggugacaaccgacaucucugagaugggcgcgaauuucaaggcugauagagucaucgacccucggcgcugccucaaacccgugauucugacagaugggccugagagaguuauccuggccggaccgaugcccgugaccgccgcuagcgccgcgcagcggcgcggcagagucgggcggaacccucagaaggaaaaugaccaauacauuuucacaggacagccccucaacaaugaugaggaccaugcccacuggaccgaagcuaagaugcuucuggacaacaucaauacgccugagggcauuauccccgcccuguuugaaccggagagagagaaauccgcugccaucgauggggaauaucgccucaagggcgagagccggaaaacauucguggaacugaugagacgcggagaccuuccuguuuggcuggcucacaagguggccucugagggcauuaaauacaccgaucggaaguggugcuuugacggggaaagaaacaaucagauccucgaggagaacauggaugucgaaauuuggaccaaagagggagaacgcaagaagcugcggcccagauggcuggacgcgcgcacauauuccgauccucucgcccuuaaagaguucaaggacuuugcugccggcagaaaaagcaucgcucuggaucuggugaccgaaauugggcggguccccucucaucucgcccaccgcacaagaaaugcccuggacaaccuugugaugcugcauacguccgagcacggaggccgggcuuaccgccacgcgguugaggaacucccugagaccauggaaacacugcugcuccuuggccugaugauccugcucaccgggggagccaugcuguuccuuaucagcggcaaggggauuggaaaaacauccaucggccugauuugugugaucgugucuagcgggaugcucuggauggcugaugucccccugcaguggauugccuccgccaucguucuggaguuuuucaugauggugcuccuuauuccggagccugaaaagcaaagaacaccccaggacaaucagcuggcuuauguggucaucggaauccugacgcucgccgcgauuguggccgcuaacgagaugggccugcuugaaaccacaaagcgggaucugggcaugagcaaagagcccgggguugugucuccuaccuccuaccucgacgucgaccugcauccggccagcgcuuggacacuguaugccguggcgaccacggucaucacacccaugcucagacacaccauugaaaauucuacagccaacgugagccuugcugccaucgcuaaccaagccguugugcugaugggacuggauaagggcuggccuauuuccaaaauggaccucggggucccccugcuugcucugggaugcuacucucaggugaauccucucacccugaccgccgcgguucugcuccuugugacacauuacgccaucaucggccccgggcugcaggcuaaggccacgcgcgaggcucagaaacggaccgccgccggaauuaugaagaacccuacagucgauggcaucaugaccauugaccuggauccggugaucuaugacagcaaguuugagaaacaacucggccaggugaugcugcuuguucugugugcgguccagcuccugcugaugagaacauccugggcucucugcgaagcccuuacccuggcuacggggcccauuacaacccugugggagggaucuccuggcaaguucuggaauaccacaaucgccgugagcauggccaacaucuuucgcggguccuaccucgcuggagccggccuggcguucagcauuaugaaaucuguggggaccggacggagaggcacaggcucccagggggaaacgcuuggagagaaguggaaaaagaagcugaaucaacucagccggaaagaauuugaucuguauaagaaauccggcaucaccgaggucgaccgcacagaggccaaggaagggcugaaaagaggagagaccacacaccaugcuguuucucggggcagcgccaagcuccagugguucguggaacgcaacauggugauucccgaggggagagucaucgaucuuggauguggccggggcgggugguccuacuauugcgcuggacugaaaaaggugaccgaaguucgcggcuacacgaaaggcgggccugggcacgaggagcccgugccgaugucuaccuauggguggaauauugucaaacugaugagcggaaaggacguguucuaccucccucccgaaaaaugugauacacugcuuugcgacaucggcgaguccagccccucuccuaccguugaagaguccagaacaauucgggugcugaagauggucgagcccuggcucaaaaacaaucaguuuuguaucaaggugcugaacccuuacaugccgaccgugaucgaacaccuggagcgccuccagagaaaguauggcgggaugcuuguccggaauccccugagcagaaacucuacacaugaaauguacuggauuuccaauggaaccggcaacaucguuagcucugugaauauggugagccgccugcuccugaaccgguucacgaugacacacagacgcccuaccauugagaaagaugucgaccuuggggccggaacccggcaugugaacgcggaacccgagacaccuaauauggacguuaucggcgagagaauuaagcgcaucaaagaggaacacuccucuacguggcacuaugaugacgaaaaccccuacaagaccugggccuaucaugggagcuacgaggugaaagcuacaggauccgccagcuccaugaucaauggcgucgugaagcugcucaccaagccgugggauguugugccuauggucacacaaauggcuaugaccgacacaacccccuuuggccagcagcggguguucaaagaaaagguugauacgagaaccccucgccccaugccugggacacggaaagugauggagauuaccgccgaguggcuguggagaacacugggacgcaacaagaaaccccggcucugcaccagagaagaguuuacgaagaagguccgcacaaaugcugccaugggcgcgguguucaccgaagagaaccaaugggacucugccagagcugccgucgaagaugaggaguuuuggaaacugguggaccgggaacgcgagcuucacaagcuggggaaauguggaagcugcguuuauaauaugaugggcaagagagagaagaagcucggggaguucggcaaagcuaagggaucccgggccaucugguacauguggcugggcgccagauaccuugaguuugaagcgcugggguuccucaacgaggaucauugguuuucucgggaaaauagcuauuccggaguggagggcgaagggcugcacaagcugggauacauucuccgcgacaucucuaaaauuccgggcggggcuauguaugccgaugacacagccggcugggacaccagaaucacggaggaugaccugcauaacgaggaaaagaucacccagcagauggauccugagcaccggcagcuugcuagcgccauuuucaaacugacauaccaaaauaaggucgugaaagugcagcgccccacccccaagggaacaguuauggacaucauuuccagaaaggaucagcggggcagcggacaggugggaaccuauggccucaacacauuuaccaauauggaagcucaacugguccgccagauggagggggaaggagugcuuucuaaagccgaccuggagaacccucaccuccuggagaagaaaaucacgcaguggcuggaaacaaagggcguugagagacucaaacggauggcgauuuccggggaugacugcguggucaagccgaucgaugaccgcuucgccaaugcucugcuugcccugaacgauaugggcaaggugagaaaagacaucccccaguggcaaccuagcaagggauggcaugauuggcagcagguccccuucuguucucaccauuuucacgaacucauuaugaaagacggccggaagcuggugguuccuugccgcccccaggacgagcuuaucgggagagcucggauuucccaaggagccggcuggagccugaaagaaaccgcgugucucgggaaggccuacgcucagauguggucucugauguauuuccaccgcagagaucugcggcucgccuccaacgcuaucugcagcgccgugccuguccauugggugcccaccuccagaacaaccuggagcauucacgcucaucaccaguggaugacaacggaggacaugcugaccguuuggaaucgcguguggaucgaggauaacccguggauggaagacaagacaccugucaccacaugggaggaugugcccuaccuuggaaaacgggaagaccaaugguguggcucucugauugggcucaccagcagagccacgugggcgcagaauauccugaccgccauccaacaggugcgcucccuuauuggcgaugaggaguuucuggacuacaugccuucuaugaagcgguucagaaaagaagaggaaagcgagggagcuaucugguga

SEQ ID NO: 20941 - RNA, 9873 nt, Artificial Sequence
  derived and/or modified CDS sequence (opt5) from DENV-3__DQ675533__SS-prME
accagccugugccucaugaugauccugcccgccgcucuugccuuccaccugacaucccgggacggcgagccucggaugauuguggggaagaacgaacgcggaaagucucuccuguuuaagacggcgagcggcaucaauauguguacccuuauugcuauggaucugggggagaugugcgacgauacagugaccuacaaguguccgcauaucacagaaguugagcccgaagacauugauugcugguguaaccucaccuccacaugggugaccuauggaacgugcaaucaggccggcgagcaccggcgggacaagcgcucuguggcccuggcuccucauguugggaugggacuggauaccagaacacagaccuggaugagcgccgagggcgcuuggagacagguggaaaaaguugagacaugggcccuccgccaccccggcuucaccauccuggcgcuuuuucuggcccauuacaucgggacgucccucacacagaagguggugauuuucauccugcuuaugcuggugaccccuucuaugacaaugagauguguuggagugggcaaccgggacuuugucgaagggcucagcggagcuaccuggguggaugugguccuggagcacggcgggugcguuaccacaauggccaagaauaaacccacgcuggacauugagcuccagaagaccgaagcuacacagcuggccacccuucgcaaacuguguaucgagggaaagauuacaaacaucaccacggauuccagaugcccuacacagggcgaagcggugcucccggaggaacaggaccagaauuauguguguaaacacaccuacgucgaucggggcugggggaacggaugcggccuguucgggaagggaagccuugugaccugcgccaaguuucagugucuggagcccauugagggcaaaguugugcaguaugaaaaucucaaguacacagucaucaucaccgugcauacaggggaccagcaccagguuggaaacgagacgcaaggcgugaccgcugaaauuacaccucaggccucuacccaugaggcucugcugcccgaauauggcacacucgggcuggagugcuccccucgcaccggacuugacuucaaugagaugauccugcucacgaugaaaaacaaggccuggaugguccacagacagugguuuuucgaucugccccuuccgugggccagcggcgcuaccacagaaaccccuacauggaaucggaaagagcugcucgugaccuuuaagaacgcgcacgccaaaaagcaagaagucgugguucuggggucucaggagggagcuaugcauacggcccugacaggcgccaccgaaauucaaaauuccgggggcacaagcaucuucgcuggacaccucaagugucgccugaaaauggacaaacuugagcugaaaggcaugucuuacgccaugugcaccaacaccuuugugcucaagaaagaggucuccgaaacacagcaugggacgauucugaucaagguggaguacaagggagaagaugcgcccuguaaaaucccuuucagcaccgaggacggccaagggaaggcucacaacggaagacugauuacagccaaucccguugugaccaaaaaggaggaacccgucaacaucgaggccgaaccuccguucggcgaguccaauauugugaucgggauuggcgauaacgcucuuaaaaucaauugguauaagaagggaucuagcaucggcaaaauguuugaagccacagcuagaggggccagacgcauggcgauucucggagacaccgccugggauuucggcuccgucggagggguucugaacagccugggcaagaugguccaucagaucuuugggucugcuuacacggcccucuucuccggcgugagcugggugaugaaaauuggaaucggcguccugcuuacauggauugggcucaauucuaagaacaccagcauguccuuuucuugcaucgcuauuggaaucaucacccucuaucugggcgccgugguucaggcggacauggggugugugauuaauuggaaaggaaaggagcugaagugcggcagcgggaucuucgucacaaacgaggugcacaccuggacagaacaguacaaauuucaagccgauucccccaagcggcuugcuacggccauugcuggcgccugggagaauggaguuuguggcaucagaagcaccacacgcauggaaaaccuccuguggaaacagauugccaaugagcugaacuauauccucugggaaaauaacaucaagcugaccguggucgugggggacacacuuggaguucuggagcagggcaaacggacccucacgccucagcccauggagcugaaguacucuuggaaaaccugggggaaggcuaagauugugacagcggaaacccaaaacuccagcuucaucauugauggaccuaauacacccgagugcccgucugccuccagagcuuggaacgucugggaaguggaggacuauggcuuuggcguguucaccacaaauaucuggcugaaacuucgcgaagucuacacccagcucugugaccaccggcugaugagcgccgccguuaaggaugagagagcugugcaugccgacaugggguacuggauugagucccagaaaaacggaucuuggaagcuggaaaaagcgagccucaucgaggugaagacgugcacauggccuaagucccacacccuguggucuaauggcguccuugaaagcgauaugaucauucccaaaucccuggcugggccuaucagccagcauaacuaucgccccggauaccacacccaaacagccggcccuuggcaccucgggaagcuggagcuggacuuuaauuauugcgagggaaccacggugguuauuacagaaucuuguggcacccggggccccucccuuagaacaaccacagugagcgggaaacucauccaugaguggugcugucgcucuugcacccugccgccucugcgguacaugggagaagauggcuguugguaugggauggagauuagacccaucuccgaaaaggaggagaacauggucaaaagccucgugucugccggaagcggcaagguugacaauuucacgaugggggugcugugccuugcuauccuguuugaagagguccuccggggaaaguucggcaaaaagcacaugauugccggcguguucuuuaccuucguucugcugcuuuccgggcagaucacauggcgcgauauggcgcauacccugauuaugaucggaagcaacgcuucugacagaaugggcaugggggugacauaccucgcccugauugccaccuuuaaaauccagcccuuccucgcucugggauuuuuccuucggaagcugacguccagagaaaaucuccugcugggcgucgggcuugccauggcuacaacccugcaacucccugaggauauugaacagauggccaacggaaucgcgcugggccucauggcccugaaacuuaucacacaguuugagaccuaucagcuguggaccgcucucgugagccugacauguuccaauacgauuuucacccugacaguggccuggcgcaccgcuacacuuauccuggccggcgucucucuccugccgguuugccaaagcuccucuaugcggaagaccgacuggcuccccaugacgguggccgcuaugggggugccuccccugccucuucugauuuuuagccugaaggauacacucaaaagacgcuccuggccccugaacgagggagucauggcggugggccuuguuucuauccuggccagcucccuccugagaaaugacgugccuauggcugggccccucgucgccggaggccugcuuauugccuguuacgugaucaccgggaccagcgcugaucugacaguugaaaaggccgcggacgugaccugggaggaagaggcugaacagacaggagucucucacaaccugaugaucacgguggacgaugacggcaccaugcggauuaaagaugacgagacagagaacauccucaccguccugcuuaagacagcccugcucauuguguccggcaucuucccguacagcauuccugccacccugcucguuuggcauacguggcagaaacagacccaacgcucuggggugcugugggauguccccuccccucccgaaacacagaaggcugagcuugaagagggaguguauagaaucaaacagcagggcaucuuugggaagacccaaguuggagugggcguccagaaggaggggguguuccacacaauguggcacgugacccggggagccguucugacacauaauggcaaacgccuggaaccgaacugggcgagcgucaagaaagaccucauuucuuacggcgggggauggagacuguccgcucaguggcaaaagggcgaggaaguccaggugaucgccgucgagccugggaaaaaucccaagaacuuucagacgaugccuggaaccuuccagacaaccaccggcgaaauuggggccaucgcucuugauuucaagcccggaacaagcggcucccccauuaucaaucgggagggcaaagugguugggcuguauggaaacggcguggucacgaagaaugggggauacgugagcggcauugcccaaaccaacgcugagccugacgggccgacacccgaacucgaggaagagauguuuaaaaagcgcaaucugaccaucauggaucuccacccuggcucuggaaaaacaagaaaguaucugcccgccaucguucgggaagcgauuaagcgcagacuucggacccugauccuggccccuacgagaguggucgcugccgagauggaggaagcucucaaaggccugcccauucgcuaccagacaaccgccaccaagagcgagcauacagggcgggaaaucguggaccuuaugugccacgccaccuucacaaugagacugcucuccccuguucgcgugccgaacuauaaucugauuaucauggaugaggcucauuuuaccgaccccgcgucuaucgccgcucggggauacauuagcacgagagucggcaugggggaagccgccgcuaucuucaugacagccaccccucccggaacagcggaugcuuuuccucaguccaacgcccccauucaggacgaggagcgcgacaucccggaacggucuuggaauagcggcaacgaguggauuaccgauuucgccgggaaaacggugugguuugugccuuccaucaaggcuggcaaugacaucgccaacugucugcgcaaaaacggaaagaaggucauucaacucucuagaaaaaccuucgauacagaauaccagaagaccaaacuuaaugacugggauuuuguugugacaaccgacaucagcgagaugggcgcgaacuucaaggccgaucgggugauugaccccagacggugccugaaacccgucauccugacagaugggccugagcgcgugauucucgcuggacccaugccuguuaccgccgcuuccgccgcucagagacggggccgcguggggagaaauccgcagaaggaaaacgaccaauauaucuuuacgggacagccccugaauaacgaugaggaccacgcccacuggacagaagcgaagaugcuucuggacaauauuaacaccccugagggcaucauccccgcccucuucgaaccugagcgggagaaaagcgcugccauugauggggaauacagacugaagggcgagucucgcaaaaccuucgucgaacugaugcggagaggagaccuccccguguggcuugcucauaagguugccuccgagggcaucaaauauacagaucgcaaguggugcuuugacggggaacggaauaaccagauucuggaggagaauauggauguggaaaucuggaccaaagagggagaaagaaagaagcugcgcccgcgguggcucgacgccagaacauacagcgauccucuggcucuuaaagaguucaaggacuuugcggccggccgcaaaucuauugcucuggaucucgucacggaaaucgggagagugcccucccaccuggcccaucggacccgcaacgcccuggacaaucucgucaugcuucacacaagcgagcacggaggcagagcuuaucggcaugccguggaggaacugccugagaccauggaaacacugcuccugcuuggccugaugauccuccugaccgggggagcgaugcuguuccucauuuccggcaaggggaucggaaaaacgucuauuggccuuaucuguguuauugccagcuccgggaugcuguggauggcugaggugccccugcaguggaucgccagcgcuaucgugcucgaguuuuucaugaugguccugcuuauuccugaacccgagaagcaacgcaccccgcaggauaaccagcuggccuacguugugaucgggauucugacacuggcggccaucauugcugccaaugaaaugggccugcucgagaccacaaagagagaccuuggcaugucuaaagaaccugggguggucucccccaccagcuaucuggauguggaccugcaccccgcuucugccuggacgcucuacgcuguugccacaaccgugaucacaccuaugcugcggcauaccauugagaacagcaccgcgaaugucucccuugccgcuaucgccaaccaagcugugguccugaugggacucgacaagggcuggccgaucucuaaaauggaucugggggugccccugcucgcccuuggaugcuacagccagguuaacccucugacacugacggccgcggugcuccugcuuauuacccacuaugcuaucauuggccccgggcugcaggccaaggcuacaagagaggcccagaaacgcaccgccgcuggaaucaugaagaauccuacagucgacggcauuaugaccaucgaucucgaccccgugaucuacgauuccaaguuugaaaaacaacugggccagguuaugcugcucgugcuuugugccguccagcugcugcucaugcggacgucuugggcgcugugcgaggcccuuacacuggcuaccgggccuauuaccacacucugggaaggaagcccgggcaaguucuggaacaccacaaucgccguguccauggcuaauauuuuuagagggagcuaucuggccggagcgggccuggccuucucuaucaugaaauccguggggacgggaaagcgcggcaccggcagccagggggagacacucggagaaaaauggaagaagaaacuuaaccaacugucccggaaggaguuugaccuguacaaaaagucuggcauuaccgagguugauagaacagaagcuaaagaggggcucaagcggggagaaaccacgcaucacgccgucagccgcggcuccgcuaaacugcagugguucguggagagaaauauggugguccccgaagggcggguuaucgaccuuggauguggccgcggcggguggucuuauuacugcgccggacugaagaaggugaccgaggugagaggcuauacaaaagggggaccuggccacgaggaacccgucccuaugagcaccuacggguggaacaucgugaagcucauguccggaaaagaugucuuuuaccugcccccggagaagugugacacacugcucugcgauauuggcgaaagcucuccuucccccaccguggaggagagccggacaauccgcguccuuaaaaugguggaacccuggcugaagaauaaccaguucuguauuaagguucugaauccuuauaugcccaccgugaucgagcaucucgaaagacugcagcggaaacacggcgggaugcuuguccgcaacccucugucuagaaauuccacgcaugagauguacuggauuagcaacggaacaggcaauaucgugucuagcgugaacauggucucccggcuccugcugaauagauucaccaugacccaccgccggccgacaauugaaaaggacguugaucucggggcuggaacgagacacgugaacgccgagcccgagaccccuaacauggacgugaucggcgaacgcaucaaacggauuaaggaggaacauaauucuacauggcacuaugacgaugagaaccccuacaaaaccugggcguaucaugggagcuacgaagucaaggccacaggauccgcuagcuccaugaucaauggcgugguuaagcugcuuaccaaaccuugggacgugguccccauggugacacaaauggccaugaccgauacgaccccguuuggccagcagagaguuuucaaggagaaaguggacacacgcaccccucggcccaugccugggacaagaaaggucauggagauuaccgcugaauggcuguggcgcacgcucggacggaacaaaagaccccgccugugcacacgggaggaauuuaccaagaaggugagaacaaaugccgccaugggcgcgguuuucaccgaggaaaaccaaugggauucugcuaaagccgccguggaggacgaggaauuuuggaaacuugucgaucgcgagagagaacugcacaaacucgggaaguguggaagcugcguguauaauaugaugggcaaacgggagaagaaacugggggaguucggcaaggcuaagggaucccgcgccaucugguacauguggcugggcgcuagauaccucgaauuugaggcccugggguuccuuaacgaagaccauugguuuucucgggagaauagcuauuccggagucgaaggcgaggggcugcacaaacucggauacauucugagagauaucucuaagaucccuggcggggcgauguaugccgacgauacggcuggcugggacacccggauuacagaggacgaucuucacaacgaagagaaaaucauucagcagauggaccccgaacaucgccagcuggccaaugcuaucuucaagcucaccuaccaaaacaaagugguuaaggugcagagaccgacaccuaccggaacagucauggauauuaucagccggaaggaccagcgcggcuccggacaggugggaaccuauggccugaauacguuuacaaacauggaggcccaacuggugagacagauggaaggggagggaguucucaccaaagcggaucuggagaauccccaccuucuggaaaagaaaaucacccaguggcucgagacaaagggcguggaacggcugaaacgcauggccauuagcggggacgauugcgucgugaagcccaucgacgauagauucgcuaacgcccuucuggcucucaacgacaugggcaagguucggaaagauauuccucaguggcaaccgucuaagggauggcaugacuggcaacaggugcccuuuuguucccaccacuuccaugagcugaucaugaaagauggccgcaagcuggucgugccuugcagaccccaggacgaacucauugggcgggcccgcaucagccaaggagcuggcuggucucugagagagaccgccugucuugggaaagcguacgcccagauguggucccugauguauuuccaccggcgcgaccucagacuggcuagcaaugccaucugcucugccgucccugugcauuggguucccacaucccggacgaccuggagcauucacgcucaucaccaguggaugacaaccgaggauaugcuuacaguguggaacagagucuggaucgaagagaauccuuggauggaagacaagacccccgugacgaccugggagaacguuccguaccugggaaagcgcgaggaucaaugguguggcucccucauugggcugacaagccgggccaccugggcgcagaauaucccuacagcuauucaacaggugagaucucugaucggcaacgaagaguuucucgacuacaugcccagcaugaaacgcuuccggaaggaagaggaauccgagggagccauuugguga

SEQ ID NO: 20942 - RNA, 9873 nt, Artificial Sequence
  derived and/or modified CDS sequence (opt5) from DENV-3__AY744677__SS-prME
accagccucugccucaugaugaugcugcccgccacccuugcuuuccaccugacguccagagacggagagccucggaugaucguggggaagaacgaacgcggaaagucucuccuguuuaagaccgccagcggcauuaauauguguacccuuaucgcgauggaucugggggagaugugcgacgauaccgugacauacaaguguccgcucauuaccgaaguugagcccgaagacaucgauugcugguguaaccugacauccaccugggugacguauggaaccugcaaucaggcuggcgagcauagacgggacaagcgcucuguggcccuggccccucacguugggaugggacucgauacaagaacccagacauggaugagcgcugagggcgccuggagacagguggaaaaaguugagaccugggcuuuccgccaucccggcuuuacgauucuggcccuuuuccuggcgcacuacaucgggacaucccucacccagaagguggugaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccagcuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaagccguucagcacgaaaaucucaaguauaccgugauuaucacaguccauacgggggaccagcaccaggugggaaacgagacccaaggcguuacagcugaaaucacaccccaggccuccacaguggaggcuauucugccugaauacggcacccuggggcucgagugcagcccccgcacgggacuggacuuuaaugagaugauccuucugaccaugaaaaacaaggccuggaugguccauagacagugguucuuugaucucccucugcccuggacaucuggcgccaccacagaaaccccgacguggaauaaaaaggagcuucuggugacauucaaaaacgcucacgcgaagaagcaagaagucgugguucucgggucccaggagggagccaugcacaccgcucugacaggcgccaccgaaauucagaccagcgggggcacaucuaucuuugccggacaucugaaaugucggcucaagauggacaaacuggagcuuaagggcauguccuaugcuaugugccugaaugccuucgugcucaaaaaggaggucagcgaaacgcagcacgggaccauucugaucaagguggaguacaaaggagaagaugcgccuuguaagauccccuucuccacagaggacggccaagggaaagcucauaacggacgccugauuaccgccaacccuaucguuacaaagaaagaggaacccgugaauauugaggccgaacccccuuuuggcgagucuaacaucgucauugggaucggcgauaaggcucuuaagaucaauugguacaaaaagggaagcuccauuggcaaaauguucgaagccaccgcuagaggggcccggagaauggcgauccucggagacacggccugggauuuuggcagcgucgggggagugcugaacucucugggcaagaugguucaccagauuuucggguccgcuuauacagcccucuuuagcggcgucucuuggaucaugaaaauuggaaucggcgugcugcuuaccuggauugggcugaauagcaagaacaccuccaugucuuucagcugcaucgugaucggaauuaucacacucuaccugggcgcugucgugcaggccgacaugggguguguuauuaauuggaagggaaaagagcugaagugcggcuccgggaucuuugugaccaacgagguccauacauggacggaacaguauaaauuccaagcggauagcccgaagcgccuugccaccgcuauugccggcgcuugggagaauggaguguguggcauccggucuacaaccagaauggaaaaccuccuguggaaacagaucgccaaugagcugaacuacauucucugggaaaauaacaucaagcugacaauuguugugggggacgucaucggagugcuugagcagggcaaacgcacccugacgccccagccuauggagcucaaguauuccuggaagaccugggggaaagccaagauuguuacagcugaaacccaaaauagcucuuuuaucaucgauggacccaacacaccugagugccccuccgcgagccgggccuggaacgugugggaagucgaggacuacggcuucggcguguuuaccacaaauauuuggcugaaacugagagaaauguauacccagcuuugugaccaccgccucauguccgcugccgugaaggaugagcgggccguccacgcugacaugggguacuggaucgagucucagaaaaacggaagcuggaagcuggaaaaggccucccugauugagguuaaaacgugcacauggccgaagucucauacccucuggagcaauggcgugcuggaauccgauaugaucauuccuaaaagccuugcggggcccaucucucagcacaacuacagaccuggauaucauacccaaacagcuggccccuggcaccuggggaagcucgagcuggacuucaauuacugcgagggaaccacgguggucaucacagaaaacuguggcacccgcggcccuucccugcggacaaccacagugagcgggaaacuuauucacgaguggugcuguagaucuugcacccugcccccgcugcgcuauaugggagaagauggcuguugguacgggauggagauccggccuauuaaugaaaaggaggagaacaugguuaagucccuggugagcgccggaucuggcaaagccgacaauuuuacgauggggguccucugccuggcuauccuuuucgaagaggugaugagaggaaaguucggcaaaaagcauaugauugccggcgcgcuguuuaccuucguucuccugcugagcgggcagaucacauggcgggauauggcucacacccuuauuaugaucggauccaacgccagcgaccgcaugggcaugggggugacauaucuggcccucaucgcuaccuuuaaaauucagcccuuccuggcccucggauuuuuccugagaaaacuuacgucucgggaaaaucugcuccugggcgucgggcuggcuauggccacaacccuucaacugcccgaggauaucgaacagauggcgaacggaauugcccucggccugauggcucucaagcugaucacacaguuugagaccuaccagcuuuggaccgcccuggugucccucauguguagcaauacaauuuucacgcugaccguugcuuggagaacagccacccugauccuugccgugaucucccugcucccugucugccaaucuagcuccaugcgcaaaacagacuggcugccgaugaccguggcugcgaugggcgugcccccucucccccuguuuauuuucucucuuaaggauacgcugaaacggagaagcuggccucugaacgagggggucauggccguuggacucguguccauccuggcuucuagcuuucuucgcaaugacgugcccauggccggcccucuggucgccgggggacuccugauugcuuguuaugugaucacaggcaccuccgccgaucucaccguugaaaaggcggcugacgugacaugggaggaagaggccgaacagaccggggucagccauaaccugaugauuacaguggacgaugacggaacgaugagaaucaaagaugacgagaccgagaacauccuuacaguucugcugaagaccgcccuccugauugugucuggcaucuuccccuacuccauuccggcuacacuucuggucuggcacaccuggcagaaacagacgcaacggagcggcgugcucugggaugucccuucucccccugaaacccagaaggccgagcuggaagaggggguguaccgcaucaagcagcagggaauuuuuggcaaaacacaaguuggggugggaguccagaaggagggcguguuccauaccauguggcacguuacaagaggggcggugcucacccacaauggaaaacggcuggaacccaacugggcuaaugucaagaaagaccuuaucuccuauggcggcggguggaagcugagcgcccaguggcaaaagggagaggaaguccaggugauugccguugagccgggcaaaaacccuaagaauuuccagacaaugcccgggaucuuucagacgaccacaggagaaaucggcgcuauugcccuggauuucaaaccugggaccucuggaucccccaucauuaaccgcgagggcaaggucgugggccucuacgggaauggaguggucaccaaaaacggcggguaugugagcggaaucgcucaaacaaaugccgagcccgacggcccuacgccggaacuggaggaagagauguuuaagaagagaaaccuuaccauuauggaucugcaucccggguccggcaaaacacggaaguaccucccugcgaucguucgcgaagccaucaaaagacggcugcgcacccucauucuggcucccacaagaguggucgccgcugagauggaggaagcccuuaagggacugccuauccgguaucagaccacggccacaaaaagcgagcacaccggcagagaaauuguggaccugaugugccaugcuaccuucacaaugcgccuccugucucccguucgggugccuaauuacaaccuuaucgucauggaugaggcgcacuuuaccgacccggccagcauugcugccagaggguauaucuccacacgcgugggaaugggcgaagccgcugccaucuucaugaccgcgacgcccccugggacagcugaugccuuuccccagucuaaugccccuauucaggacgaggagcgggacauccccgaaagaagcuggaacuccggaaaugaguggauuaccgauuucgcuggcaagacaguuugguuugugccgucuaucaaggccgggaacgacauugcgaacugucugcgcaaaaauggcaagaaagucauccaacucagccggaagaccuucgauacggaauaccagaaaaccaagcugaacgacugggauuuuguggugacaaccgacauuuccgagaugggagccaauuucaaggcugauagagucaucgacccucgccggugccugaaacccguuauccucacagauggccccgagagagugauucuugccgggccuaugcccgugaccgucgcuucugccgcucagcggcgcggaagagugggccggaacccucagaaggaaaaugaccaauacaucuucacagggcagccgcugaacaaugaugaggaccaugcccacuggaccgaagcgaaaaugcugcucgacaacauuaauacgcccgagggaaucauuccugcccuguuugaacccgagcgcgaaaagagcgcugccaucgauggcgaauauagacuuaaaggggagucccggaagacauucguugaacugaugagacgcggcgaccucccuguguggcuggcucacaaagucgccagcgagggaaucaaguacaccgaucggaaguggugcuuugacggcgaaagaaacaaucagauucuggaggagaacauggauguggaaaucuggaccaaagagggggaaaagaaaaagcuccgcccccgguggcuugacgccagaacauauucugauccgcuggcucugaaagaguucaaggacuuugcggccggacgcaaguccauugcucucgaucugguuaccgaaaucggccgggugccuagccaucuugcccacagaacacgcaaugcccuggacaaccucgucaugcugcauacgucugagcacgggggccgggcuuaccggcacgccguggaggaacugcccgagaccauggaaacacuccuucugcugggccucaugauucugcuuaccggcggggcgaugcuguuccucaucuccggaaaaggcaucgggaagacaagcauuggacugaucugugucguggccuccucuggcaugcuguggauggcugauguuccucuccaguggauugccagcgcuaucgugcuugaguuuuucaugauggugcugcugauucccgagccugaaaaacaacgcacaccccaggacaaucagcucgccuaugucguuaucgggauucugacgcuugcggccaucguggcugccaacgagaugggacugcucgaaaccacaaagagagaucugggcauguccaaagagccgggcguggucagcccuaccucuuaccuggacguggaccuccaucccgcuuccgccuggacacuuuaugcuguugccaccacggugaucacacccaugcugcggcacaccauugaaaauagcacagcgaacgucucucuggccgcuaucgccaaccaagcugugguccucauggggcuggauaagggauggccuauuagcaagauggaccuuggcgugccgcugcucgcccuggggugcuacucccagguuaauccccugacccucaccgccgcggugcuucugcuggucacacauuacgcuaucauuggaccuggccuccaggccaaagcuacgcgcgaggcccagaagagaaccgccgcugggaucaugaaaaaccccacaguggauggaaucaugaccauugaccuggauccuguuaucuaugacucuaaguuugagaaacaacuuggccaggugaugcugcucguccugugugccgugcagcugcuccuuaugcggacaagcugggcguucugcgaagcccugacccuggcuacgggccccauuacaacccucugggagggguccccuggaaaguuuuggaauaccacaaucgccgugucuauggcuaacauuuucagaggcagcuaccuggccggggcgggacuugccuuuuccaucaugaaaagcguuggcaccgggaaacgcggaacaggcucucagggcgaaacgcugggggagaaguggaaaaagcggcucaaucaacuguccagaaaagaguucgaucuguauaagaaaagcggaaucaccgaggucgaccgcacagaggcuaaggaaggccucaagagaggggaaauuacccaccaugccgugucccggggaucugcuaaacuucagugguucguggaacggaacauggucaucccggagggccgcguuauugaucugggguguggaagaggcggcuggagcuacuauugcgccgggcugaagaaagugacagaagugcggggauacaccaagggcgggcccggacacgaggagccuguccccauguccacguauggcuggaauaucgugaaacucaugucugggaaggacgucuuuuaccugccucccgaaaagugugauacccuucugugcgacauuggagagagcuccccgagcccuacaguggaagagucucgcaccaucagaguccucaaaaugguggagcccuggcugaagaacaaucaguucuguauuaaaguucugaaccccuacaugccuacagugaucgaacaccucgagcggcuucagcgcaagcauggcggcaugcuggucagaaauccccugucccggaacagcacccacgaaauguauuggaucucuaaugggacaggaaacauuguguccagcgugaauauggucucucgccuccugcuuaacagauuuaccaugacgcaucggagaccuacaaucgagaaagauguugaccugggcgcugggacccgccacgugaacgccgaaccggagacccccaauauggacgugauuggagagcggaucagacgcauuaaggaggaacacagcuccacauggcauuacgaugacgaaaacccuuauaagacgugggcguaccacggcucuuaugaggucaaagccaccgggagcgcuuccagcaugaucaauggagugguuaagcuccugacaaaacccugggauguggucccuauggugacccaaauggccaugacagacaccacacccuucggccagcagcggguuuuuaaggaaaaaguggauaccagaacgccgcgcccuaugcccggcacccggaaggucauggagaucacagcugaguggcuguggagaacccucgggcgcaacaagcggccuagacugugcacacgcgaagaguucauuaaaaaggugcggaccaaugccgccaugggagcgguuuuuacggaagagaaccaaugggacuccgcuagagccgccguggaagaugaggaguucuggaaacuugucgaccgcgaaagagagcugcauaagcucggcaaaugugggucuugcguguacaauaugaugggaaagcgggagaagaagcugggcgaguuugggaaggcuaaaggcagccgcgccaucugguauauguggcuuggagcuagauaccuggaguucgaagcccucggcuuucugaacgaggaucacugguucucccgggaaaauucuuacagcggggucgagggagaaggccugcauaagcucggguauauucugagagacaucuccaaaauucccggaggcgcgauguacgccgaugacacagcugggugggacacccggaucacagaggaugaccuucacaacgaggaaaagaucacccagcagauggauccugagcaccgccagcuggccaaugcuauuuuuaaacucacguaucaaaacaaggugguuaaggugcagagacccaccccgaaaggcacagucauggacaucauuucucggaaggaucagcgcggaagcggccagguggggaccuacggacugaauacauucaccaacauggaagcccaacuuaucagacagauggagggcgaaggggugcuguccaaagcggaccucgagaauccucaucugcuggagaagaaaguuacacaguggcucgaaaccaagggaguggagcggcugaagcgcauggccauuagcggcgaugacugcgucgugaaacccaucgaugacagauucgcuaacgcccuucuggcucucaacgauauggggaagguucggaaagacaucccccaguggcaaccuucuaagggcuggcacgauuggcaacaggugccguuuuguucccaucacuuccacgaacugauuaugaaagacggacgcaaacuugucgugcccugcagaccucaggacgagcugaucggccgggcccgcauuagccaaggggcuggauggucucucagagaaacggccugucugggcaaggcguaugcccagaugugggcucugauguacuuucaucggcgcgaucucagacuggccuccaaugccaucugcagcgcuguccccgugcacuggguuccuacaucucggaccaccugguccauucaugcccaccaucaguggaugacaaccgaggacaugcuuacaguguggaacagagucuggaucgaggauaaucccuggauggaagacaaaacgccugugaccacaugggaggauguucccuaucuggggaagcgcgaagaccaaugguguggaagccucauuggccugaccucccgggcgacaugggcucagaacauccuuaccgccauccaacaggugagaagccugauugggaaugaggaguuccucgauuacaugccgucuaugaaacgcuuucggaaggaagaggaaagcgagggcgccaucugguga

SEQ ID NO: 20943 - RNA, 9873 nt, Artificial Sequence
  derived and/or modified CDS sequence (opt5) from DENV-3__AY744678__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagaacccaaacauggaugagcgcugagggcgccuggcggcagguggaaaaaguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccaacuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaagccguucagcacgaaaaucucaaguauaccgugauuaucacaguccauacgggggaccagcaccaggugggaaacgagacccaaggcguuacagcugaaaucaccccccaggccuccacaguggaggcuauucugccugaauacggcacccuggggcucgagugcagcccccgcacgggacuggacuuuaaugagaugauccuucugaccaugaaaaacaaggccuggaugguccauagacagugguucuuugaucucccucugcccuggacaucuggcgccaccacagaaaccccgacguggaauaaaaaggagcuucuggugacauucaaaaacgcucacgcgaagaagcaagaagucgugguucucgggucccaggagggagccaugcacaccgcucugacaggcgccaccgaaauucagaccagcgggggcacaucuaucuuugccggacaucugaaaugucggcucaagauggacaaacuggagcuuaagggcauguccuaugcuaugugccugaaugccuucgugcucaaaaaggaggucagcgaaacgcagcacgggaccauucugaucaagguggaguacaaaggagaagaugcgccuuguaagauccccuucuccacagaggacggccaagggaaagcucauaacggacgccugauuaccgccaacccuaucguuacaaagaaagaggaacccgugaauauugaggccgaacccccuuuuggcgagucuaacaucgucauugggaucggcgauaaggcucuuaagaucaauugguacaaaaagggaagcuccauuggcaaaauguucgaagccaccgcuagaggggcccggagaauggcgauccucggagacacggccugggauuuuggcagcguggggggagugcugaacucucugggcaagaugguucaccagauuuucggguccgcuuauacagcccucuuuagcggcgucucuuggaucaugaaaauuggaaucggcgugcugcuuaccuggauugggcugaauagcaagaacaccuccaugucuuucagcugcaucgugaucggaauuaucacacucuaccugggcgcugucgugcaggccgacaugggguguguuauuaauuggaagggaaaagagcugaagugcggcuccgggaucuuugugaccaacgagguccauacauggacggaacaguauaaauuccaagcggauagcccgaagcgccuugccaccgcuauugccggcgcuugggagaauggaguguguggcauccggucuacaaccagaauggaaaaccuccuguggaaacagaucgccaaugagcugaacuacauucucugggaaaauaacaucaagcugacaauuguugugggggacgucaucggagugcuugagcagggcaaacgcacccugacgccccagccuauggagcucaaguauuccuggaagaccugggggaaagccaagauuguuacagcugaaacccaaaauagcucuuuuaucaucgauggacccaacacaccugagugccccuccgcgagccgggccuggaacgugugggaagucgaggacuacggcuucggcguguuuaccacaaauauuuggcugaaacugagagaaauguauacccagcuuugugaccaccgccucauguccgcugccgugaaggaugagcgggccguccacgcugacaugggguacuggaucgagucucagaaaaacggaagcuggaagcuggaaaaggccucccugauugagguuaaaacgugcacauggccgaagucucauacccucuggagcaauggcgugcuggaauccgauaugaucauuccuaaaagccuugcggggcccaucucucagcacaacuacagaccuggauaucauacccaaacagcuggccccuggcaccuggggaagcucgagcuggacuucaauuacugcgagggaaccacgguggucaucacagaaaacuguggcacccgcggcccuucccugcggacaaccacagugagcgggaaacuuauucacgaguggugcuguagaucuugcacccuccccccgcugcgcuauaugggagaagauggcuguugguacgggauggagauccggccuauuaaugaaaaggaggagaacaugguuaagucccuggugagcgccggaucuggcaaagccgacaauuuuacgauggggguccucugccuggcuauccuuuucgaagaggugaugagaggaaaguucggcaaaaagcauaugauugccggcgcgcuguuuaccuucguucuccugcugagcgggcagaucacauggcgggauauggcucacacccuuauuaugaucggauccaacgccagcgaccgcaugggcaugggggugacauaucuggcccucaucgcuaccuuuaaaauucagcccuuccuggcccucggauuuuuccugagaaagcuuacgucucgggaaaaucugcuccugggcgucgggcuggcuauggccacaacccuucaacugcccgaggauaucgaacagauggcgaacggaauugcccucggccugauggcucucaagcugaucacacaguuugagaccuaccagcuuuggaccgcccuggugucccucauguguagcaauacaauuuucacgcugaccguugcuuggagaacagccacccugauccuugccgugaucucccugcucccugucugccaaucuagcuccaugcgcaaaacagacuggcugccgaugaccguggcugcgaugggcgugcccccucucccccuguuuauuuucucucuuaaggauacgcugaaacggagaagcuggccucugaacgagggggucauggccguuggacucguguccauccuggcuucuagcuuucuucgcaaugacgugcccauggccggcccucuggucgccgggggacuccugauugcuuguuaugugaucacaggcaccuccgccgaucucaccguugaaaaggcggcugacgugacaugggaggaagaggccgaacagaccggggucagccauaaccugaugauuacaguggacgaugacggaacgaugagaaucaaagaugacgagaccgagaacauccuuacaguucugcugaagaccgcccuccugauugugucuggcaucuuccccuacuccauuccggcuacacuucuggucuggcacaccuggcagaaacagacgcaacggagcggcgugcucugggaugucccuucucccccugaaacccagaaggccgagcuggaagaggggguguaccgcaucaagcagcagggaauuuuuggcaaaacacaaguuggggugggaguccagaaggagggcguguuccauaccauguggcacguuacaagaggggcggugcucacccacaauggaaaacggcuggaacccaacugggcuaaugucaagaaagaccuuaucuccuauggcggcggguggaagcugagcgcccaguggcaaaagggagaggaagugcaggugauugccguugagccgggcaaaaacccuaagaauuuccagacaaugcccgggaucuuucagacgaccacaggagaaaucggcgcuauugcccuggauuucaaaccugggaccucuggaucccccaucauuaaccgcgagggcaaggucgugggccucuacgggaauggaguggucaccaaaaacggcggguaugugagcggaaucgcucaaacaaaugccgagcccgacggcccuacgccggaacuggaggaagagauguuuaagaagagaaaccuuaccauuauggaucugcaucccggguccggcaaaacacggaaguaccucccugcgaucguucgcgaagccaucaaaagacggcugcgcacccucauucuggcucccacaagaguggucgccgcugagauggaggaagcccuuaagggacugccuauccgguaucagaccacggccacaaaaagcgagcacaccggcagagaaauuguggaccugaugugccaugcuaccuucacaaugcgccuccugucucccguucgggugccuaauuacaaccuuaucgucauggaugaggcgcacuuuaccgacccggccagcauugcugccagaggguauaucuccacacgcgugggaaugggcgaagccgcugccaucuucaugaccgcgacgcccccugggacagcugaugccuuuccccagucuaaugccccuauucaggacgaggagcgggacauccccgaaagaagcuggaacuccggaaaugaguggauuaccgauuucgcuggcaagacaguuugguuugugccgucuaucaaggccgggaacgacauugcgaacugucugcgcaaaaauggcaagaaagucauccaacucagccggaagaccuucgauacggaauaccagaaaaccaagcugaacgacugggauuuuguggugacaaccgacauuuccgagaugggagccaauuucaaggcugauagagucaucgacccucgccggugccugaaacccguuauccucacagauggccccgagagagugauucuugccgggccuaugcccgugaccgucgcuucugccgcucagcggcgcggaagagugggccggaacccucagaaggaaaaugaccaauacaucuucacagggcagccgcugaacaaugaugaggaccaugcccacuggaccgaagcgaaaaugcugcucgacaacauuaauacgcccgagggaaucauuccugcccuguuugaacccgagcgcgagaagagcgcugccaucgauggcgaauauagacuuaaaggggagucccggaagacauucguugaacugaugagacgcggcgaccucccuguguggcuggcucacaaagucgccagcgagggaaucaaguacaccgaucggaaguggugcuuugacggcgaaagaaacaaucagauucuggaggagaacauggauguggaaaucuggaccaaagagggggaaaagaaaaagcuccgcccccgguggcuugacgccagaacauauucugauccgcuggcucugaaagaguucaaggacuuugcggccggacgcaaguccauugcucucgaucugguuaccgaaaucggccgggugccuagccaucuugcccacagaacacgcaaugcccuggacaaccucgucaugcugcauacgucugagcacgggggaagagcuuaccggcacgccguggaggaacugcccgagaccauggaaacacuccuucugcugggccucaugauucugcuuaccggcggggcgaugcuguuccucaucuccggaaaaggcaucgggaagacaagcauuggacugaucugugucguggccuccucuggcaugcuguggauggcugauguuccucuccaguggauugccagcgcuaucgugcuugaguuuuucaugauggugcugcugauucccgagccugaaaaacaacgcaccccccaggacaaucagcucgccuaugucguuaucgggauucugacgcuugcggccaucguggcugccaacgagaugggacugcucgaaaccacaaagagagaucugggcauguccaaagagccgggcguggucagcccuaccucuuaccuggacguggaccuccaucccgcuuccgccuggacacuuuaugcuguugccaccacggugaucacacccaugcugcggcacaccauugaaaauagcacagcgaacgucucucuggccgcuaucgccaaccaagcugugguccucauggggcuggauaagggauggccuauuagcaagauggaccuuggcgugccgcugcucgcccuggggugcuacucccagguuaauccccugacccucaccgccgcggugcuucugcuggucacacauuacgcuaucauuggaccuggccuccaggccaaagcuacgcgcgaggcccagaagagaaccgccgcugggaucaugaaaaaccccacaguggauggaaucaugaccauugaccuggauccuguuaucuaugacucuaaguuugagaaacaacuuggccaggugaugcugcucguccugugugccgugcagcugcuccuuaugcggacaagcugggcguucugcgaagcccugacccuggcuacgggccccauuacaacccucugggagggguccccuggaaaguuuuggaauaccacaaucgccgugucuauggcuaacauuuucagaggcagcuaccuggccggggcgggacuugccuuuuccaucaugaagagcguuggcaccgggaaacgcggaacaggcucucagggcgaaacgcugggggagaaguggaaaaagaaacucaaucaacugucccggaaggaauucgaucuguauaaaaagagcggaaucaccgaggucgacagaacagaggcuaaggaaggccucaaacgcggggagauuacccaccaugccgugucccggggaucugcuaagcuucagugguucguggaaagaaacauggucaucccggagggccggguuauugaucugggguguggacgcggcggcuggagcuacuauugcgccgggcugaaaaaggugacagaagugagaggauacaccaaaggcgggcccggacacgaggagccuguccccauguccacguauggcuggaauaucgugaagcucaugucugggaaggacguuuuuuaccugccucccgaaaaaugugauacccuucugugcgacauuggagagagcuccccgagcccuacaguggaagagucucggaccauccgcguccucaagaugguggagcccuggcugaaaaacaaucaguucuguauuaagguucugaaccccuacaugccuacagugaucgaacaccucgagagacuucagcggaaacauggcggcaugcugguccgcaauccccuguccagaaacagcacccacgaaauguauuggaucucuaaugggacaggaaacauuguguccagcgugaauauggucucucggcuccugcuuaaccgcuuuaccaugacgcauagacggccuacaaucgagaaggauguugaccugggcgcugggaccagacacgugaacgccgaaccggagacccccaauauggacgugauuggagagcgcauccggagaauuaaggaagagcacagcuccacauggcauuacgaugacgaaaacccuuauaaaacgugggcguaccacggcucuuaugaggucaaggccaccgggagcgcuuccagcaugaucaauggagugguuaaacuccugacaaagcccugggauguggucccuauggugacccaaauggccaugacagacaccacacccuucggccagcagcgcguuuuuaaagaaaagguggauacccggacgccgagaccuaugcccggcacccgcaaggucauggagaucacagcugaguggcuguggcggacccucgggagaaacaaacgcccucggcugugcacaagagaagaguucauuaagaaagugcgcaccaaugccgccaugggagcgguuuuuacggaagagaaccaaugggacuccgcucgggccgccguggaagaugaggaguucuggaagcuugucgacagagaacgcgagcugcauaaacucggcaagugugggucuugcguguacaauaugaugggaaaaagagaaaagaagcugggcgaguuugggaaagcuaagggcagccgggccaucugguauauguggcuuggagcucgcuaccuggaguucgaagcccucggcuuucugaacgaggaucacugguucuccagagaaaauucuuacagcggggucgagggagaaggccugcauaaacucggguauauucugcgggacaucuccaagauucccggaggcgcgauguacgccgaugacacagcugggugggacaccagaaucacagaggaugaccuucacaacgaggaaaaaaucacccagcagauggauccugagcaccggcagcuggccaaugcuauuuuuaagcucacguaucaaaacaaggugguuaaagugcagcgccccaccccgaagggcacagucauggacaucauuucuagaaaagaucagcggggaagcggccagguggggaccuacggacugaauacauucaccaacauggaagcccaacuuauccgccagauggagggcgaaggggugcuguccaaggcggaccucgagaauccucaucugcuggagaaaaagguuacacaguggcucgaaaccaagggaguggagagacugaaacggauggccauuagcggcgaugacugcgucgugaagcccaucgaugaccgcuucgcuucugcccuucuggcucucaacgauauggggaaaguuagaaaggacaucccccaguggcaaccuuccaaaggcuggcacgauuggcagcaggugccguuuuguagccaucacuuccacgaacugauuaugaaggacggacggaagcuugucgugcccugccgcccucaggacgagcugaucggcagagcccggauuucucaaggggcuggauggucccuccgcgaaacggccugucugggcaaagcguaugcccagaugugggcucugauguacuuucauagacgggaucuccgccuggccagcaacgccaucugcucugcuguccccgugcacuggguuccuacauccagaaccaccuggagcauucaugcccaccaucaguggaugacaaccgaggacaugcuuacaguguggaaucgggucuggaucgaggauaaccccuggauggaagacaagacgccugugaccacaugggaggauguucccuaucuggggaaaagagaagaccaaugguguggaucccucauuggccugaccagccgcgcgacaugggcucagaauauccuuaccgccauccagcaggugcggucucugauugggaacgaggaguuccucgauuacaugccgagcaugaagagauuucgcaaagaagaggaauccgagggcgccaucugguga

SEQ ID NO: 20944 - RNA, 9873 nt, Artificial Sequence
  derived and/or modified CDS sequence (opt5) from DENV-3__AY744679__SS-prME
accagccugugccucaugaugaugcugcccgccacccuugcuuuccaccugacguccagagacggagaaccucggaugaucguggggaagaacgaacgcggaaaaucucuccuguuuaagaccgccagcggcauuaauauguguacccuuaucgcgauggaucugggggaaaugugcgacgauaccgugacauacaaauguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagaacccaaacauggaugagcgcugagggcgccuggcggcaaguggaaaaaguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccaacuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaaguugugcagcacgaaaaucucaaguauaccgucauuaucacagugcauacgggggaccagcaccagguuggaaacgagacccaaggcgugacagccgaaaucacaccccaggcuuccacagucgaggccauucugccugaauacggcacccuggggcucgagugcagcccccgcacgggacuggacuuuaaugagaugauccuucugaccaugaaaaacaaggcuuggauggugcauagacagugguucuuugaucucccucugcccuggacaucuggcgccaccacagaaaccccgacguggaauaaaaaggagcuucuggucacauucaaaaacgcccacgcuaagaagcaagaagugguugugcucgggucccaggagggagcgaugcacaccgcccugacaggcgcuaccgaaauucagaccagcgggggcacaucuaucuuugccggacaucugaaaugucggcucaagauggacaaacuggagcuuaagggcauguccuaugccaugugccugaaugcuuucguccucaaaaaggaggugagcgaaacgcagcacgggaccauucugaucaagguugaguacaaaggagaagaugccccuuguaagauccccuucuccacagaggacggccaagggaaagcgcauaacggacgccugauuaccgcuaacccuaucgugacaaagaaagaggaacccgucaauauugaggccgaacccccuuuuggcgagucuaacaucgugauugggaucggcgauaaggcccuuaagaucaauugguacaaaaagggaagcuccauuggcaaaauguucgaagcuaccgccagaggggcucggagaauggccauccucggagacacggcgugggauuuuggcagcgucgggggaguucugaacucucugggcaagaugguccaccagauuuucggguccgccuauacagcucucuuuagcggcgugucuuggaucaugaaaauuggaaucggcgugcugcuuaccuggauugggcugaauagcaagaacaccuccaugucuuucagcugcaucgucaucggaauuaucacacucuaccugggcgccgugguucaggcugacauggggugugugauuaauuggaagggacaggagcugaaaugcggcuccgggaucuuugucaccaacgaggugcauacauggacggaacaauauaaguuccaggccgauagcccgaaacgccuugcgaccgccauugcuggcgccugggagaauggaguuuguggcauccggucuacaaccagaauggaaaaccuccuguggaagcagaucgcuaaugagcugaacuacauucucugggaaaauaacaucaaacugacaguggucgugggggacguuauuggagugcuugagcagggcaagcgcacccugacgccccaaccuauggagcucaaauauuccuggaagaccugggggaaggccaaaaucgucacagccgaaacccagaauagcucuuuuauuaucgauggacccaacacaccugagugccccuccgcuagccgggcguggaacgugugggaaguggaggacuacggcuucggcgucuuuaccacaaauaucuggcugaagcugagagaaauguauacccagcuuugugaccaccgccucauguccgccgcuguuaaagaugagcgggccgugcacgccgacaugggguacuggauugagucucagaagaacggaagcuggaaacuggaaaaggcuucccugaucgaggugaagacgugcacauggccgaaaucucauacccucuggagcaauggcguccuggaauccgauaugauuaucccuaagagccuugccgggcccauuucucaacacaacuacagaccuggauaucauacccagacagcgggccccuggcaccuggggaaacucgagcuggacuucaauuacugcgagggaaccacggugguuaucacagaaaacuguggcacccgcggcccuucccugcggacaaccacagugagcgggaaacuuauccacgaguggugcuguagaucuugcacccugcccccgcugcgcuauaugggagaagauggcuguugguacgggauggagauucggccuaucaaugaaaaagaggagaacauggucaagucccuggugagcgcuggaucuggcaaggccgacaauuuuacgauggggguucucugccuggccauucuuuucgaagaggugaugagaggaaaauucggcaagaaacauaugaucgcuggcgcccuguuuaccuucguccuccugcugagcgggcagauuacauggcgggauauggcgcacacccuuaucaugauuggauccaacgcuagcgaccgcaugggcaugggggugacauaucuggcccucaucgccaccuuuaagauccaacccuuccuggcucucggauuuuuccugagaaaacuuacgucucgggaaaaucugcuccugggcguugggcuggccauggcuacaacccuucagcugcccgaggauauugaacagauggccaacggaaucgcgcucggccugauggcccucaagcugauuacacaguuugagaccuaccaacuuuggaccgcucuggugucccucauguguagcaauacaaucuucacgcugaccgucgccuggagaacagcuacccugauucuugccgugaucucccugcucccugugugccagucuagcuccaugcgcaagacagacuggcugccgaugaccgucgccgcuaugggcguucccccucucccccuguuuaucuucucucuuaaagauacgcugaagcggagaagcuggccucugaacgagggggugauggcggugggacucgucuccauucuggccucuagcuuucuucgcaaugacgugcccauggcuggcccucugguugccgggggacuccugaucgccuguuaugugauuacaggcaccuccgcugaucucaccgucgaaaaagccgcggacgugacaugggaggaagaggcugaacagaccgggguuagccauaaccugaugaucacaguggacgaugacggaacgaugagaauuaaggaugacgagaccgagaacauccuuacaguccugcugaaaaccgcccuccugaucgugucuggcauuuuccccuacuccaucccggccacacuucuggucuggcacaccuggcagaagcaaacgcagcggagcggcgugcucugggauguuccuucucccccugaaacccagaaagcugagcuggaagaggggguguaccgcauuaagcagcaaggaaucuuuggcaagacacaggucggggugggaguucagaaagagggcguguuccauaccauguggcacgucacaagaggggccgugcucacccacaauggaaagcggcuggaacccaacugggcgaaugugaaaaaggaccuuauuuccuauggcggcggguggaaacugagcgcucaauggcagaagggagaggaaguucaggucaucgccguggagccgggcaagaacccuaaaaauuuccagacaaugcccgggauuuuucaaacgaccacaggagaaaucggcgccaucgcucuggauuucaagccugggaccucuggaucccccauuaucaaccgcgagggcaaaguggucggccucuacgggaauggagugguuaccaagaacggcggguaugugagcggaauugcccagacaaaugcugagcccgacggcccuacgccggaacuggaggaagagauguuuaaaaagagaaaccuuaccaucauggaucugcaucccggguccggcaagacacggaaauaccucccugccauuguccgcgaagcgaucaagagacggcugcgcacccucauccuggcccccacaagagugguugcugccgagauggaggaagcucuuaaaggacugccuauucgguaucagaccacggccacaaagagcgagcacaccggcagagaaaucguggaccugaugugccaugccaccuucacaaugcgccuccugucucccguccgggugccuaauuacaaccuuauuguuauggaugaggcucacuuuaccgacccggcgagcaucgccgcuagaggguauauuuccacacgcgugggaaugggcgaagccgccgcuaucuucaugaccgccacgcccccugggacagcggaugcuuuuccccagucuaaugccccuauccaagacgaggagcgggacauucccgaaagaagcuggaacuccggaaaugaguggaucaccgauuucgccggcaaaacagucugguuugugccgucuauuaaggcugggaacgacaucgccaacugucugcgcaagaauggcaaaaaggugauucagcucagccggaaaaccuucgauacggaauaccagaagaccaaacugaacgacugggauuuugucguuacaaccgacaucuccgagaugggagcgaauuucaaggccgauagagugauugacccucgccggugccugaagcccgugauccucacagauggccccgagagagucauccuugcugggccuaugcccgugaccguugccucugcugcccagcggcgcggaagagugggccggaacccucaaaaagaaaaugaccaguacauuuucacagggcagccgcugaacaaugaugaggaccaugcucacuggaccgaagccaagaugcugcucgacaacaucaauacgcccgagggaauuaucccugcgcuguuugaacccgagcgcgagaaaagcgccgcuauugauggcgaauauagacuuaagggggagucccggaaaacauucgucgaacugaugagacgcggcgaccucccuguguggcuggcccacaagguugcuagcgagggaaucaaauacaccgaucggaaguggugcuuugacggcgaaagaaacaaucagauccuggaggagaacauggauguggaaauuuggaccaaggagggggagaagaagaaacuccgcccccgguggcuugacgccagaacauauucugauccgcuggcccugaaggaguucaaagacuuugcugcgggacgcaaguccaucgcccucgaucuggucaccgaaauuggccgggugccuagccaucuugcucacagaacacgcaaugcccuggacaaccucgucaugcugcauacgucugagcacgggggcagagccuaccggcacgcuguggaggaacugcccgagaccauggaaacacuccuucugcugggccucaugauccugcuuaccggcggggccaugcuguuccucauuuccggaaagggcaucgggaaaacaagcaucggacugauuuguguuguggcguccucuggcaugcuguggauggccgaugugccucuccaauggaucgcuagcgccauuguccuugaguuuuucaugaugguucugcugauccccgagccugaaaagcagcgcacaccccaggacaaucaacucgcuuauguggugauugggauccugacgcuugccgcgauugucgccgcuaacgagaugggacugcucgaaaccacaaaaagagaucugggcauguccaaggagccgggcgugguuagcccuaccucuuaccuggacguggaccuccaucccgccuccgcuuggacacuuuaugccgucgcuaccacggugaucacacccaugcugcggcacaccaucgaaaauagcacagccaacgucucucuggcggccauugcuaaccaggccgugguucucauggggcuggauaaaggauggccuaucagcaagauggaccuuggcgugccgcugcucgcucuggggugcuacucccaggucaauccccugacccucaccgccgccgugcuucugcugguuacacauuacgcgauuaucggaccuggccuccaggcuaaggccacgcgcgaggcucagaagagaaccgccgccgggauuaugaagaaccccacaguggauggaaucaugaccaucgaccuggauccugucauuuaugacucuaaauuugagaagcagcuuggccaggugaugcugcucgugcugugugcuguucagcugcuccuuaugcggacaagcugggccuucugcgaagcgcugacccuggccacgggccccaucacaacccucugggagggguccccuggaaaauuuuggaauaccacaauugcugucucuauggccaacaucuucagaggcagcuaccuggcuggggccggacuugcguuuuccauuaugaaaagcgugggcaccgggaagcgcggaacaggcucucaaggcgaaacgcugggggagaaauggaagaaaaagcucaaucagcugucccggaaagaguucgaucuguauaagaaaagcggaaucaccgagguggacagaacagaggccaaggaaggccucaagcgcggggagaucacccaccaugcugucucccggggaucugccaaacuucagugguucguugaaagaaacauggugauuccggagggccgggugaucgaucugggguguggacgcggcggcuggagcuacuauugcgcugggcugaagaaagucacagaagugagaggauacaccaagggcgggcccggacacgaggagccuguucccauguccacguauggcuggaauauugugaaacucaugucugggaaggacgucuuuuaccugccucccgaaaagugugauacccuucugugcgacaucggagagagcuccccgagcccuacaguggaagagucucggaccauucgcguucucaaaaugguggagcccuggcugaagaacaaucaguucuguaucaaaguccugaaccccuacaugccuacagugauugaacaccucgagagacuucaacggaagcauggcggcaugcuggugcgcaauccccuguccagaaacagcacccacgaaauguauuggaucucuaaugggacaggaaacaucgucuccagcguuaauauggugucucggcuccugcuuaaccgcuuuaccaugacgcauagacggccuacaauugagaaagauguggaccugggcgccgggaccagacacgucaacgcugaaccggagacccccaauauggacaucauuggagagcgcauccggagaauuaaggaagaacacagcuccacauggcauuacgaugacgaaaacccuuauaagacgugggccuaccacggcucuuaugaggugaaagcgaccgggagcgccuccagcaugaucaauggaguugugaagcuccugacaaaacccugggaugucgugccuaugguuacccagauggcuaugacagacaccacacccuucggccagcaacgcguguuuaaggaaaaagucgauacccggacgccgagaccuaugcccggcacccgcaaggugauggagaucacagccgaguggcuguggcggacccucgggagaaacaagcgcccucggcugugcacaagagaagaguucaugaaaaagguucgcaccaaugcugccaugggagccguguuuacggaagagaaccagugggacuccgcgcgggcugccgucgaagaugaggaguucuggaaacuuguggacagagaacgcgagcugcauaagcucggcaaaugugggucuugcgucuacaauaugaugggaaagagagagaagaagcugggcgaguuugggaaggccaaaggcagccgggcuauuugguauauguggcuuggagcccgcuaccuggaguucgaagcucucggcuuucugaacgaggaucacugguucuccagagaaaauucuuacagcgggguggagggagaaggccugcauaagcucggguauauccugcgggacauuuccaaaauccccggaggcgccauguacgcggaugacacagccgggugggacaccagaauuacagaggaugaccuucacaacgaggaaaagaucacccagcagauggauccugagcaccggcaacuggcuaaugccaucuuuaaacucacguaucagaacaagguugugaagguccagcgccccaccccgaaaggcacagugauggacauuaucucuagaaaggaucagcggggaagcggccaaguggggaccuacggacugaauacauucaccaacauggaagcucagcuuauucgccagauggagggcgaagggguucuguccaaagccgaccucgagaauccucaucugcuggagaagaaagugacacaguggcucgaaaccaagggagucgagagacugaagcggauggcgaucagcggcgaugacugcgugguuaaacccauugaugaccgcuucgccaacgcccuucucgcucucaacgauauggggaaggugagaaaagacaucccccaauggcagccuucuaagggcuggcacgauuggcagcaggucccguuuuguucccaucacuuccacgaacugaucaugaaagacggacggaaacuugugguccccugccgcccucaagacgagcugauuggcagagcucggaucagccagggggccggauggucucuccgcgaaacggcuugucugggcaaggccuaugcgcagaugugggcccugauguacuuucauagacgggaucuccgccuggcuuccaaugccauuugcagcgccgugcccguucacugggugccuacaucuagaaccaccugguccauccaugcucaccaucaauggaugacaaccgaggacaugcuuacagucuggaaccggguguggauugaggauaaucccuggauggaagacaaaacgccuguuagcaccugggaggaugugcccuaucuggggaagagagaagaccagugguguggaucccucaucggccugacaagccgcgccaccugggcgcagaacauucuuacagcuauccagcaaguccggucucugaucgggaaugaggaguuccucgauuacaugccgagcaugaaaagauuucgcaaggaagaggaauccgagggcgccauuugguga

SEQ ID NO: 20945 - RNA, 9873 nt, Artificial Sequence
  derived and/or modified CDS sequence (opt5) from DENV-3__AY744680__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagaacccaaacauggaugagcgcugagggcgccuggcggcagguggaaaaaguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccaacuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaagccguucagcacgaaaaucucaaguauaccgugauuaucacaguccauacgggggaccagcaccaggugggaaacgagacccaaggcguuacagcugaaaucaccccccaggccuccacaguggaggcuauucugccugaauacggcacccuggggcucgagugcagcccccgcacgggacuggacuuuaaugagaugauccuucugaccaugaaaaacaaggccuggaugguccauagacagugguucuuugaucucccucugcccuggacaucuggcgccaccacagaaaccccgacguggaauaaaaaggagcuucuggugacauucaaaaacgcucacgcgaagaagcaagaagucgugguucucgggucccaggagggagccaugcacaccgcucugacaggcgccaccgaaauucagaccagcgggggcacaucuaucuuugccggacaucugaaaugucggcucaagauggacaaacuggagcuuaagggcauguccuaugcuaugugccugaaugccuucgugcucaaaaaggaggucagcgaaacgcagcacgggaccauucugaucaagguggaguacaaaggagaagaugcgccuuguaagauccccuucuccacagaggacggccaagggaaagcucauaacggacgccugauuaccgccaacccuaucguuacaaagaaagaggaacccgugaauauugaggccgaacccccuuuuggcgagucuaacaucgucauugggaucggcgauaaggcucuuaagaucaauugguacaaaaagggaagcuccauuggcaaaauguucgaagccaccgcuagaggggcccggagaauggcgauccucggagacacggccugggauuuuggcagcguggggggagugcugaacucucugggcaagaugguucaccagauuuucggguccgcuuauacagcccucuuuagcggcgucucuuggaucaugaaaauuggaaucggcgugcugcuuaccuggauugggcugaauagcaagaacaccuccaugucuuucagcugcaucgugaucggaauuaucacacucuaccugggcgcugucgugcaggccgacaugggguguguuauuaauuggaagggaaaagagcugaagugcggcuccgggaucuuugugaccaacgagguccauacauggacggaacaguauaaauuccaagcggauagcccgaagcgccuugccaccgcuauugccggcgcuugggagaauggaguguguggcauccggucuacaaccagaauggaaaaccuccuguggaaacagaucgccaaugagcugaacuacauucucugggaaaauaacaucaagcugacaauuguugugggggacgucaucggagugcuugagcagggcaaacgcacccugacgccccagccuauggagcucaaguauuccuggaagaccugggggaaagccaagauuguuacagcugaaacccaaaauagcucuuuuaucaucgauggacccaacacaccugagugccccuccgcgagccgggccuggaacgugugggaagucgaggacuacggcuucggcguguuuaccacaaauauuuggcugaaacugagagaaauguauacccagcuuugugaccaccgccucauguccgcugccgugaaggaugagcgggccguccacgcugacaugggguacuggaucgagucucagaaaaacggaagcuggaagcuggaaaaggccucccugauugagguuaaaacgugcacauggccgaagucucauacccucuggagcaauggcgugcuggaauccgauaugaucauuccuaaaagccuugcggggcccaucucucagcacaacuacagaccuggauaucauacccaaacagcuggccccuggcaccuggggaagcucgagcuggacuucaauuacugcgagggaaccacgguggucaucacagaaaacuguggcacccgcggcccuucccugcggacaaccacagugagcgggaaacuuauucacgaguggugcuguagaucuugcacccuccccccgcugcgcuauaugggagaagauggcuguugguacgggauggagauccggccuauuaaugaaaaggaggagaacaugguuaagucccuggugagcgccggaucuggcaaagccgacaauuuuacgauggggguccucugccuggcuauccuuuucgaagaggugaugagaggaaaguucggcaaaaagcauaugauugccggcgcgcuguuuaccuucguucuccugcugagcgggcagaucacauggcgggauauggcucacacccuuauuaugaucggauccaacgccagcgaccgcaugggcaugggggugacauaucuggcccucaucgcuaccuuuaaaauucagcccuuccuggcccucggauuuuuccugagaaagcuuacgucucgggaaaaucugcuccugggcgucgggcuggcuauggccacaacccuucaacugcccgaggauaucgaacagauggcgaacggaauugcccucggccugauggcucucaagcugaucacacaguuugagaccuaccagcuuuggaccgcccuggugucccucauguguagcaauacaauuuucacgcugaccguugcuuggagaacagccacccugauccuugccgugaucucccugcucccugucugccaaucuagcuccaugcgcaaaacagacuggcugccgaugaccguggcugcgaugggcgugcccccucucccccuguuuauuuucucucuuaaggauacgcugaaacggagaagcuggccucugaacgagggggucauggccguuggacucguguccauccuggcuucuagcuuucuucgcaaugacgugcccauggccggcccucuggucgccgggggacuccugauugcuuguuaugugaucacaggcaccuccgccgaucucaccguugaaaaggcggcugacgugacaugggaggaagaggccgaacagaccggggucagccauaaccugaugauuacaguggacgaugacggaacgaugagaaucaaagaugacgagaccgagaacauccuuacaguucugcugaagaccgcccuccugauugugucuggcaucuuccccuacuccauuccggcuacacuucuggucuggcacaccuggcagaaacagacgcaacggagcggcgugcucugggaugucccuucucccccugaaacccagaaggccgagcuggaagaggggguguaccgcaucaagcagcagggaauuuuuggcaaaacacaaguuggggugggaguccagaaggagggcguguuccauaccauguggcacguuacaagaggggcggugcucacccacaauggaaaacggcuggaacccaacugggcuaaugucaagaaagaccuuaucuccuauggcggcggguggaagcugagcgcccaguggcaaaagggagaggaagugcaggugauugccguugagccgggcaaaaacccuaagaauuuccagacaaugcccgggaucuuucagacgaccacaggagaaaucggcgcuauugcccuggauuucaaaccugggaccucuggaucccccaucauuaaccgcgagggcaaggucgugggccucuacgggaauggaguggucaccaaaaacggcggguaugugagcggaaucgcucaaacaaaugccgagcccgacggcccuacgccggaacuggaggaagagauguuuaagaagagaaaccuuaccauuauggaucugcaucccggguccggcaaaacacggaaguaccucccugcgaucguucgcgaagccaucaaaagacggcugcgcacccucauucuggcucccacaagaguggucgccgcugagauggaggaagcccuuaagggacugccuauccgguaucagaccacggccacaaaaagcgagcacaccggcagagaaauuguggaccugaugugccaugcuaccuucacaaugcgccuccugucucccguucgggugccuaauuacaaccuuaucgucauggaugaggcgcacuuuaccgacccggccagcauugcugccagaggguauaucuccacacgcgugggaaugggcgaagccgcugccaucuucaugaccgcgacgcccccugggacagcugaugccuuuccccagucuaaugccccuauucaggacgaggagcgggacauccccgaaagaagcuggaacuccggaaaugaguggauuaccgauuucgcuggcaagacaguuugguuugugccgucuaucaaggccgggaacgacauugcgaacugucugcgcaaaaauggcaagaaagucauccaacucagccggaagaccuucgauacggaauaccagaaaaccaagcugaacgacugggauuuuguggugacaaccgacauuuccgagaugggagccaauuucaaggcugauagagucaucgacccucgccggugccugaaacccguuauccucacagauggccccgagagagugauucuugccgggccuaugcccgugaccgucgcuucugccgcucagcggcgcggaagagugggccggaacccucagaaggaaaaugaccaauacaucuucacagggcagccgcugaacaaugaugaggaccaugcccacuggaccgaagcgaaaaugcugcucgacaacauuaauacgcccgagggaaucauuccugcccuguuugaacccgagcgcgagaagagcgcugccaucgauggcgaauauagacuuaaaggggagucccggaagacauucguugaacugaugagacgcggcgaccucccuguguggcuggcucacaaagucgccagcgagggaaucaaguacaccgaucggaaguggugcuuugacggcgaaagaaacaaucagauucuggaggagaacauggauguggaaaucuggaccaaagagggggaaaagaaaaagcuccgcccccgguggcuugacgccagaacauauucugauccgcuggcucugaaagaguucaaggacuuugcggccggacgcaaguccauugcucucgaucugguuaccgaaaucggccgggugccuagccaucuugcccacagaacacgcaaugcccuggacaaccucgucaugcugcauacgucugagcacgggggaagagcuuaccggcacgccguggaggaacugcccgagaccauggaaacacuccuucugcugggccucaugauucugcuuaccggcggggcgaugcuguuccucaucuccggaaaaggcaucgggaagacaagcauuggacugaucugugucguggccuccucuggcaugcuguggauggcugauguuccucuccaguggauugccagcgcuaucgugcuugaguuuuucaugauggugcugcugauucccgagccugaaaaacaacgcaccccccaggacaaucagcucgccuaugucguuaucgggauucugacgcuugcggccaucguggcugccaacgagaugggacugcucgaaaccacaaagagagaucugggcauguccaaagagccgggcguggucagcccuaccucuuaccuggacguggaccuccaucccgcuuccgccuggacacuuuaugcuguugccaccacggugaucacacccaugcugcggcacaccauugaaaauagcacagcgaacgucucucuggccgcuaucgccaaccaagcugugguccucauggggcuggauaagggauggccuauuagcaagauggaccuuggcgugccgcugcucgcccuggggugcuacucccagguuaauccccugacccucaccgccgcggugcuucugcuggucacacauuacgcuaucauuggaccuggccuccaggccaaagcuacgcgcgaggcccagaagagaaccgccgcugggaucaugaaaaaccccacaguggauggaaucaugaccauugaccuggauccuguuaucuaugacucuaaguuugagaaacaacuuggccaggugaugcugcucguccugugugccgugcagcugcuccuuaugcggacaagcugggcguucugcgaagcccugacccuggcuacgggccccauuacaacccucugggagggguccccuggaaaguuuuggaauaccacaaucgccgugucuauggcuaacauuuucagaggcagcuaccuggccggggcgggacuugccuuuuccaucaugaagagcguuggcaccgggaaacgcggaacaggcucucagggcgaaacgcugggggagaaguggaaaaagaaacucaaucaacugucccggaaggaauucgaucuguauaaaaagagcggaaucaccgaggucgacagaacagaggcuaaggaaggccucaaacgcggggagauuacccaccaugccgugucccggggaucugcuaagcuucagugguucguggaaagaaacauggucaucccggagggccggguuauugaucugggguguggacgcggcggcuggagcuacuauugcgccgggcugaaaaaggugacagaagugagaggauacaccaaaggcgggcccggacacgaggagccuguccccauguccacguauggcuggaauaucgugaagcucaugucugggaaggacguuuuuuaccugccucccgaaaaaugugauacccuucugugcgacauuggagagagcuccccgagcccuacaguggaagagucucggaccauccgcguccucaagaugguggagcccuggcugaaaaacaaucaguucuguauuaagguucugaaccccuacaugccuacagugaucgaacaccucgagagacuucagcggaaacauggcggcaugcugguccgcaauccccuguccagaaacagcacccacgaaauguauuggaucucuaaugggacaggaaacauuguguccagcgugaauauggucucucggcuccugcuuaaccgcuuuaccaugacgcauagacggccuacaaucgagaaggauguugaccugggcgcugggaccagacacgugaacgccgaaccggagacccccaauauggacgugauuggagagcgcauccggagaauuaaggaagagcacagcuccacauggcauuacgaugacgaaaacccuuauaaaacgugggcguaccacggcucuuaugaggucaaggccaccgggagcgcuuccagcaugaucaauggagugguuaaacuccugacaaagcccugggauguggucccuauggugacccaaauggccaugacagacaccacacccuucggccagcagcgcguuuuuaaagaaaagguggauacccggacgccgagaccuaugcccggcacccgcaaggucauggagaucacagcugaguggcuguggcggacccucgggagaaacaaacgcccucggcugugcacaagagaagaguucauuaagaaagugcgcaccaaugccgccaugggagcgguuuuuacggaagagaaccaaugggacuccgcucgggccgccguggaagaugaggaguucuggaagcuugucgacagagaacgcgagcugcauaaacucggcaagugugggucuugcguguacaauaugaugggaaaaagagaaaagaagcugggcgaguuugggaaagcuaagggcagccgggccaucugguauauguggcuuggagcucgcuaccuggaguucgaagcccucggcuuucugaacgaggaucacugguucuccagagaaaauucuuacagcggggucgagggagaaggccugcauaaacucggguauauucugcgggacaucuccaagauucccggaggcgcgauguacgccgaugacacagcugggugggacaccagaaucacagaggaugaccuucacaacgaggaaaaaaucacccagcagauggauccugagcaccggcagcuggccaaugcuauuuuuaagcucacguaucaaaacaaggugguuaaagugcagcgccccaccccgaagggcacagucauggacaucauuucuagaaaagaucagcggggaagcggccagguggggaccuacggacugaauacauucaccaacauggaagcccaacuuauccgccagauggagggcgaaggggugcuguccaaggcggaccucgagaauccucaucugcuggagaaaaagguuacacaguggcucgaaaccaagggaguggagagacugaaacggauggccauuagcggcgaugacugcgucgugaagcccaucgaugaccgcuucgcuaacgcccuucuggcucucaacgauauggggaaaguuagaaaggacaucccccaguggcaaccuucuaaaggcuggcacgauuggcagcaggugccguuuuguucccaucacuuccacgaacugauuaugaaggacggacggaagcuugucgugcccugccgcccucaggacgagcugaucggcagagcccggauuagccaaggggcuggauggucucuccgcgaaacggccugucugggcaaagcguaugcccagaugugggcucugauguacuuucauagacgggaucuccgccuggccuccaaugccaucugcagcgcuguccccgugcacuggguuccuacaucuagaaccaccugguccauucaugcccaccaucaguggaugacaaccgaggacaugcuuacaguguggaaccgggucuggaucgaggauaaucccuggauggaagacaagacgccugugaccacaugggaggauguucccuaucuggggaaaagagaagaccaaugguguggaagccucauuggccugaccucccgcgcgacaugggcucagaacauccuuaccgccauccagcaggugcggagccugauugggaaugaggaguuccucgauuacaugccgucuaugaagagauuucgcaaagaagaggaaagcgagggcgccaucugguga

SEQ ID NO: 20946 - RNA, 9873 nt, Artificial Sequence
  derived and/or modified CDS sequence (opt5) from DENV-3__AY744681__SS-prME
accucccugugccucaugaugaugcugcccgccacccuugcuuuccaccugacgucccgggacggcgaaccucggaugaucguggggaagaaugaacgcggaaaaucucuccuguuuaagaccgccagcggcauuaauauguguacacuuaucgcgauggaucugggggagaugugcgacgauaccgugacauacaaauguccgcucauuaccgaaguugagcccgaagacaucgauugcugguguaaccugacauccaccugggugacguauggaaccugcaaucaggcuggcgagcaucggcgggacaagcgcucuguggcccuggccccucacguugggaugggacucgauacacggacccagacauggaugagcgcugagggcgccuggagacagguggaaaaaguugagaccugggcuuuccgccaucccggcuuuacgauucuggcccuuuuccuggcgcacuacaucgggacaucccucacccagaagguggugaucuuuauucugcuuaugcuggugacaccuucuaugaccaugcgguguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccaacuggcuacacuucgcaaacuguguauugagggaagaaucaccaacgugacgacagauucccggugcccuacccagggcgaagccauucucccggaggaacaggaccagaauuauguguguaagcacaccuacgucgaucgcggcugggggaacggaugcggccuguuugggaaaggaagccuugugacaugcgcgaaguuccaaugucuggagucuaucgagggcaaggccguucagcacgaaaaucucaaauauaccgugauuaucacaguccauacgggggaccagcaccaggugggauccgagacccaaggcguuacagcugaaaucacaccccaggccagcacaguggaggcuauucugccugaauacggcacccuggggcucgagugcucucccagaacgggacuggacuuuaacgagaugauccuucugaccaugaagaauaaagccuggaugguccaucggcagugguucuuugaucucccucugcccuggacauccggcgccaccacagaaaccccgacguggaacaagaaagagcuucuggugacauucaagaaugcucacgcgaaaaagcaagaagucgugguucucgggagccaggagggagccaugcacaccgcucugacaggcgccaccgaaauucagaccucugggggcacauccaucuuugccggacaucugaagugucgccucaaaauggacaagcuggagcuuaaaggcaugagcuaugcuaugugccugaacgccuucgugcucaagaaagaggucuccgaaacgcagcacgggaccauucugaucaagguggaguacaagggagaagaugcgccuuguaaaauccccuucucuacagaggacggccaagggaaggcucauaauggaagacugauuaccgccaacccuaucguuaccaagaaggaggaacccgugaacauugaggccgaacccccuuuuggcgagagcaauaucgucauugggaucggcgauaaagcucuuaagaucaacugguacaagaaaggauccagcauuggcaagauguucgaagccaccgcuagaggggccagacgcauggcgauccucggagacacggccugggauuuuggcucugucgggggagugcucaauucccugggcaaaaugguucaccagauuuucgggagcgcuuauacagcccucuuuucuggcgucagcuggaucaugaagauuggaaucggcgugcugcuuaccuggauugggcugaacuccaaaaauaccucuaugagcuucuccugcaucgugaucggaauuaucacacucuaccugggcgcugucgugcaggccgacaugggguguguuauuaacuggaagggaaaggagcugaaaugcggcagcgggaucuuugugaccaaugagguccauacauggacggaacaguauaaguuccaagcggauucuccgaaacggcuugccaccgcuauugccggcgcuugggagaacggaguguguggcaucagauccacaacccgcauggaaaaucuccuguggaagcagaucgccaacgagcugaauuacauucucugggaaaacaauaucaaacugacaauuguugugggggacgucaucggagugcuugagcagggcaagcggacccugacgccccagccuauggagcucaaauauagcuggaagaccugggggaaggccaaaauuguuacagcugaaacccaaaacucuuccuuuaucaucgauggacccaauacaccugagugccccagcgcguccagagccuggaacgugugggaagucgaggacuacggcuucggcguguuuaccacaaacauuuggcugaagcugcgcgaaauguauacccagcuuugugaccaccggcucaugucugcugccgugaaagaugagagagccguccacgcugacaugggguacuggaucgagagccagaagaauggauccuggaaacuggaaaaggccucucugauugagguuaagacgugcacauggccgaaaagccauacccucugguccaacggcgugcuggaaagcgauaugaucauuccuaagucucuugcggggcccaucucccagcacaauuaccgcccuggauaucauacccaaacagcuggccccuggcaccuggggaaacucgagcuggacuucaacuacugcgagggaaccacgguggucaucacagaaaauuguggcacccggggcccuagccugagaacaaccacagugucugggaaacuuauucacgaguggugcugucgcuccugcacccugcccccgcugcgguauaugggagaagauggcuguugguacgggauggagaucagaccuauuaacgaaaaagaggagaauaugguuaagagccuggugucugccggaagcggcaaggccgacaacuuuacgauggggguccucugccuggcuauccuuuucgaagaggugaugcggggaaaauucggcaagaaacauaugauugccggcgcgcuguuuaccuucguucuccugcuguccgggcagaucacauggcgcgauauggcucacacccuuauuaugaucggaagcaaugccucugacagaaugggcaugggggugacauaucuggcccucaucgcuaccuuuaagauucagcccuuccuggcccucggauuuuuccugcggaaacuuacguccagagaaaaccugcuccugggcgucgggcuggcuauggccacaacccuucaacugcccgaggauaucgaacagauggcgaauggaauugcccucggccugauggcucucaagcugaucacacaguuugagaccuaccagcuuuggaccgcccuggugagccucauguguuccaacacaauuuucacgcugaccguugcuuggcgcacagccacccugauccuugccgugaucucucugcucccugucugccaaagcuccucuaugcggaagacagacuggcugccgaugaccguggcugcgaugggcgugcccccucucccccuguuuauuuucagccuuaaagauacgcugaagagacgcuccuggccucugaaugagggggucauggccguuggacucgugucuauccuggcuagcuccuuucuuagaaacgacgugcccauggccggcccucuggucgccgggggacuccugauugcuuguuaugugaucacaggcaccagcgccgaucucaccguugaaaaagcggcugacgugacaugggaggaagaggccgaacagaccggggucucucauaaucugaugauuacaguggacgaugacggaacgaugcggaucaaggaugacgagaccgagaacauccuuacaguucugcugaaaaccgcccuccugauuguguccggcaucuuccccuacagcauuccggcuacacuucuggucuggcacaccuggcagaagcagacgcaacgcucuggcgugcucugggaugucccuucucccccugaaacccagaaagccgagcuggaagaggggguguacagaaucaagcagcagggaauuuuuggcaagacacaaguuggggugggaguccagaaagagggcguguuccauaccauguggcacguuacaagaggggcggugcucacccacaacggaaagcgccuggaacccaauugggcuaacgucaaaaaggaccuuaucagcuauggcggcggguggaaacugagcgcccaguggcaaaagggagaggaaguccaggugauugccguugagccgggcaagaauccuaaaaacuuccagacaaugcccgggaucuuucagacgaccacaggagaaaucggcgcuauugcccuggauuucaagccugggaccuccggaagccccaucauuaauagagagggcaaagucgugggccucuacgggaacggaguggucaccaagaauggcggguauguguccggaaucgcucaaacaaacgccgagcccgacggcccuacgccggaacuggaggaagagauguuuaaaaagcggaaucuuaccauuauggaucugcaucccgggagcggcaagacacgcaaauaccucccugcgaucguuagagaagccaucaagcggcgccugagaacccucauucuggcucccacacggguggucgccgcugagauggaggaagcccuuaaaggacugccuaucagauaucagaccacggccacaaagucugagcacaccggccgcgaaauuguggaccugaugugccaugcuaccuucacaaugcggcuccugagccccguuagagugccuaacuacaaucuuaucgucauggaugaggcgcacuuuaccgacccggccuccauugcugcccgcggguauaucucuacacgggugggaaugggcgaagccgcugccaucuucaugaccgcgacgcccccugggacagcugaugccuuuccccagagcaacgccccuauucaggacgaggagagagacauccccgaacgcuccuggaacucuggaaacgaguggauuaccgauuucgcuggcaaaacaguuugguuugugccgagcaucaaggccgggaaugacauugcgaacugucugcggaagaacggcaaaaaggucauccaacucuccagaaaaaccuucgauacggaauaccagaagaccaaacugaaugacugggauuuuguggugacaaccgacauuucugagaugggagccaacuucaaggcugaucgcgucaucgacccucggagaugccugaagcccguuauccucacagauggccccgagcgggugauucuugccgggccuaugcccgugaccgucgcuagcgccgcucagcgcagaggacgggugggccgcaauccucagaaagaaaacgaccaauacaucuucacagggcagccgcugaauaacgaugaggaccaugcccacuggaccgaagcgaagaugcugcucgacaauauuaacacgcccgagggaaucauuccugcccuguuugaacccgagagagagaaauccgcugccaucgauggcgaauaucggcuuaagggggagagcagaaaaacauucguugaacugaugcgccggggcgaccucccuguguggcuggcucacaaggucgccucugagggaaucaaauacaccgauagaaaguggugcuuugacggcgaacgcaauaaccagauucuggaggagaauauggauguggaaaucuggaccaaggagggggagaagaagaaacuccggcccagauggcuugacgcccgcacauauuccgauccgcuggcucugaaggaguucaaagacuuugcggccggaagaaagagcauugcucucgaucugguuaccgaaaucggccgggugccuucucaucuugcccaccgcacaagaaacgcccuggacaaucucgucaugcugcauacguccgagcacgggggacgggcuuaccgccacgccguggaggaacugcccgagaccauggaaacacuccuucugcugggccucaugauucugcuuaccggcggggcgaugcuguuccucaucagcggaaagggcaucgggaaaacauccauuggacugaucugugucguggccucuagcggcaugcuguggauggcugauguuccucuccaguggauugccuccgcuaucgugcuugaguuuuucaugauggugcugcugauucccgagccugaaaagcaaagaacaccccaggacaaccagcucgccuaugucguuaucgggauucugacgcuugcggccaucguggcugccaaugagaugggacugcucgaaaccacaaaacgggaucugggcaugagcaaggagccgggcguggucucuccuaccuccuaccuggacguggaccuccaucccgcuagcgccuggacacuuuaugcuguugccaccacggugaucacacccaugcugcgccacaccauugaaaacucuacagcgaaugucagccuggccgcuaucgccaaccaagcugugguccucauggggcuggauaaaggauggccuauuuccaagauggaccuuggcgugccgcugcucgcccuggggugcuacucucagguuaacccccugacccucaccgccgcggugcuucugcuggucacacauuacgcuaucauuggaccuggccuccaggccaaggcuacgagagaggcccagaaacggaccgccgcugggaucaugaagaaucccacaguggauggaaucaugaccauugaccuggauccuguuaucuaugacagcaaauuugagaagcaacuuggccaggugaugcugcucguccugugugccgugcagcugcuccuuaugagaacauccugggcguucugcgaagcccugacccuggcuacgggccccauuacaacccucugggaggggucuccuggaaaauuuuggaacaccacaaucgccgugagcauggcuaauauuuuccgcggcuccuaccuggccggggcgggacuugccuuuagcaucaugaagucuguuggcaccgggaagcggggaacaggcucccagggcgaaacgcugggggagaaauggaagaaaaagcucaaccaacugagcagaaaagaguucgaucuguauaagaaauccggaaucaccgaggucgaccgcacagaggcuaaggaaggccucaagagaggggaaauuacccaccaugccgugucucggggaagcgcuaaacuucagugguucguggaacggaauauggucaucccggagggccgcguuauugaucugggguguggaagaggcggcugguccuacuauugcgccgggcugaagaaagugacagaagugcggggauacaccaagggcgggcccggacacgaggagccuguccccaugucuacguauggcuggaacaucgugaaacucaugagcgggaaggacgucuuuuaccugccucccgaaaagugugauacccuucugugcgacauuggagaguccagcccgucuccuacaguggaagagucccgcaccaucagaguccucaaaaugguggagcccuggcugaagaauaaccaguucuguauuaaaguucugaaucccuacaugccuacagugaucgaacaccucgagcggcuucagcgcaagcauggcggcaugcuggucagaaacccccugagcagaaauucuacccacgaaauguauuggaucuccaacgggacaggaaauauugugagcucugugaacauggucagccgccuccugcuuaauagauuuaccaugacgcaucggagaccuacaaucgagaaagauguugaccugggcgcugggacccgccacgugaacgccgaaccggagacccccaacauggacgugauuggagagcggaucagacgcauuaaggaagaacacuccucuacauggcauuacgaugacgaaaauccuuauaagacgugggcguaccacggcagcuaugaggucaaagccaccggguccgcuagcuccaugaucaacggagugguuaagcuccugacaaaacccugggauguggucccuauggugacccaaauggccaugacagacaccacacccuucggccagcagcggguuuuuaaggaaaaaguggauaccagaacgccgcgcccuaugcccggcacccggaaggucauggagaucacagcugaguggcuguggagaacccucgggcgcaauaagcggccuagacugugcacacgcgaagaguucauuaaaaaggugcggaccaacgccgccaugggagcgguuuuuacggaagagaaucaaugggacucugcuagagccgccguggaagaugaggaguucuggaaacuugucgaccgcgaaagagagcugcauaagcucggcaaaugugggagcugcguguacaacaugaugggaaagcgggagaaaaagcugggcgaguuugggaaggcuaaaggcucccgcgccaucugguauauguggcuuggagcuagauaccuggaguucgaagcccucggcuuucugaaugaggaucacugguucucucgggaaaacagcuacuccggggucgagggagaaggccugcauaagcucggguauauucugagagacaucucuaaaauucccggaggcgcgauguacgccgaugacacagcugggugggacacccggaucacagaggaugaccuucacaaugaggaaaagaucacccagcagauggauccugagcaccgcagacuggccaacgcuauuuuuaaacucacguaucagaauaaggugguuaaggugcaacggcccaccccgaaaggcacagucauggacaucauuagccgcaaggaucagagaggauccggccagguggggaccuacggacugaacacauucaccaauauggaagcccagcuuauccggcaaauggagggcgaaggggugcugagcaaagcggaccucgagaacccucaucugcuggagaagaaaguuacacaguggcucgaaaccaagggaguggagcgccugaagagaauggccauuucuggcgaugacugcgucgugaaacccaucgaugaccgguucgcuaaugcccuucuggcucucaacgauauggggaagguucgcaaagacaucccccaguggcagccuuccaagggcuggcacgauuggcaacaggugccguuuuguagccaucacuuccacgaacugauuaugaaagacggaagaaaacuugucgugcccugccggccucaggacgagcugaucggccgcgccagaauuucucagggggcuggauggucccuccgggaaacggccugucugggcaaggcguaugcccaaaugugggcucugauguacuuucaucgcagagaucuccggcuggccagcaacgccaucugcucugcuguccccgugcacuggguuccuacauccagaaccaccuggagcauucaugcccaccaucaguggaugacaaccgaggacaugcuuacaguguggaaucgcgucuggaucgaggauaaccccuggauggaagacaaaacgccugugaccacaugggaggauguucccuaucuggggaagcgggaagaccagugguguggaucccucauuggccugaccagcagagcgacaugggcucaaaauauccuuaccgccauccaacaggugcgcucucugauugggaacgaggaguuccucgauuacaugccgagcaugaaacgguuuagaaaggaagaggaauccgagggcgccaucugguga

SEQ ID NO: 20947 - RNA, 9873 nt, Artificial Sequence
  derived and/or modified CDS sequence (opt5) from DENV-3__AY744682__SS-prME
accagccugugccucaugaugaugcugcccgccacacuugcuuuccaccugacguccagagacggagaaccucggaugaucguggggaagaacgaacgcggaaagucucuccuguuuaagaccgccuccggcauuaauauguguacacuuaucgcgauggaucugggggagaugugcgacgauaccgugacauacaaguguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagaacccaaacauggaugagcgcugagggcgccuggcggcaggucgaaaaaguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccaacuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaagccguucagcacgaaaaucucaaguauaccgugacaauuacgguccauaccggggaccagcaccaggugggaaacgagacacaaggcguuaccgcugaaaucacaccccaggccuccaccguggaggcuauccugccugaauacggcacgcuggggcucgagugcagcccccgcaccggacuggacuuuaaugagaugauucuucugacaaugaaaaacaaggccuggaugguccauagacagugguucuuugaucucccucugcccuggaccucuggcgccacaaccgaaacgccgacauggaauaaaaaggagcuucuggugaccuucaaaaacgcucacgcgaagaagcaagaagucgugguucucgggucccaggagggagccaugcacacagcucugaccggcgccaccgaaauccagacaagcgggggcacgucuauuuuugccggacaucugaaaugucggcucaagauggacaaacuggagcuuaagggcauguccuaugcuaugugccugaaugccuucgugcucaaaaaggaggucagcgaaacccagcacgggacaauccugauuaagguggaguacaaaggagaagaugcgccuuguaagauccccuucuccaccgaggacggccaagggaaagcucauaacggacgccugaucacagccaacccuauuguuaccaagaaagaggaacccgugaauaucgaggccgaacccccuuuuggcgagucuaacauugucaucgggauuggcgauaaggcucuuaagaucaauugguacaaaaagggaagcuccaucggcaaaauguucgaagccacggcuagaggggcccggagaauggcgauucucggagacacagccugggauuuuggcagcgucgggggagugcugaacucucugggcaagaugguucaccagaucuucggguccgcuuauaccgcccucuuuagcggcgucucuuggauuaugaaaaucggaauuggcgugcugcuuaccuggaucgggcugaauagcaagaacacauccaugucuuucagcugcauugugaucggaaucauuacccucuaccugggcgcugucgugcaggccgacaugggguguguuaucaauuggaagggaaaagagcugaagugcggcuccgggauuuuugugacaaacgagguccauacguggaccgaacaguauaaauuccaagcggauagcccgaagcgccuugccacagcuaucgccggcgcuugggagaauggaguguguggcauucggucuaccacaagaauggaaaaccuccuguggaaacagaucgccaaugagcugaacuacauccucugggaaaauaacauuaagcugaccaucguugugggggacgucauuggagugcuugagcagggcaaacgcacgcugacaccccagccuauggagcucaaguauuccuggaagacaugggggaaagccaagaucguuaccgcugaaacacaaaauagcucuuuuauuaucgauggacccaacaccccugagugccccuccgcgagccgggccuggaacgugugggaagucgaggacuacggcuucggcguguuuacaaccaauaucuggcugaaacugagagaaguguauacgcagcuuugugaccaccgccucauguccgcugccgucaaggaugagcgggccguucacgcugacaugggguacuggauugagucucagaaaaacggaagcuggaagcuggaaaaggccucccugaucgaggugaaaacaugcaccuggccgaagucucauacccucuggagcaauggcgugcuggaauccgauaugauuaucccuaaaagccuugcggggcccauuucucagcacaacuacagaccuggauaucauacacaaaccgcuggccccuggcaccuggggaagcucgagcuggacuucaauuacugcgagggaacgacagucgugaucaccgaaaacuguggcacacgcggcccuucccugcggaccacaaccguuagcgggaaacuuauccacgaguggugcuguagaucuugcacgcugcccccgcugcgcuauaugggagaagauggcuguugguacgggauggagauucggccuaucaaugaaaaggaggagaacauggugaagucccuggucagcgccggaucuggcaaagccgacaauuuuaccaugggggugcucugccuggcuauucuuuucgaagagguuaugagaggaaaguucggcaaaaagcauaugaucagcggcgcccuguuuacauucgugcuccugcuguccgggcagauuaccuggcgggauauggcgcacacacuuaucaugauuggaagcaacgcuucugaccgcaugggcaugggggucaccuaucuggcccucaucgccacguuuaaaauccagcccuuccuggcucucggauuuuuccugagaaaacuuacaucccgggaaaaucugcuccugggcguggggcuggccauggcuaccacacuucaacugcccgaggauauugaacagauggccaacggaaucgcgcucggccugauggcccucaagcugauuacccaguuugagaccuaccagcuuuggacagcucugguuagccucauguguuccaauacgaucuucacccugacaguggccuggagaaccgcuacacugauucuugccgucaucucucugcucccugugugccaaagcuccucuaugcgcaaaaccgacuggcugccgaugacgguggccgcuaugggcgugcccccucucccccuguuuaucuucagccuuaaggauacacugaaacggagauccuggccucugaacgaggggguuauggcggugggacucgugucuauucuggccagcuccuuucuucgcaaugacguccccauggcuggcccucugguggccgggggacuccugaucgccuguuauguuauuaccggcaccagcgcugaucucacaguggaaaaggccgcggacgucaccugggaggaagaggcugaacagacaggggugucucauaaccugaugaucacgguugacgaugacggaaccaugagaauuaaagaugacgagacagagaacauccuuaccgugcugcugaagacagcccuccugaucgucuccggcauuuuccccuacagcaucccggccacccuucugguguggcacacguggcagaaacagacccaacggucuggcguccucugggaugugccuucucccccugaaacacagaaggcugagcuggaagaggggguuuaccgcauuaagcagcagggaaucuuuggcaaaacccaagugggggucggagugcagaaggagggcguuuuccauacaauguggcacgugaccagaggggccguccucacacacaauggaaaacggcuggaacccaacugggcgaaugugaagaaagaccuuauuagcuauggcggcggguggaagcugagcgcucaguggcaaaagggagaggaagugcagguuaucgccgucgagccgggcaaaaacccuaagaauuuccagacgaugcccgggauuuuucagaccacaaccggagaaaucggcgccaucgcucuggauuucaaaccugggaccuccggaagccccauuaucaaccgcgagggcaagguggugggccucuacgggaauggagucgugaccaagaacggcggguauguuuccggaauugcccaaacgaaugcugagcccgacggcccuaccccggaacuggaggaagagauguuuaagaagagaaaccuuacaaucauggaucugcaucccgggagcggcaaaacccggaaguaccucccugccauugugcgcgaagcgaucaaaagacggcugcgcacacucauccuggcccccaccagagucguggcugccgagauggaggaagcucuuaagggacugccuauucgguaucagacgacagccaccaaaucugagcacaccggcagagaaaucguugaccugaugugccaugccacauucaccaugcgccuccugagccccgugcgggucccuaauuacaaccuuauugugauggaugaggcucacuuuacagacccggcguccaucgccgcuagaggguauauuucuacccgcguuggaaugggcgaagccgccgcuaucuucaugacggccacacccccugggaccgcggaugcuuuuccccagagcaaugccccuauccaggacgaggagcgggacauucccgaaagauccuggaacucuggaaaugaguggaucacagauuucgccggcaagaccgugugguuugucccgagcauuaaggcugggaacgacaucgccaacugucugcgcaaaaauggcaagaaagugauucaacucucccggaagacguucgauaccgaauaccagaaaacaaagcugaacgacugggauuuuguggucaccacagacaucucugagaugggagcgaauuucaaggccgauagaguuauugacccucgccggugccugaaacccgugauccucaccgauggccccgagagagugauccuugcugggccuaugcccgucacaguggccagcgcugcccagcggcgcggaagaguuggccggaacccucagaaggaaaaugaccaauacauuuucaccgggcagccgcugaacaaugaugaggaccaugcucacuggacggaagccaaaaugcugcucgacaacaucaauacacccgagggaauuaucccugcgcuguuugaacccgagcgcgagaaguccgccgcuauugauggcgaauauagacuuaaaggggagagccggaagaccuucguggaacugaugagacgcggcgaccucccugucuggcuggcccacaaaguggcuucugagggaaucaaguacaccgaucggaaguggugcuuugacggcgaaagaaacaaucagauccuggaggagaacauggauguugaaauuuggacaaaagagggggaaaagaaaaagcuccgcccccgguggcuugacgccagaaccuauuccgauccgcuggcccugaaagaguucaaggacuuugcugcgggacgcaagagcaucgcccucgaucuggugacagaaauuggccgggucccuucucaucuugcucacagaacgcgcaaugcccuggacaaccucgugaugcugcauaccuccgagcacgggggcagagccuaccggcacgcugucgaggaacugcccgagacaauggaaacccuccuucugcugggccucaugauccugcuuacaggcggggccaugcuguuccucauuagcggaaaaggcaucgggaagaccuccaucggacugauuugugugguugcgucuagcggcaugcuguggauggccgaugugccucuccaguggaucgcuuccgccauugugcuugaguuuuucaugaugguccugcugauccccgagccugaaaaacaacgcacgccccaggacaaucagcucgcuuauguugugauugggauccugacccuugccgcgauuguggccgcuaacgagaugggacugcucgaaacaaccaagagagaucugggcaugagcaaagagccgggcgucgugucuccuacauccuaccuggacguugaccuccaucccgccagcgcuuggacccuuuaugccguggcuacgacagucaucacccccaugcugcggcacacaaucgaaaauucuaccgccaacgugagccuggcggccauugcuaaccaagccgucgugcucauggggcuggauaagggauggccuaucuccaagauggaccuuggcguuccgcugcucgcucuggggugcuacucucaggugaauccccugacccucacagccgccguccuucugcuggugacgcauuacgcgauuaucggaccuggccuccaggcuaaagccacccgcgaggcucagaagagaacagccgccgggauuaugaaaaaccccaccguugauggaaucaugacaaucgaccuggauccugugauuuaugacagcaaguuugagaaacaacuuggccaggucaugcugcucgugcugugugcugugcagcugcuccuuaugcggaccuccugggccuucugcgaagcgcugacgcuggccacaggccccaucaccacccucugggaggggucuccuggaaaguuuuggaauacaaccauugcuguuagcauggccaacaucuucagaggcuccuaccuggcuggggccggacuugcguuuagcauuaugaagucugucggcacagggaaacgcggaacgggcucccagggcgaaacccugggggagaaguggaaaaagaaacucaaucaacugagccggaaggaguucgaucuguauaaaaaguccggaaucacagagguggacagaaccgaggccaaggaaggccucaaacgcggggagaucacacaccaugcugugucucggggaagcgccaaacuucagugguucgucgaaagaaacaugguuauuccggagggccgggugaucgaucugggguguggacgcggcggcugguccuacuauugcgcugggcugaaaaaggugaccgaagucagaggauacacgaaaggcgggcccggacacgaggagccugugcccaugucuaccuauggcuggaauauuguuaagcucaugagcgggaaggacguguuuuaccugccucccgaaaaaugugauacacuucugugcgacaucggagaguccagcccgucuccuaccgucgaagagucccggacaauucgcgugcucaagaugguugagcccuggcugaaaaacaaucaguucuguaucaaggugcugaaccccuacaugccuaccgucauugaacaccucgagagacuucagcggaaacauggcggcaugcuggugcgcaauccccugagcagaaacucuacacacgaaauguauuggaucuccaaugggaccggaaacaucgugagcucugucaauaugguuagccggcuccugcuuaaccgcuuuacgaugacacauagacggccuaccauugagaaggauguggaccugggcgccgggaccagacacgugaacgcugaaccggagacacccaauauggacgucaucggagagcgcauucggagaaucaaggaagaacacuccucuacguggcauuacgaugacgaaaacccuuauaaaaccugggccuaccacggcagcuaugaggugaaggcgacaggguccgccagcuccaugauuaauggaguugugaaacuccugaccaagcccugggaugucgugccuaugguuacacaaauggcuaugaccgacacaacccccuucggccagcagcgcguguuuaaagaaaaggucgauacgcggaccccgagaccuaugcccggcacacgcaaggugauggagaucaccgccgaguggcuguggcggacacucgggagaaacaaacgcccucggcugugcaccagagaagaguucaucaagaaaguucgcacgaaugcugccaugggagccguguuuacagaagagaaccaaugggacucugcgcgggcugccgucgaagaugaggaguucuggaaacuuguggacagagaacgcgagcugcauaaacucggcaagugugggagcugcgucuacaauaugaugggaaaaagagaaaagaagcugggcgaguuugggaaagccaagggcucccgggcuauuugguauauguggcuuggagcccgcuaccuggaguucgaagcucucggcuuucugaacgaggaucacugguucucuagagaaaauagcuacuccgggguggagggagaaggccugcauaaacucggguauauccugcgggacauuucuaagauccccggaggcgccauguacgcggaugacaccgccgggugggacacaagaauuaccgaggaugaccuucacaacgaggagaagaucacgcagcagauggauccugagcaccggcagcuggcuaaugccaucuuuaagcucaccuaucaaaacaagguugugaaaguccagcgccccacaccgaagggcaccgugauggacauuaucagcagaaaagaucagcggggauccggccagguggggacauacggacugaauaccuucacaaacauggaagcucaacuuauucgccagauggagggcgaagggguucugagcaaggccgaccucgagaauccuuaucugcuggagaaaaaggugacccaguggcucgaaacgaagggagucgagagacugaaacggauggcgaucucuggcgaugacugcgugguuaagcccauugaugaccgcuucgccaacgcccuucucgcucucaacgauauggggaaagugagaaaggacaucccccaguggcaaccuuccaaaggcuggcaugauuggcagcaggucccguuuuguagccaccauuuccacgaacugaucaugaaggacggacggaaacuugugguccccugccgcccucaggacgagcugauuggcagagcucggaucucucaaggggccggauggucccuccgcgaaacagcuugucugggcaaagccuacgcgcagaugugggcccugauguauuuucacagacgggaucuccgccuggcuagcaaugccauuugcucugccgugcccguucauugggugccuaccuccagaaccacauggagcauccacgcucaucaccaguggaugaccacagaggacaugcuuacggucuggaaccggguguggauugaggauaaucccuggauggaagacaagaccccuguuacaaccugggaggaugugcccuaccuggggaaaagagaagaccaaugguguggaucccucaucggccugacaagccgcgccaccugggcgcagaacauucuuacggcuauccagcagguccggucucugaucgggaaugaggaguuccucgauuacaugccgagcaugaagagauuucgcaaagaagaggaauccgagggcgccauuugguga

SEQ ID NO: 20948 - RNA, 9873 nt, Artificial Sequence
  derived and/or modified CDS sequence (opt5) from DENV-3__AY744683__SS-prME
accagccugugccucaugaugaugcugcccgccacacuugcuuuccaccugacguccagagacggcgagccucggaugaucguggggaagaacgaacgcggaaaaucucuccuguuuaagaccgccagcggcauuaauauguguacacuuaucgcgauggaucugggggagaugugcgacgauaccgucacauacaaauguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagaacccaaacauggaugagcgcugagggcgccuggcggcagguggaaaaaguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccaacuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaagccguucagcacgaaaaucucaaguauaccgugauuaucacaguccauacgggggaccagcaccaggugggaaacgagacccaaggcguuacagcugaaaucaccccccaggccuccacaguggaggcuauucugccugaauacggcacccuggggcucgagugcagcccccgcacgggacuggacuuuaaugagaugauccuucugaccaugaaaaacaaggccuggaugguccauagacagugguucuuugaucucccucugcccuggacaucuggcgccaccacagaaaccccgacguggaauaaaaaggagcuucuggugacauucaaaaacgcucacgcgaagaagcaagaagucgugguucucgggucccaggagggagccaugcacaccgcucugacaggcgccaccgaaauucagaccagcgggggcacaucuaucuuugccggacaucugaaaugucggcucaagauggacaaacuggagcuuaagggcauguccuaugcuaugugccugaaugccuucgugcucaaaaaggaggucagcgaaacgcagcacgggaccauucugaucaagguggaguacaaaggagaagaugcgccuuguaagauccccuucuccacagaggacggccaagggaaagcucauaacggacgccugauuaccgccaacccuaucguuacaaagaaagaggaacccgugaauauugaggccgaacccccuuuuggcgagucuaacaucgucauugggaucggcgauaaggcucuuaagaucaauugguacaaaaagggaagcuccauuggcaaaauguucgaagccaccgcuagaggggcccggagaauggcgauccucggagacacggccugggauuuuggcagcguggggggagugcugaacucucugggcaagaugguucaccagauuuucggguccgcuuauacagcccucuuuagcggcgucucuuggaucaugaaaauuggaaucggcgugcugcuuaccuggauugggcugaauagcaagaacaccuccaugucuuucagcugcaucgugaucggaauuaucacacucuaccugggcgcugucgugcaggccgacaugggguguguuauuaauuggaagggaaaagagcugaagugcggcuccgggaucuuugugaccaacgagguccauacauggacggaacaguauaaauuccaagcggauagcccgaagcgccuugccaccgcuauugccggcgcuugggagaauggaguguguggcauccggucuacaaccagaauggaaaaccuccuguggaaacagaucgccaaugagcugaacuacauucucugggaaaauaacaucaagcugacaauuguugugggggacgucaucggagugcuugagcagggcaaacgcacccugacgccccagccuauggagcucaaguauuccuggaagaccugggggaaagccaagauuguuacagcugaaacccaaaauagcucuuuuaucaucgauggacccaacacaccugagugccccuccgcgagccgggccuggaacgugugggaagucgaggacuacggcuucggcguguuuaccacaaauauuuggcugaaacugagagaaauguauacccagcuuugugaccaccgccucauguccgcugccgugaaggaugagcgggccguccacgcugacaugggguacuggaucgagucucagaaaaacggaagcuggaagcuggaaaaggccucccugauugagguuaaaacgugcacauggccgaagucucauacccucuggagcaauggcgugcuggaauccgauaugaucauuccuaaaagccuugcggggcccaucucucagcacaacuacagaccuggauaucauacccaaacagcuggccccuggcaccuggggaagcucgagcuggacuucaauuacugcgagggaaccacgguggucaucacagaaaacuguggcacccgcggcccuucccugcggacaaccacagugagcgggaaacuuauucacgaguggugcuguagaucuugcacccuccccccgcugcgcuauaugggagaagauggcuguugguacgggauggagauccggccuauuaaugaaaaggaggagaacaugguuaagucccuggugagcgccggaucuggcaaagccgacaauuuuacgauggggguccucugccuggcuauccuuuucgaagaggugaugagaggaaaguucggcaaaaagcauaugauugccggcgcgcuguuuaccuucguucuccugcugagcgggcagaucacauggcgggauauggcucacacccuuauuaugaucggauccaacgccagcgaccgcaugggcaugggggugacauaucuggcccucaucgcuaccuuuaaaauucagcccuuccuggcccucggauuuuuccugagaaagcuuacgucucgggaaaaucugcuccugggcgucgggcuggcuauggccacaacccuucaacugcccgaggauaucgaacagauggcgaacggaauugcccucggccugauggcucucaagcugaucacacaguuugagaccuaccagcuuuggaccgcccuggugucccucauguguagcaauacaauuuucacgcugaccguugcuuggagaacagccacccugauccuugccgugaucucccugcucccugucugccaaucuagcuccaugcgcaaaacagacuggcugccgaugaccguggcugcgaugggcgugcccccucucccccuguuuauuuucucucuuaaggauacgcugaaacggagaagcuggccucugaacgagggggucauggccguuggacucguguccauccuggcuucuagcuuucuucgcaaugacgugcccauggccggcccucuggucgccgggggacuccugauugcuuguuaugugaucacaggcaccuccgccgaucucaccguugaaaaggcggcugacgugacaugggaggaagaggccgaacagaccggggucagccauaaccugaugauuacaguggacgaugacggaacgaugagaaucaaagaugacgagaccgagaacauccuuacaguucugcugaagaccgcccuccugauugugucuggcaucuuccccuacuccauuccggcuacacuucuggucuggcacaccuggcagaaacagacgcaacggagcggcgugcucugggaugucccuucucccccugaaacccagaaggccgagcuggaagaggggguguaccgcaucaagcagcagggaauuuuuggcaaaacacaaguuggggugggaguccagaaggagggcguguuccauaccauguggcacguuacaagaggggcggugcucacccacaauggaaaacggcuggaacccaacugggcuaaugucaagaaagaccuuaucuccuauggcggcggguggaagcugagcgcccaguggcaaaagggagaggaagugcaggugauugccguugagccgggcaaaaacccuaagaauuuccagacaaugcccgggaucuuucagacgaccacaggagaaaucggcgcuauugcccuggauuucaaaccugggaccucuggaucccccaucauuaaccgcgagggcaaggucgugggccucuacgggaauggaguggucaccaaaaacggcggguaugugagcggaaucgcucaaacaaaugccgagcccgacggcccuacgccggaacuggaggaagagauguuuaagaagagaaaccuuaccauuauggaucugcaucccggguccggcaaaacacggaaguaccucccugcgaucguucgcgaagccaucaaaagacggcugcgcacccucauucuggcucccacaagaguggucgccgcugagauggaggaagcccuuaagggacugccuauccgguaucagaccacggccacaaaaagcgagcacaccggcagagaaauuguggaccugaugugccaugcuaccuucacaaugcgccuccugucucccguucgggugccuaauuacaaccuuaucgucauggaugaggcgcacuuuaccgacccggccagcauugcugccagaggguauaucuccacacgcgugggaaugggcgaagccgcugccaucuucaugaccgcgacgcccccugggacagcugaugccuuuccccagucuaaugccccuauucaggacgaggagcgggacauccccgaaagaagcuggaacuccggaaaugaguggauuaccgauuucgcuggcaagacaguuugguuugugccgucuaucaaggccgggaacgacauugcgaacugucugcgcaaaaauggcaagaaagucauccaacucagccggaagaccuucgauacggaauaccagaaaaccaagcugaacgacugggauuuuguggugacaaccgacauuuccgagaugggagccaauuucaaggcugauagagucaucgacccucgccggugccugaaacccguuauccucacagauggccccgagagagugauucuugccgggccuaugcccgugaccgucgcuucugccgcucagcggcgcggaagagugggccggaacccucagaaggaaaaugaccaauacaucuucacagggcagccgcugaacaaugaugaggaccaugcccacuggaccgaagcgaaaaugcugcucgacaacauuaauacgcccgagggaaucauuccugcccuguuugaacccgagcgcgagaagagcgcugccaucgauggcgaauauagacuuaaaggggagucccggaagacauucguugaacugaugagacgcggcgaccucccuguguggcuggcucacaaagucgccagcgagggaaucaaguacaccgaucggaaguggugcuuugacggcgaaagaaacaaucagauucuggaggagaacauggauguggaaaucuggaccaaagagggggaaaagaaaaagcuccgcccccgguggcuugacgccagaacauauucugauccgcuggcucugaaagaguucaaggacuuugcggccggacgcaaguccauugcucucgaucugguuaccgaaaucggccgggugccuagccaucuugcccacagaacacgcaaugcccuggacaaccucgucaugcugcauacgucugagcacgggggaagagcuuaccggcacgccguggaggaacugcccgagaccauggaaacacuccuucugcugggccucaugauucugcuuaccggcggggcgaugcuguuccucaucuccggaaaaggcaucgggaagacaagcauuggacugaucugugucguggccuccucuggcaugcuguggauggcugauguuccucuccaguggauugccagcgcuaucgugcuugaguuuuucaugauggugcugcugauucccgagccugaaaaacaacgcaccccccaggacaaucagcucgccuaugucguuaucgggauucugacgcuugcggccaucguggcugccaacgagaugggacugcucgaaaccacaaagagagaucugggcauguccaaagagccgggcguggucagcccuaccucuuaccuggacguggaccuccaucccgcuuccgccuggacacuuuaugcuguugccaccacggugaucacacccaugcugcggcacaccauugaaaauagcacagcgaacgucucucuggccgcuaucgccaaccaagcugugguccucauggggcuggauaagggauggccuauuagcaagauggaccuuggcgugccgcugcucgcccuggggugcuacucccagguuaauccccugacccucaccgccgcggugcuucugcuggucacacauuacgcuaucauuggaccuggccuccaggccaaagcuacgcgcgaggcccagaagagaaccgccgcugggaucaugaaaaaccccacaguggauggaaucaugaccauugaccuggauccuguuaucuaugacucuaaguuugagaaacaacuuggccaggugaugcugcucguccugugugccgugcagcugcuccuuaugcggacaagcugggcguucugcgaagcccugacccuggcuacgggccccauuacaacccucugggagggguccccuggaaaguuuuggaauaccacaaucgccgugucuauggcuaacauuuucagaggcagcuaccuggccggggcgggacuugccuuuuccaucaugaagagcguuggcaccgggaaacgcggaacaggcucucagggcgaaacgcugggggagaaguggaaaaagaaacucaaucaacugucccggaaggaauucgaucuguauaaaaagagcggaaucaccgaggucgacagaacagaggcuaaggaaggccucaaacgcggggagauuacccaccaugccgugucccggggaucugcuaagcuucagugguucguggaaagaaacauggucaucccggagggccggguuauugaucugggguguggacgcggcggcuggagcuacuauugcgccgggcugaaaaaggugacagaagugagaggauacaccaaaggcgggcccggacacgaggagccuguccccauguccacguauggcuggaauaucgugaagcucaugucugggaaggacguuuuuuaccugccucccgaaaaaugugauacccuucugugcgacauuggagagagcuccccgagcccuacaguggaagagucucggaccauccgcguccucaagaugguggagcccuggcugaaaaacaaucaguucuguauuaagguucugaaccccuacaugccuacagugaucgaacaccucgagagacuucagcggaaacauggcggcaugcugguccgcaauccccuguccagaaacagcacccacgaaauguauuggaucucuaaugggacaggaaacauuguguccagcgugaauauggucucucggcuccugcuuaaccgcuuuaccaugacgcauagacggccuacaaucgagaaggauguugaccugggcgcugggaccagacacgugaacgccgaaccggagacccccaauauggacgugauuggagagcgcauccggagaauuaaggaagagcacagcuccacauggcauuacgaugacgaaaacccuuauaaaacgugggcguaccacggcucuuaugaggucaaggccaccgggagcgcuuccagcaugaucaauggagugguuaaacuccugacaaagcccugggauguggucccuauggugacccaaauggccaugacagacaccacacccuucggccagcagcgcguuuuuaaagaaaagguggauacccggacgccgagaccuaugcccggcacccgcaaggucauggagaucacagcugaguggcuguggcggacccucgggagaaacaaacgcccucggcugugcacaagagaagaguucauuaagaaagugcgcaccaaugccgccaugggagcgguuuuuacggaagagaaccaaugggacuccgcucgggccgccguggaagaugaggaguucuggaagcuugucgacagagaacgcgagcugcauaaacucggcaagugugggucuugcguguacaauaugaugggaaaaagagaaaagaagcugggcgaguuugggaaagcuaagggcagccgggccaucugguauauguggcuuggagcucgcuuccuggaguuugaagcccucggcuuccugaacgaggaucacugguuuuccagagaaaauucuuacagcggggucgagggagaaggccugcauaaacucggguacauucugcgggacaucuccaagauucccggaggcgcgauguaugccgaugacacagcugggugggacaccagaaucacagaggaugaccuucacaacgaggaaaaaaucacccagcagauggauccugagcaccggcagcuggccaaugcuauuuucaagcucacguaccaaaacaaggugguuaaagugcagcgccccaccccgaagggcacagucauggacaucauuucuagaaaagaucagcggggaagcggccagguggggaccuauggacugaauacauucaccaacauggaagcccaacuuauccgccagauggagggcgaaggggugcuguccaaggcggaccucgagaauccucaucugcuggagaaaaagguuacacaguggcucgaaaccaagggaguggagagacugaaacggauggccauuagcggcgaugacugcgucgugaagcccaucgaugaccgcuuugcuaacgcccuucuggcucucaacgauauggggaaaguuagaaaggacaucccccaguggcaaccuucuaaaggcuggcacgauuggcagcaggugccguucuguucccaucacuuucacgaacugauuaugaaggacggacggaagcuugucgugcccugccgcccucaggacgagcugaucggcagagcccggauuagccaaggggcuggauggucucuccgcgaaacggccugucugggcaaagcguacgcccagaugugggcucugauguauuuccauagacgggaucuccgccuggccuccaaugccaucugcagcgcuguccccgugcacuggguuccuacaucuagaaccaccugguccauucaugcccaccaucaguggaugacaaccgaggacaugcuuacaguguggaaccgggucuggaucgaggauaaucccuggauggaagacaagacgccugugaccacaugggaggauguucccuaccuggggaaaagagaagaccaaugguguggaagccucauuggccugaccucccgcgcgacaugggcucagaacauccuuaccgccauccagcaggugcggagccugauugggaaugaggaguuucucgauuauaugccgucuaugaagagauuccgcaaagaagaggaaagcgagggcgccaucugguga

SEQ ID NO: 20949 - RNA, 9873 nt, Artificial Sequence
  derived and/or modified CDS sequence (opt5) from DENV-3__AY744684__SS-prME
accagccucugccucaugaugaugcugcccgccacccuugcuuuccaccugacguccagagacggagagccucggaugaucguggggaagaacgaacgcggaaagucucuccuguuuaagaccgccuccggcauuaauauguguacccuuaucgcgauggaucugggggagaugugcgacgauaccgugacauacaaguguccgcucauuaccgaaguugagcccgaagacaucgauugcugguguaaccugacauccaccugggugacguauggaaccugcaaucaggcuggcgagcauagacgggacaagcgcucuguggcccuggccccucacguggggaugggacucgauacaagaacccagacauggaugagcgcugagggcgccuggagacagguggaaaagguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccagcuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaagccguucagcacgaaaaucucaaguauaccgugauuaucacaguccauacgggggaccagcaccaggugggaaacgagacccaaggcguuacagcugaaaucacaccccaggccuccacaguggaggcuauucugccugaauacggcacccuggggcucgagugcagcccccgcacgggacuggacuuuaaugagaugauccuucugaccaugaaaaacaaggccuggaugguccauagacagugguucuuugaucucccucugcccuggacaucuggcgccaccacagaaaccccgacguggaauaaaaaggagcuucuggugacauucaaaaacgcucacgcgaagaagcaagaagucgugguucucgggucccaggagggagccaugcacaccgcucugacaggcgccaccgaaauucagaccagcgggggcacaucuaucuuugccggacaucugaaaugucggcucaagauggacaaacuggagcuuaagggcauguccuaugcuaugugccugaaugccuucgugcucaaaaaggaggucagcgaaacgcagcacgggaccauucugaucaagguggaguacaaaggagaagaugcgccuuguaagauccccuucuccacagaggacggccaagggaaagcucauaacggacgccugauuaccgccaacccuaucguuacaaagaaagaggaacccgugaauauugaggccgaacccccuuuuggcgagucuaacaucgucauugggaucggcgauaaggcucuuaagaucaauugguacaaaaagggaagcuccauuggcaaaauguucgaagccaccgcuagaggggcccggagaauggcgauccucggagacacggccugggauuuuggcagcgucgggggagugcugaacucucugggcaagaugguucaccagauuuucggguccgcuuauacagcccucuuuagcggcgucucuuggaucaugaaaauuggaaucggcgugcugcuuaccuggauugggcugaauagcaagaacaccuccaugucuuucagcugcaucgugaucggaauuaucacacucuaccugggcgcugucgugcaggccgacaugggguguguuauuaauuggaagggaaaagagcugaagugcggcuccgggaucuuugugaccaacgagguccauacauggacggaacaguauaaauuccaagcggauagcccgaagcgccuugccaccgcuauugccggcgcuugggagaauggaguguguggcauccggucuacaaccagaauggaaaaccuccuguggaaacagaucgccaaugagcugaacuacauucucugggaaaauaacaucaagcugacaauuguugugggggacgucaucggagugcuugagcagggcaaacgcacccugacgccccagccuauggagcucaaguauuccuggaagaccugggggaaagccaagauuguuacagcugaaacccaaaauagcucuuuuaucaucgauggacccaacacaccugagugccccuccgcgagccgggccuggaacgugugggaagucgaggacuacggcuucggcguguuuaccacaaauauuuggcugaaacugagagaaauguauacccagcuuugugaccaccgccucauguccgcugccgugaaggaugagcgggccguccacgcugacaugggguacuggaucgagucucagaaaaacggaagcuggaagcuggaaaaggccucccugauugagguuaaaacgugcacauggccgaagucucauacccucuggagcaauggcgugcuggaauccgauaugaucauuccuaaaagccuugcggggcccaucucucagcacaacuacagaccuggauaucauacccaaacagcuggccccuggcaccuggggaagcucgagcuggacuucaauuacugcgagggaaccacgguggucaucacagaaaacuguggcacccgcggcccuucccugcggacaaccacagugagcgggaaacuuauucacgaguggugcuguagaucuugcacccugcccccgcugcgcuauaugggagaagauggcuguugguacgggauggagauccggccuauuaaugaaaaggaggagaacaugguuaagucccuggugagcgccggaucuggcaaagccgacaauuuuacgauggggguccucugccuggcuauccuuuucgaagaggugaugagaggaaaguucggcaaaaagcauaugauugccggcgcgcuguuuaccuucguucuccugcugagcgggcagaucacauggcgggauauggcucacacccuuauuaugaucggauccaacgccagcgaccgcaugggcaugggggugacauaucuggcccucaucgcuaccuuuaaaauucagcccuuccuggcccucggauuuuuccugagaaaacuuacgucucgggaaaaucugcuccugggcgucgggcuggcuauggccacaacccuucaacugcccgaggauaucgaacagauggcgaacggaauugcccucggccugauggcucucaagcugaucacacaguuugagaccuaccagcuuuggaccgcccuggugucccucauguguagcaauacaauuuccacgcugaccguugcuuggagaacagccacccugauccuugccgugaucucucugcucccugucugccaaagcuccucuaugcgcaaaacagacuggcugccgaugaccguggcugcgaugggcgugcccccucucccccuguucauuuuuagccuuaaggauacgcugaaacggagauccuggccucugaacgagggggucauggccguuggacucgugucuauccuggcuagcuccuuccuucgcaaugacgugcccauggccggcccucuggucgccgggggacuccugauugcuuguuaugugaucacaggcaccagcgccgaucucaccguugaaaaggcggcugacgugacaugggaggaagaggccgaacagaccggggucucucauaaccugaugauuacaguggacgaugacggaacgaugagaaucaaagaugacgagaccgagaacauccuuacaguucugcugaagaccgcccuccugauuguguccggcaucuuucccuacagcauuccggcuacacuucuggucuggcacaccuggcagaaacagacgcaacggucuggcgugcucugggaugucccuucucccccugaaacccagaaggccgagcuggaagaggggguguaccgcaucaagcagcagggaauuuucggcaaaacacaaguuggggugggaguccagaaggagggcguguuucauaccauguggcacguuacaagaggggcggugcucacccacaauggaaaacggcuggaacccaacugggcuaaugucaagaaagaccuuaucagcuauggcggcggguggaagcugagcgcccaguggcaaaagggagaggaaguccaggugauugccguugagccgggcaaaaacccuaagaauuuccagacaaugcccgggaucuuccagacgaccacaggagaaaucggcgcuauugcccuggauuuuaaaccugggaccuccggaagccccaucauuaaccgcgagggcaaggucgugggccucuacgggaauggaguggucaccaaaaacggcggguauguguccggaaucgcucaaacaaaugccgagcccgacggcccuacgccggaacuggaggaagagauguucaagaagagaaaccuuaccauuauggaucugcaucccgggagcggcaaaacacggaaguaccucccugcgaucguucgcgaagccaucaaaagacggcugcgcacccucauucuggcucccacaagaguggucgccgcugagauggaggaagcccuuaagggacugccuauccgguaucagaccacggccacaaaaucugagcacaccggcagagaaauuguggaccugaugugccaugcuaccuuuacaaugcgccuccugagccccguucgggugccuaauuacaaccuuaucgucauggaugaggcgcacuucaccgacccggccuccauugcugccagaggguauaucucuacacgcgugggaaugggcgaagccgcugccaucuuuaugaccgcgacgcccccugggacagcugaugccuucccccagagcaaugccccuauucaggacgaggagcgggacauccccgaaagauccuggaacucuggaaaugaguggauuaccgauuuugcuggcaagacaguuugguucgugccgagcaucaaggccgggaacgacauugcgaacugucugcgcaaaaauggcaagaaagucauccaacucucccggaagaccuuugauacggaauaccagaaaaccaagcugaacgacugggauuucguggugacaaccgacauuucugagaugggagccaauuuuaaggcugauagagucaucgacccucgccggugccugaaacccguuauccucacagauggccccgagagagugauucuugccgggccuaugcccgugaccgucgcuagcgccgcucagcggcgcggaagagugggccggaacccucagaaggaaaaugaccaauacaucuucacagggcagccgcugaacaaugaugaggaccaugcccacuggaccgaagcgaaaaugcugcucgacaacauuaauacgcccgagggaaucauuccugcccuguucgaacccgagcgcgagaaguccgcugccaucgauggcgaauauagacuuaaaggggagagccggaagacauuuguugaacugaugagacgcggcgaccucccuguguggcuggcucacaaagucgccucugagggaaucaaguacaccgaucggaaguggugcuucgacggcgaaagaaacaaucagauucuggaggagaacauggauguggaaaucuggaccaaagagggggaaaagaaaaagcuccgcccccgguggcuugacgccagaacauauuccgauccgcuggcucugaaagaguuuaaggacuucgcggccggacgcaagagcauugcucucgaucugguuaccgaaaucggccgggugccuucucaucuugcccacagaacacgcaaugcccuggacaaccucgucaugcugcauacguccgagcacgggggccgggcuuaccggcacgccguggaggaacugcccgagaccauggaaacacuccuucugcugggccucaugauucugcuuaccggcggggcgaugcuguuucucaucagcggaaaaggcaucgggaagacauccauuggacugaucugugucguggccucuagcggcaugcuguggauggcugauguuccucuccaguggauugccuccgcuaucgugcuugaguucuuuaugauggugcugcugauucccgagccugaaaaacaacgcacaccccaggacaaucagcucgccuaugucguuaucgggauucugacgcuugcggccaucguggcugccaacgagaugggacugcucgaaaccacaaagagagaucugggcaugagcaaagagccgggcguggucucuccuaccuccuaccuggacguggaccuccaucccgcuagcgccuggacacuuuaugcuguugccaccacggugaucacacccaugcugcggcacaccauugaaaauucuacagcgaacgucagccuggccgcuaucgccaaccaagcugugguccucauggggcuggauaagggauggccuauuuccaagauggaccuuggcgugccgcugcucgcccuggggugcuacucucagguuaauccccugacccucaccgccgcggugcuucugcuggucacacauuacgcuaucauuggaccuggccuccaggccaaagcuacgcgcgaggcccagaagagaaccgccgcugggaucaugaaaaaccccacaguggauggaaucaugaccauugaccuggauccuguuaucuaugacagcaaguucgagaaacaacuuggccaggugaugcugcucguccugugugccgugcagcugcuccuuaugcggacauccugggcguuuugcgaagcccugacccuggcuacgggccccauuacaacccucugggaggggucuccuggaaaguucuggaauaccacaaucgccgugagcauggcuaacauuuuuagaggcuccuaccuggccggggcgggacuugccuucagcaucaugaagucuguuggcaccgggaaacgcggaacaggcucccagggcgaaacgcugggggagaaguggaaaaagaaacucaaucaacugagccggaaggaauuugaucuguauaaaaaguccggaaucaccgaggucgacagaacagaggcuaaggaaggccucaaacgcggggagauuacccaccaugccgugucucggggaagcgcuaaacuucagugguucguggaaagaaacauggucaucccggagggccggguuauugaucugggguguggacgcggcggcugguccuacuauugcgccgggcugaaaaaggugacagaagugagaggauacaccaaaggcgggcccggacacgaggagccuguccccaugucuacguauggcuggaauaucgugaagcucaugagcgggaaggacguuuucuaccugccucccgaaaaaugugauacccuucugugcgacauuggagaguccagcccgucuccuacaguggaagagucccggaccauccgcguccucaagaugguggagcccuggcugaaaaacaaucaguuuuguauuaagguucugaaccccuacaugccuacagugaucgaacaccucgagagacuucagcggaaacauggcggcaugcugguccgcaauccccugagcagaaacucuacccacgaaauguauuggaucuccaaugggacaggaaacauugugagcucugugaauauggucagccggcuccugcuuaaccgcuucaccaugacgcauagacggccuacaaucgagaaggauguugaccugggcgcugggaccagacacgugaacgccgaaccggagacccccaauauggacgugauuggagagcgcauccggagaauuaaggaagaacacuccucuacauggcauuacgaugacgaaaacccuuauaaaacgugggcguaccacggcagcuaugaggucaaggccaccggguccgcuagcuccaugaucaauggagugguuaaacuccugacaaagcccugggauguggucccuauggugacccaaauggccaugacagacaccacacccuuuggccagcagcgcguuuucaaagaaaagguggauacccggacgccgagaccuaugcccggcacccgcaaggucauggagaucacagcugaguggcuguggcggacccucgggagaaacaaacgcccucggcugugcacaagagaagaguuuauuaagaaagugcgcaccaaugccgccaugggagcgguuuucacggaagagaaccaaugggacucugcucgggccgccguggaagaugaggaguuuuggaaacuugucgacagagaacgcgagcugcauaaacucggcaagugugggagcugcguguacaauaugaugggaaaaagagaaaagaagcugggcgaguucgggaaagcuaagggcucccgggccaucugguauauguggcuuggagcucgcuaccuggaguuugaagcccucggcuuccugaacgaggaucacugguuuucuagagaaaauagcuacuccggggucgagggagaaggccugcauaaacucggguauauucugcgggacaucucuaagauucccggaggcgcgauguacgccgaugacacagcugggugggacaccagaaucacagaggaugaccuucacaacgaggagaagaucacccagcagauggauccugagcaccggcagcuggccaaugcuauuuucaagcucacguaucaaaacaaggugguuaaagugcagcgccccaccccgaagggcacagucauggacaucauuagcagaaaagaucagcggggauccggccagguggggaccuacggacugaauacauuuaccaacauggaagcccaacuuauccgccagauggagggcgaaggggugcugagcaaggcggaccucgagaauccucaucugcuggagaaaaagguuacacaguggcucgaaaccaagggaguggagagacugaaacggauggccauuucuggcgaugacugcgucgugaagcccaucgaugaccgcuucgcuaacgcccuucuggcucucaacgauauggggaaaguuagaaaggacaucccccaguggcaaccuuccaaaggcuggcacgauuggcaacaggugccguucuguagccaucacuuucacgaacugauuaugaaggacggacggaaacuugucgugcccugccgcccucaggacgagcugaucggcagagcccggauuucucaaggggcuggauggucccuccgcgaaacggccugucugggcaaagcguaugcccagaugugggcucugauguacuuccauagacgggaucuccgccuggccagcaaugccaucugcucugcuguccccgugcacuggguuccuacauccagaaccaccuggagcauucaugcccaccaucaguggaugacaaccgaggacaugcuuacaguguggaaccgggucuggaucgaggauaaucccuggauggaagacaagacgccugugaccacaugggaggauguucccuaucuggggaaaagagaagaccaaugguguggaucccucauuggccugaccagccgcgcgacaugggcucagaacauccuuaccgccauccaacaggugcggucucugauugggaaugaggaguuucucgauuacaugccgagcaugaagagauuccgcaaagaagaggaauccgagggcgccaucugguga

SEQ ID NO: 20950 - RNA, 9873 nt, Artificial Sequence
  derived and/or modified CDS sequence (opt5) from DENV-3__AY744685__SS-prME
accagccugugccucaugaugaugcugcccgccacacuugcuuuccaccugacgagcagagacggagaaccucggaugaucguggggaagaacgaacgcggaaaaucucuccuguuuaagaccgccagcggcauuaauauguguacacuuaucgcgauggaucugggggagaugugcgacgauaccgugacauacaaauguccgcucauuaccgaaguugagcccgaagacaucgauugcugguguaaccugacauccaccugggugacguauggaaccugcaaucaggcuggcgagcauagacgggacaagcgcucuguggcccuggccccucacgucgggaugggacucgauacaagaacccaaacauggaugagcgcugagggcgccuggagacagguggaaaaaguugagaccugggcuuuccgccaucccggcuuuacgauucuggcccuuuuccuggcgcacuacaucgggacaucccucacccagaagguggucaucuuuauucugcuuaugcuggugacaccuucuaugaccaugagauguguuggagugggcaaccgggacuucgucgaagggcucagcggagccaccuggguggaugugguccuggagcauggcgggugcguuacaacgauggcuaagaauaaacccacccuggacaucgagcuccagaagacagaagccacccaacuggcuacacuucgcaaacuguguauugagggaaagaucaccaacgugacgacagauuccagaugcccuacccagggcgaagccauucucccggaggaacaggaccagaauuauguguguaaacacaccuacgucgaucggggcugggggaacggaugcggccuguuugggaagggaagccuugugacaugcgcgaaguuccaaugucuggagucuaucgagggcaaagccguucagcacgaaaaucucaaguauaccgugauuaucacaguccauacgggggaccagcaccaggugggaaacgagaugcaaggcguuaccgcugaaaucacaccccaggccuccaccguggaggcuauucugccugaauacggcacacuggggcucgagugcagcccccgcaccggacuggacuuuaaugagaugauccuucugacgaugaaaaacaaggccuggaugguccauagacagugguucuuugaucucccucugcccuggaccucuggcgccacaaccgaaacaccgaccuggaauaaaaaggagcuucuggugacguucaaaaacgcucacgcgaagaagcaagaagucgugguucucgggucccaggagggagccaugcacacagcucugaccggcgccacagaaauucagaccagcgggggcaccucuaucuuugccggacaucugaaaugucggcucaagauggacaaacuggagcuuaagggcauguccuaugcuaugugccugaaugccuucgugcucaaaaaggaggucagcgaaacacagcacgggacgauucugaucaagguggaguacaaaggagaagaugcgccuuguaagauccccuucuccaccgaggacggccaagggaaagcucauaacggacgccugauuacagccaacccuaucguuaccaagaaagaggaacccgugaauauugaggccgaacccccuuuuggcgagucuaacaucgucauugggaucggcgauaaggcucuuaagaucaauugguacaaaaagggaagcuccauuggcaaaauguucgaagccacagcuagaggggcccggagaauggcgauccucggagacaccgccugggauuuuggcagcgucgggggagugcugaacucucugggcaagaugguucaccagauuuucggguccgcuuauacggcccucuuuagcggcgucucuuggaucaugaaaauuggaaucggcgugcugcuuacauggauugggcugaauagcaagaacgcuuccaugucuuucagcugcaucgugaucggaauuaucacccucuaccugggcgccgucgugcaggcggacaugggguguguuauuaauuggaagggaaaagagcugaagugcggcuccgggaucuuugugaccaacgagguccauacauggaccgaacaguauaaauuccaagccgauagcccgaagcgccuugcuacagccauugcuggcgccugggagaauggaguguguggcauccggucuacgaccagaauggaaaaccuccuguggaaacagaucgccaaugagcugaacuacauucucugggaaaauaacaucaagcugacaauuguugugggggacgucaucggagugcuugagcagggcaaacgcacccugacaccccagccuauggagcucaaguauuccuggaagaccugggggaaagcuaagauuguuacggcggaaacccaaaauagcucuuuuaucaucgauggacccaacacaccugagugccccuccgcccugcgggcuuggaacgugugggaagucgaggacuacggcuucggcguguuuaccacaaauauuuggcugaaacuuagagaaaaguauacccagcucugugaccaccgccugaugagcgccgccgugaaagaugagcgggcuguccacgccgacaugggguacuggaucgagucccagaagaacggaucuuggaagcuggaaaaagcgagccucauugagguuaagacaugcaccuggccgaaaucccauacgcuguggucuaauggcgugcuugaaagcgauaugaucauuccuaagucccuggcugggcccaucagccagcacaacuacagaccuggauaucauacacaaaccgccggccccuggcaccucgggaaacuggagcuggacuucaauuacugcgagggaaccacaguggucaucaccgaaaacuguggcauucgcggcccuucucuucggacgacaaccguguccgggaagcucauccacgaguggugcuguagaagcugcacacugcccccgcugcgcuauaugggagaagauggcuguugguacgggauggagauucggccuaucaaugaaaaggaggagaacaugguuaaaucucucguguccgccggaagcggcaagaccgacaauuuuacaauggggguccugugccuugcuauucuguucgaagaggugaugagaggaaaauucggcaagaaacauaugaucgccggcgcgcucuuuaccuucguucugcugcuuucugggcagauuacguggcgggauauggcucacacccugaucaugaucggaagcaacgccuccgaccgcaugggcaugggggugacauaucucgcccugauugcuaccuuuaagauccagcccuuccucgcccugggauuuuuccuuagaaagcugacaagccgggaaaaucuccugcugggcgucgggcuugcuauggccaccacgcugcaacuccccgaggauauugaacagauggcgaacggaaucgcccugggccucauggcucugaaacuuauuacacaguuugagaccuaccagcuguggacagcccucaucucucugauguguuccaauaccaucuucacccugacaguggcuuggagaacggccacccuuauucuggccguuaucagccuccugccugugugccaauccucuagcaugcgcaagacagacuggcucccgaugaccgucgcugcgaugggcgugcccccucugccccuuuuuauuuucucccugaaagauacacugaagcggagaucuuggccucucaacgagggggugauggccgucggacugguuagcauccuugcuuccucuuuucugcgcaaugacgugcccauggccggcccucucguggccgggggacugcucauugcuuguuaugucaucaccggcacgagcgccgaucugacaguggaaaaagcggcugacguuaccugggaggaagaggccgaacagaccggggugucccauaaccuuaugaucacagucgacgaugacggaaccaugagaauuaaggaugacgagacagagaacauccugacggugcugcucaaaaccgcccugcuuauuguuagcggcaucuuccccuacucuauuccggcuacacugcucguguggcacaccuggcagaagcagacacaacgguccggcguccugugggaugugccuucucccccugaaacccagaaggccgagcucgaagagggggucuaccgcaucaaacagcagggaauuuuuggcaagacgcaaguggggguuggagugcagaaagagggcgucuuccauaccauguggcacgugacaagaggggcgguucugacccacaauggaaagcggcuugaacccaacugggcuaaugugaaaaaggaccugaucuccuauggcggcggguggaagcuguccgcccaguggcaaaaaggagaggaaguccaggugaucgccguggagccgggcaagaacccuaaaaauuuccagacaaugcccgggauuuuucagaccacaacgggagaaaucggcgcuauugcccucgauuucaagccugggaccagcggaucucccaucauuaaccgcgagggcaaaguugucggccuguacgggaauggaguggugacaaagaacggcggguaugucuccggaaucgcucaaaccaaugccgagcccgacggcccuaccccggaacuugaggaagagauguuuaagaaaagaaaccugacaaucauggaucuccaucccgggagcggcaagacgcggaaauaccugccugcgauugugcgcgaagccaucaagagacggcuccgcacccugauucuugcucccacaagaguuguggccgcugagauggaggaagcccugaaaggacugccuauccgguaucagaccacagccaccaaguccgagcacacgggcagagaaauugucgaccucaugugccaugcuacauucaccaugcgccugcuuagccccgugcggguuccuaauuacaaccugaucgugauggaugaggcgcacuuuaccgacccggccucuaucgcugccagaggguauauuagcacacgcgucggaaugggcgaagccgcugccaucuucaugaccgcgacacccccugggaccgcugaugccuuuccccaguccaaugccccuauucaggacgaggagcgggacauccccgaaagaucuuggaacagcggaaaugaguggauuacggauuucgcuggcaagacagugugguuuguuccguccaucaaagccgggaacgacauugcgaacugucuccgcaagaauggcaaaaaggugauccaacugucucggaaaaccuucgauacagaauaccagaagaccaagcugaacgacugggauuuugucgugacgaccgacaucagcgagaugggagccaauuucaaagcugauagagugauugacccucgccggugccucaagcccgucauccuuacagauggccccgagagaguuauucuggccgggccuaugcccgugaccguggcuuccgccgcucagcggcgcggaagagucggccggaacucucagaaagaaaaugaccaauacaucuucacagggcagccucugaacaaugaugaggaccaugcccacuggaccgaagcgaagaugcuccuggacaacauuaauacaccggagggaaucauccccgcccuuuuugaaccugagcgcgagaaaagcgcugccauugauggcgaauauagacugaagggggagucccggaaaaccuucguggaacucaugagacgcggcgaccugcccguuuggcuggcucacaagguggccagcgagggaaucaaguacacggaucggaaauggugcuuugacggcgaaagaaacaaucagauucucgaggagaacauggaugucgaaaucuggacaaaggagggggagaagaagaaacuucgcccucgguggcuggacgccagaaccuauucugauccccuggcucucaaggaguucaaggacuuugcggccggacgcaaauccauugcucuggaucuugugaccgaaaucggccggguuccgagccaucuggcccacagaacacgcaaugcccucgacaaccuggugaugcugcauaccucugagcacgggggccgggcuuaccggcacgccgucgaggaacucccugagacaauggaaacgcuucugcugcucggccugaugauccuucugaccggcggggcgaugcuguuccugauuuccggaaagggcaucgggaaaacaagcauuggacugaucuguguggucgccuccucuggcaugcucuggauggcugaugugccccuucaguggauugccagcgcuaucguucuggaguuuuucaugauggugcugcucauuccugagcccgaaaagcaacgcaccccucaggacaaucagcuggccuauguggucaucgggauccuuacacuggcggccauuguugcugccaacgagaugggacuccuggaaaccacgaaaagagaucugggcauguccaaggagcccggcguggugagcccgaccucuuaccucgacgucgaccuucauccugcuuccgccuggacacuguaugcuguggccaccacaguuaucacccccaugcugcggcacacgauugaaaauagcacagcgaacgugucucucgccgcuaucgccaaccaagcugucgugcugauggggcuugauaagggauggcccauuagcaaaauggaccugggcgucccucuccuggcccuggggugcuacucccaggugaauccgcucacccuuacagccgcgguucugcugcucgugacccauuacgcuaucaucggacccggccugcaggccaaggcuacccgcgaggcccagaaaagaacagccgcugggauuaugaagaacccuacggucgauggaaucaugaccauugaccuugaucccgugaucuaugacucuaaauuugagaagcaacugggccagguuaugcuccuggugcugugugccguccagcuccuucugaugcggacaagcugggcguucugcgaagcccugacccucgcuacaggcccuauuaccacgcugugggaggggucccccggaaaguuuuggaauacaaccaucgccgugucuauggcuaacaucuucagaggcagcuaccuugccggggcgggacuggccuuuuccauuaugaaaagcgugggcaccgggaagcgcggaacaggcucucagggcgaaacccucggggagaaauggaagaaaaagcugaaucaacugucccggaaagaguucgaucucuauaaaaagagcggaaucacagagguugacagaacggaggcuaaagaaggccuuaagcgcggggagauuacccaccaugccgucucccggggaucugcuaaacugcagugguucguggaaagaaacauggugaucccugagggccgggucauugaucugggguguggacgcggcggcuggagcuacuauugcgccgggcucaagaaaguuacagaagugagaggauacaccaagggcgggccgggacacgaggagcccgugccuauguccacauauggcuggaauaucgucaagcugaugucugggaaagacguguuuuaccuucccccugaaaagugugauacccugcucugcgacauuggagagagcucccccagcccgacgguugaagagucucggaccauccgcgugcugaaaauggucgagccuuggcugaagaacaaucaguucuguaucaaagugcucaaccccuacaugcccacaguuauugaacaccuugagagacugcagcggaagcauggcggcaugcuggugcgcaauccucucuccagaaacagcacccacgaaauguauuggaucucuaaugggacaggaaacauugucuccagcgugaauauggugucucggcugcuucugaaccgcuuuaccaugacacauagacggcccaccaucgagaaggaugucgaccucggcgcugggacgagacacguuaacgccgaaccugagacaccgaauauggacgugauuggagagcgcauccggagaaucaaagaagaacacagcuccaccuggcauuacgaugacgaaaaccccuauaagaccugggcguaccacggcucuuaugaggugaaagccacagggagcgcuuccagcaugauuaauggagucgugaagcugcugacgaaaccuugggauguugugcccauggucacccaaauggccaugacagacaccacaccuuucggccagcagcgcguguuuaaggaaaagguugauacccggacacccagaccgaugccuggcacccgcaaagugauggagaucacggcugaguggcucuggcggacccuggggagaaacaagcgcccccggcuuugcacaagagaagaguucauuaaaaagguccgcaccaaugccgccaugggagcgguguuuacagaagagaaccaaugggacuccgcucgggccgccguugaagaugaggaguucuggaaacugguggacagagaacgcgagcuccauaagcugggcaaaugugggucuugcgucuacaauaugaugggaaagagagaaaagaaacuuggcgaguuugggaaggcuaaaggcagccgggccaucugguauauguggcugggagcucgcuaccucgaguucgaagcccugggcuuucugaacgaggaucacugguucuccagagaaaauucucauagcgggguggagggagaaggccuccacaagcugggguacauucuucgggacaucuccaaaaucccuggaggcgcgauguaugccgaugacaccgcugggugggacacgagaauuacagaggaugaccugcacaacgaggaaaagaucacccagcagauggaucccgagcaucggcagcucgccaaugcuauuuuuaagcugacauaccaaaacaaagucgugaagguucagcgcccuacccccaaaggcacggugauggacaucauuucuagaaaggaucagcggggaagcggccaggucgggaccuauggacuuaauacauucaccaacauggaagcccaacugauccgccagauggagggcgaaggggugcucuccaaagcggaccuggagaauccgcaccuccucgagaagaaggugacacaguggcuggaaaccaaaggaguugagagacuuaagcggauggccaucagcggcgaugacugcguggucaaaccuauugaugaccgcuucgcuaacgcccugcucgcucugaacgauauggggaaggugagaaaagacaucccccaguggcaacccucuaagggcuggcaugauuggcagcagguuccuuuuuguucccaccacuuccaugaacuuauuaugaaggacggacggaaacugguggucccgugccgcccccaggacgagcucaucggcagagcccggauuagccaaggggcuggauggucucugcgcgaaacagccugucugggcaaggcguacgcccagaugugggcucucauguauuuucacagacgggaucugcgccuugccuccaaugccaucugcagcgcugugccuguccauugggugcccaccucuagaacgacaugguccauucacgcccaucaccaguggaugaccaccgaggacaugcugacaguuuggaaccggguguggaucgaggauaauccuuggauggaagacaaaacccccgucacaacgugggaggaugugccuuaccucgggaagagagaagaccaaugguguggaagccugaucggccuuaccucccgcgcgacaugggcucagaacauucugaccgccauccagcagguucggagccucauugggaaugaggaguuccuggauuauaugcccucuaugaaaagauuucgcaaggaagaggaaagcgagggcgccaucugguga

SEQ ID NO: 20951 - RNA, 9873 nt, Artificial Sequence
  derived and/or modified CDS sequence (opt5) from DENV-3__AY876494__SS-prME
accucccugugccucaugaugaugcugcccgccacccuugcuuuccaccugacguccagagacggagaaccucggaugaucguggccaaaaacgaacgcgggaaaucucuccuguuuaagaccgcgagcggaauuaauauguguacccuuaucgcuauggaucugggcgagaugugcgacgauaccgucaccuacaaauguccgcucauugccgaaguugagcccgaagacaucgauugcugguguaaccugaccuccacaugggugaccuaugggacgugcaaucaggccggagagcacagacgggacaagcgcucuguggcucuggccccucacgucggcauggggcucgauaccagaacacaaaccuggaugagcgcugagggagccuggcggcccguggaaaaaguugagacaugggcgcugcgccauccuggcuucaccauucuugcccuguuucucgcucacuacaucggcacgucccugacacagaagguggucaucuucauucuucugaugcucgugacccccucuaugacaaugagauguguuggggugggaaaccgggacuuugucgaaggccugagcggggccaccuggguggaugugguccuggagcauggaggcugcguuaccacaauggcuaagaauaaaccuacgcucgacaucgagcugcagaagaccgaagccacacagcuugcgacccugcgcaaacucuguauugaggggaagaucacaaacgugaccacggauuccagaugcccgacacaaggagaagccauucugcccgaggaacaggaccagaauuauguguguaaacacaccuacgucgaucggggcuggggcaacgggugcggacuuuucggcaaggggagccuggugaccugcgcuaaguuucagugucucgagccuaucgagggaaaaguugugcaacacgaaaaucugaaguauacagucauuaucaccgugcauacaggcgaccagcaccagguugggaacgacacgcagggagugaccgucgagaucacaccccaagccucuaccgcugaagccauucugccugaguacggcacacucgugcuggaaugcagcccccgcaccggccuugauuucaaugagaugauccugcucacgaugaaaaacaaggccuggaugguccauagacagugguuuuucgaccugccgcuuccuuggaccagcggggcuacaaccgagacacccaccuggaaucggaaagaacugcucgugacguuuaagaacgcgcacgccaaaaagcaggagguugugguccugggaucucaagaaggcgcuaugcacacagcccugaccggggccacagagauucaaaauuccggaggcaccagcaucuucgcugggcaucucaagugucgccugaaaauggauaaacuugaacugaaaggcaugucuuaugccaugugccucaacaccuuugugcugaagaaagagguuuccgagacacagcacggaacgauucugaucaagguggaauacaagggcgaggacgcgccuuguaaaauccccuucagcaccgaagaugggcagggaaaggcucauaacggcagacuuauuacagccaaucccgucgugaccaaaaaggaggagccugugaacaucgaagccgagccgcccuucggggaauccaauauuguuaucggaauuggcgacaaagcucucaagaucaacugguacaagaaagggucuagcaucggcaagauguuugaggccacagcucggggagccagacgcauggcgauucugggcgauaccgccugggacuucggguccgucggaggcgugcugaauagccucgggaaaauggugcaccaaaucuuuggaucugcuuauacggcccuguucuccggcgucagcuggauuaugaagaucgggauuggcgugcuucugacauggaucggacucaacucuaaaaauaccagcauguccuuuucuugcauuguuaucggcaucauuacccuguaccugggggcugugguccaggccgauaugggaugugugaucaacuggaagggcaaggaacuuaaaugcgggagcggaauuuucguuacaaaugaggugcauaccuggacagagcaguauaaguuucaggcggacuccccuaaacggcucgccacggcuaucgccggcgcuugggaaaacggggucuguggcauuagaagcaccacacgcauggagaaucugcuguggaagcaaaucgccaacgaacucaauuacauccugugggagaacaauauuaaacuuaccgugguugugggagauaucauuggcguccuggaacaggggaagcggacacucacaccccagccuauggagcugaaauauucuuggaagacguggggaaaggccaaaaucgugaccgcugagacacagaacuccagcuucauuaucgacggccccaacaccccggaaugcccuucugcguccagagccuggaaugugugggaggucgaagacuacggguuuggaguuuucacaaccaacaucuggcugaaacuucgcgagguguauacacaaagcugugaucaccggcucauguccgcugccauuaaagacgaaagagccgugcacgcugauaugggcuacuggaucgagucucagaagaauggcagcuggaaacuggagaaggccuccuuuauugaagucaagaccugcacguggcccaaaucucauacacuguggagcaacggggugcucgaguccgacaugaucauuccuaagagccuggcgggacccaucucucagcacaaucaucgcccuggcuacuauacccagaccgcugggcccuggcaccuuggaaaacuggaacucgauuucaacuacugcgagggcacaaccguugugaucacggagaauugugggacacggggaccgucccugagaaccacaaccgucagcggcaagcugauucacgaauggugcugucgcucuugcacacuuccuccccuccgguauaugggcgaggacggguguugguacggaauggaaaucagacccauuaacgagaaagaagagaauauggugaagucccugguuagcgccggcucugggaagguggauaacuuuaccaugggaguccugugccucgccauccuguucgaggaagugaugcggggcaaauucgggaagaaacauaugauugcuggaguucuuuuuacguucgugcugcuccugagcggccaaaucaccuggcgcgacauggcccacacacugauuaugaucggcuccaaugcgagcgauagaaccgggaugggagucacauaucuugcucugaucgccaccuuuaagauucagccuuuccucgcccugggcuuuuuccuccggaaacugacgucuagagagaaccuucugcucggggugggacuggcuauggccacaacccugcagcuuccggaagacaucgagcaaauggcuaauggcauugcccuggggcucaugacacugaagcucaucacccaguuugaaaccuaccagcuguggacagcgcuugugucccugacguguagcaacaccauuuucacacucaccgucgccuggcgcacagcuacccugauccuggccggaguuucccuucugccccucugccagucuagcuccaugcggaagacggauuggcugccuaugacaguggcugccaugggcgugcccccucucccccuguuuaucuucucucuuaaagacaccccuaagagacgcagcuggccccugaaugagggcgucauggccguggggcugguuuccauucucgcuucuagccugcuuagaaacgaugugccgauggcgggaccucuggucgccggcgggcuccugaucgcuuguuaugugauuaccggaacauccgccgaccucaccguugagaaagccgcugacgugacaugggaagaggaagccgagcaaacgggcgucagccauaaccugaugaucaccguggaugacgaugggacaaugcggauuaaggacgaugaaaccgagaauauccccacaguccuucugaaaaccgcgcugcucaucgugucuggaauuuuuccuuacuccauccccgcuacgcugcuuguuuggcacaccuggcagaagcagacacagcgcagcggcgugcugugggacgucccgucuccucccgagacccaaaaagccgaacucgaggaaggcguguacagaauuaagcagcaggggaucuucggaaagacacagguuggcguggggguccaaaaagagggaguguuucauaccauguggcacgugacacggggcgccguucugacgcacaacgggaagcgccucgagccuaauugggcuuccgucaaaaaggaucugauuagcuauggaggcggcuggagacuuucugcccaguggcagaaaggggaagaggugcaagugaucgcggucgaacccggaaagaaccccaagaauuuccagaccaugccuggcauuuuccagacaaccaccggggagaucggagcuaucgcccuggacuuuaaaccgggcacauccgggagccccauuaucaaccgggaaggaaaggugguuggccuguacggcaaugggguggucacgaaaaacggaggcuauguguccgggauugcccagaccaaugcugagccugauggacccacaccugagcucgaagaggaaauguucaagaaacgcaaccugaccaucauggaccuucaucccggcagcgggaagacaagaaaguaccugccugccauuguucgggaggcuaucaaacgcagacuccggacccugauccucgccccgacgagaguggucgcggccgaaauggaggaggcucugaagggccuucccauucgcuaucaaacaaccgccaccaaaucugaacacacaggacgggagaucguggaucugaugugccaugcuaccuuuacaaugagacugcucagcccuguucgcgugcccaauuacaaccugauuaucauggacgaagcccacuucaccgauccugccuccauugcugcgcggggcuauaucucuacgagagucgggaugggagaggccgcugccaucuuuaugacagccacacccccgggcacagcugaagccuucccucagagcaaugcgcccauucaggacgaggagcgcgacauccccgaacgguccuggaacucugggaaugaguggauuaccgauuuugugggaaagacggugugguucgucccuagcaucaaagcuggcaacgacauugccaacugucuuagaaagaaugggaagaaaguuauccagcugucccgcaagaccuuugauacagaauaccagaagacccggcucaacgacugggauuucguggugacaaccgacauuucugagaugggcgccaauuuuaaggcugauagagucaucgacccccggcgcugccugaaaccugugauccugacagauggaccggagagaguuauucucgccggccccaugccugugaccgcggccagcgcugcccagcggcgcgggagagucggacggaacccccagaaggaaaaugaccaguacaucuucacgggccaaccucuuaacaaugaugaggaccaugcucacuggacagaagccaagaugcugcuggacaacauuaauacccccgaggggaucauuccggcucucuucgaaccugagagagagaaauccgccgcgaucgauggagaauaucgccugaagggcgagagccggaaaaccuuuguggaacuuaugagacgcggggaccugcccguuuggcucgcccacaagguggcuucugagggcaucaaauacacagaucggaaguggugcuucgacggagaaagaaacaaucagauucuggaggagaacauggaugucgaaaucuggaccaaagagggcgaacgcaagaagcugcggccuagauggcucgacgcccgcacauauuccgauccccuugcucugaaagaguuuaaggacuucgccgccgggagaaaaagcauugcucuggaucucgugacggaaaucggacgggucccuucucaucuggcgcaccgcaccagaaaugcccuugacaaccuggugaugcuccauacauccgagcacggcgggcgggcuuaccgccacgccguugaggaacugcccgagaccauggaaacacugcuccuucugggacugaugauucuccugaccggcggcgccaugcuuuuucugaucagcgggaagggaaucggcaaaacguccauugggcucaucugugugauugugucuagcggaaugcuguggauggcugaugucccgcugcaguggaucgccuccgcgauuguucucgaguucuuuaugauggugcuucugaucccugagcccgaaaagcagagaacaccccaagacaaucagcuggccuauguggucauuggcauccucacacuggcugccaucguggcugccaacgagauggggcuucuggaaaccacaaagcgggaucucggaaugagcaaagagccuggcguugugucuccgaccuccuaccuggacgucgaccugcaucccgcgagcgccuggacgcucuaugcuguggccacaaccgucauuacaccuaugcuuagacacaccaucgaaaauucuaccgcuaacgugagccuggccgcuauugccaaccaggcgguugugcugaugggccucgauaagggguggcccaucuccaaaauggaccugggagucccucuucuggcccucggcugcuacucucaagugaauccccugacacugacggcugccguucuccuucuggugacccauuacgcuauuaucgggccuggacugcaggccaaggccacacgcgaggcgcagaaacggaccgcugccggcaucaugaagaacccgacagucgaugggauuaugaccaucgaccucgaucccgugauuuaugacagcaaguucgagaaacagcugggacaagugaugcuucugguucucugugcuguccagcugcugcucaugagaacguccugggcccuuugcgaagcccugacacuggcuaccggcccuaucaccacacucugggagggcucucccgggaaguuuuggaauaccacaauugccgugagcauggcgaacaucuuccgcggauccuaccuggccggcgcugggcuugccuuuagcaucaugaaaucugugggaacgggcaagcgggggaccggaucccagggcgaaacacugggcgagaaauggaagaagaaacucaaucagcugagcagaaaggaguucgaucuguauaaaaaguccgggauuaccgaggucgaccggacagaggcuaaagaaggacucaagcgcggcgagaccacgcaccaugccguuucuagagggagcgcgaaacuucaaugguuuguggaacggaacauggugaucccugagggacgcgucauugaucugggcugugggagaggaggcugguccuacuauugcgccggccugaagaaggugaccgaaguucggggguacacaaaaggaggccccgggcacgaggagccggugccuaugucuaccuauggauggaauaucgucaagcucaugagcggcaaagacguguucuaccugccucccgaaaagugugauacacuucugugcgacauuggggaguccagccccucucccaccguugaagagucccgcacaaucagagugcucaaaauggucgagccuuggcugaagaacaaucaguucuguauuaaggugcugaacccguacaugcccaccgugaucgaacaccucgagcggcuucagcgcaaauauggaggcaugcuggucagaaauccucugagccggaacucuacgcaugaaauguacuggaucuccaauggcacagggaacauuguuagcucugugaauauggugagcagacuccugcuuaaccgcuuuaccaugacccaccggagacccacaaucgagaaggaugucgaccugggagcuggcacgcgccaugugaacgccgaaccugagacccccaauauggacguuauuggggagcggaucaaaagaauuaaggaagaacacuccucuacauggcacuaugaugacgaaaacccguacaaaaccugggcuuaucauggaagcuacgaggugaaggccacaggcuccgcuagcuccaugaucaauggggucgugaagcuccugaccaaaccuugggauguugugcccauggucacacagauggccaugaccgacacgaccccuuucggacaacagcgcguguuuaaggaaaaaguugauacacggacccccagaccuaugcccggcacacgcaaggugauggagaucaccgcggaguggcuguggcggacgcucggcagaaacaaacgcccgcggcugugcacaagagaagaguucaccaagaagguccgcacaaaugccgcuaugggggccguguuuaccgaagagaaccagugggacucugcuagagccgccgucgaagaugaggaguucuggaaucuuugggaccgggaacgcgagcugcacaaacucggaaaguguggcagcugcguguauaacaugauggggaaaagagaaaagaaacugggagaguuuggcaaggcgaaagggucccgggcuauuugguacauguggcuuggcgccagauaccuggaguucgaagcccucggauuucugaaugaggaucauugguucucucgggaaaacagcuauuccggcguugagggggaaggacugcacaagcucggcuacauccugcgcgacauuucuaagaucccugggggagcuauguaugccgaugacacggcuggcugggacaccagaauuacagaggaugaccuucauaaugaggagaagaucacccaacagauggaucccgagcaccggcagcuggccaacgcgaucuuuaagcucacauaccagaauaaaguggucaaggugcaacgccccaccccuaaagggacagugauggacauuaucagcagaaaggaucagcggggcuccggacagguuggcaccuaugggcugaacacguucacaaauauggaagcccagcuugugcgccaaauggagggagaaggcguccugagcaaggcugaccucgagaacccgcaucugcuggagaaaaagauuacccccuggcucgaaccuaaagggguggagagacugaagcggauggccaucucuggagaugacugcguugugaaacccauugaugaccgcuuugcuaacgcccuucuggcgcucaaugauaugggcaaggucagaaaggacaucccucaguggcagcccuccaaaggguggcaugauuggcagcaagugccuuucuguagccaccauuuccacgaacugaucaugaaggacggccggaaacuugucgugcccugccgcccgcaggacgagcugauuggcagagcccggaucucucagggcgcuggguggucccucaaggaaaccgccugucugggaaaggcuuacgcccagauguggagccugauguauuuucaccgcagagaucuccggcuggcuucuaacgccauuugcuccgcgguuccugugcauuggguccccacaagcagaaccacaugguccauccacgcccaucaccaauggaugacgaccgaggacaugcuuacaguguggaaucgcguuuggauugaggauaacccuuggauggaagacaagacccccgugacaaccugggaggaugucccguaccugggcaagcgggaagaccaguggugugggagccucaucggacugacgucuagaagcaccugggcucagaauauucuuacagccauccaacaggugcgcucccugaucggcgaugaggaguuccucgacuacaugccuucuaugaaacgguuuagaaaggaagaggaaagcgagggggccauuugguga

SEQ ID NO: 20952 - RNA, 9873 nt, Artificial Sequence
  derived and/or modified CDS sequence (opt5) from DENV-3__AY923865__SS-prME
accagccugugccugaugaugaugcugcccgccacacuugcuuuccaccugacgucccgggacggcgagccucggaugaucguggggaagaaugaacgcggaaaaucucuccuguuuaagaccgccagcggcauuaauauguguacccuuaucgcgauggaucugggggagaugugcgacgauaccgugacauacaaauguccgcucauugcugaaguugagcccgaagacaucgauugcugguguaaccugaccuccacaugggugaccuauggaacgugcaaucaggccggcgagcacagacgggacaagcgcucuguggcccuggcuccucacgucgggaugggacucgauaccagaacacagaccuggaugagcgccgagggcgcuuggcggcaggucgaaaaaguugagacaugggcccugcgccaucccggcuucaccauucuugcgcuguuucucgcccacuacaucgggacgucccugacacagaagguggucaucuucauucuucugaugcucgugaccccuucuaugacaaugagauguguuggagugggcaaccgggacuuugucgaagggcugagcggagcuaccuggguggaugugguccuggagcauggcgggugcguuaccacaauggccaagaauaaacccacgcucgacaucgagcugcagaagaccgaagcuacacagcuugccacccugcgcaaacucuguauugagggaaagaucacaaacauuaccacgggcuccagaugcccuacacagggcgaagcgauccugccggaggaacaggaucagaauuauguguguaaacacaccuacguggaccggggguggggaaacggcugcgggcuuuucggaaagggcagccuggugaccugcgccaaguuucaaugucucgagcccauugaggggaaagugguucaguaugaaaaucugaaguacacagugaucaucaccguccacacaggagaucagccucaggugggcaacgacacgcaaggcguuaccguggagauuacaccccaggcuucuaccgucgaagccgugcugcucgaguaugggacacugggacuuaaaugcuccccucgcaccggccuggacuucaaugaaaugauccuccugacgaugaagaccaaggcuuggaugguccauagacagugguuuuucgaucuuccccugccguggacaagcggggccaccacagagaccccuacguggaaccggaaggagcuccuggugacauuuaaaaaugcccacgcuaagaagcaagaaguugugguccugggaucucaggagggcgcgaugcauaccgcccucacaggggcuaccgaaauucagaacuccggcggaaccagcaucuucgccggccaccugaaaugucgccuuaagauggacaaacuggagcucaaggggaugucuuacgccaugugccugaauacauuugugcugaaaaaggaaguuuccgagacgcagcacggaaccauucuuaucaagguggaguacaaaggcgaagaugcucccuguaagaucccuuucagcacagaggacgggcaaggaaaagcccauaacggcagacucauuaccgcgaaccccgucgugacaaagaaagaagaacccgugaauaucgaggcugaaccuccguucggggaguccaacauuguuaucggcauuggagauaaggcccugaagaucaauugguauaaaaagggcucuagcaucgggaaaauguuugaagccaccgcucggggagccagacgcauggcuauucugggcgacacggccugggauuucggguccgucggaggcgugcucaacagccuggggaagauggugcaccagaucuuuggcucugcguacacagcccuuuucuccggagucagcuggauuaugaaaaucggcauuggggugcugcucaccuggaucggacucaauucuaagaacaccagcauguccuuuucuugcauuguuaucggcaucauuacacuguaucuuggggcugugguccaggccgacaugggaugugugaucaauuggaagggcaaagagcucaagugcgggagcggcauuuucguuaccaacgaagugcauacauggacggagcaguacaaauuucaagcugauucccccaagcggcuggccaccgcgaucgccggagcuugggagaauggcgucugugggauuagaagcacaacccgcauggaaaaccugcucuggaaacagaucgccaaugagcugaacuauauccuuugggaaaauaacauuaagcugacagugguugugggagacaucauuggcguccucgagcaggggaaacggacccugacgccucagcccauggaacugaaguacucuuggaagaccuggggaaaagcuaagaucgugacagccgagacccaaaauuccagcuucauuaucgauggcccuaacacacccgagugcccgucugccuccagagcuuggaacgugugggaagucgaggacuauggcuuugggguuuucaccacaaauaucuggcuuaaacuccgcgaaguguacacccagagcugugaccaccggcugauguccgcggccauuaaggaugagagagcugugcaugccgacaugggauacuggaucgaaucucagaaaaacggcagcuggaagcuggagaaggccuccuuuauugaggucaaaacgugcacauggccuaagucucacacccucuggagcaauggggugcuggaauccgauaugaucauucccaaaagccuugcuggaccuaucucucagcacaaccaucgccccggcuaucacacccaaacagccgggccuuggcaucugggaaagcucgagcuggacuucaauuacugcgaaggcaccacgguugugaucacagagaacuguggcacccgggggcccucccugagaacaaccacagucagcggaaaacuuauucacgaguggugcugucgcucuugcacccucccgccucugcgguauaugggcgaagauggguguugguacggaauggagaucagacccauuaaugaaaaggaggaaaacauggugaagucccugguuagcgcgggcucugggaaaguggacaauuuuacgaugggaguccucugccuggcuauccuuuucgaggaggugaugcggggcaaguucggcaaaaagcacaugauugccgggguucuguuuaccuucgugcuccugcugagcggacagaucacauggcgcgauauggcccauacccuuauuaugaucggcuccaacgcuagcgacagaauggggaugggagucacauaucuggcccucaucgcgaccuuuaaaauucagcccuuccuggcucucggcuuuuuccugcggaaacuuacgucuagagaaaaucugcuccugggggugggacuggccauggccacaacccuucaacugccugaggauaucgaacagauggcuaacggcauugcccucggccugaugacacucaagcugaucacccaguuugagaccuaccagcuuuggacagcucuggugucccucacguguagcaauaccauuuucacacugaccgucgccuggcgcacagcgacccugauccuugccgggguuucccugcucccgcugugccaaucuagcuccaugcggaaaacggacuggcuccccaugacaguggcugccaugggagugccuccccugccucuuuuuaucuucucucugaaggauacccccaaaagacgcagcuggccucugaacgaaggcgucauggcuguggggcucguuuccauucuggccucuagccuucugagaaaugacgugcccauggccggaccgcucgucgcuggcgggcugcucaucgcguguuaugugauuaccggaacauccgccgaucugaccguugagaaggcugccgacgugacaugggaggaagaggccgaacagacgggcgucagccacaaccuuaugaucaccguggacgaugacggcacaaugcggauuaaagaugacgagaccgaaaacauccugacaguccugcucaagaccgcucugcuuaucgugucugggauuuuuccuuacuccauccccgccacgcugcucguuuggcauaccuggcagaaacagacacaacgcagcggagugcugugggaugucccuucucccccggagacccagaaggcggagcucgaagagggcguguacagaauuaagcagcaggggaucuucggaaaaacacaaguuggcguggggguccagaaggaaggaguguuucacaccauguggcaugugacacggggcgcuguucugacgcacaauggcaaacgccuugagccuaacugggccuccgucaagaaagaccugauuagcuaugggggaggcuggagacugucugcccaguggcaaaagggggaggaaguccaggugaucgcugucgagcccggaaagaauccuaaaaacuuccagaccaugcccggcauuuuccagacaaccaccggggaaaucggagccaucgcgcucgauuuuaagcccggcacauccggcagcccuauuaucaaucgggaggggaaagugguuggacuguacggcaacgggguggucacgaagaauggaggcuauguguccgggauugcucaaaccaacgccgaaccggacggccccacaccugagcuugaggaagagauguucaaaaagcgcaaucugaccaucauggaucuccaccccggaagcggcaagacaagaaaauaccugccugccauuguucgggaagcuaucaagcgcagacuccggacccugauccuugcccccacgagaguggucgcugccgagauggaagaggcgcugaaagggcugccuauucgcuaucagacaaccgccaccaagucugagcauacaggacgggaaaucguggaccucaugugccacgcuaccuuuacaaugagacugcuuagcccgguucgcgugcccaacuacaaucugauuaucauggaugaggcccauuucaccgacccugcuuccauugccgcccggggcuauaucucuacgagagucgggaugggagaagcugcggccaucuuuaugacagcuacacccccuggcacagccgaggccuucccccagagcaacgcuccgauucaggaugaagaacgcgacaucccugagcgguccuggaacucugggaacgaauggauuaccgacuuugugggcaaaacggugugguucguccccagcaucaaggccggaaaugauauugcgaacugucucagaaagaacggcaaaaagguuauccaacugucccgcaaaaccuuugacacagaguaccagaagacccggcugaaugauugggacuuccucgugacaaccgauauuucugaaaugggggcuaacuuuaaagccgacagagugaucgauccccggcgcugccuuaagccugucauccugacagacggacccgagagagugauucuggccggcccuaugccgguuaccgcugccagcgcggcccagcggcgcgggagagugggacggaauccccagaaggagaacgaucaauacaucuucacgggccagccucucaauaacgacgaagaucacgcucauuggacagaggccaaaaugcugcuugacaauauuaacacccccgaagggaucauuccugcucuguucgagcccgaaagagagaaguccgccgcuaucgacggcgaguaucgccucaaaggagaaagccggaagaccuuugucgagcugaugagacgcggcgaucugccgguguggcucgcccacaaaguugcgucugaagggaucaaguacacagaccggaaauggugcuucgauggagagagaaauaaccagauucuugaagagaauauggacguggagaucuggaccaaggaaggcgagcgcaagaaacugcggccuagauggcuggaugcccgcacauauuccgacccccucgcucugaaggaauuuaaagauuucgccgcugggagaaagagcauugcccuugaccuggucacggagaucggacgggugccuucucaccucgcccaucgcaccagaaacgcucuggauaaucuggucaugcuccacacauccgaacauggcggccgggcguaccgccacgccguggaggagcuucccgaaaccauggagacacugcugcuccuggggcuuaugauucugcucaccggaggcgcuaugcuguuucugaucagcgggaaaggaaucggcaagacguccauugggcucaucuguguuauugugucuagcggaaugcuuuggauggccgacgugccucugcaguggaucgccuccgcuauuguccuggaguucuuuaugaugguucuccugauccccgagccggagaagcaaagaaccccucaggauaaccagcuugccuauguggugauuggcauccugacacucgcggccaucgucgcugccaaugaaaugggccugcuggagaccacaaaacgggaccucgggaugagcaaggaacccggagugguuucucccaccuccuaccuugauguggaccugcacccugcuagcgccuggacgcuguaugcggucgccacaaccgugauuacaccgaugcucagacauaccaucgagaacucuaccgcuaaugucagccuggccgcuauugccaaccaagcugugguucuuaugggccuggacaaaggguggcccaucuccaagauggaucucggagugccucugcuggcccucggcugcuacucucaggucaacccccuuacacugacggcggccgugcugcuccugguuacccacuacgcuauuaucgggccuggacuucaggccaaagcuacacgcgaagcccagaagcggaccgccgcgggcaucaugaagaaucccacaguggacggcauuaugaccaucgaucuggacccugucauuuaugauagcaaauucgagaagcaacucggacaggugaugcugcuggugcucugugcuguucagcuucugcugaugagaacguccugggcccucugcgaggcucugacacuugccaccggaccgaucaccacacugugggaaggcucucccgggaaauuuuggaacaccacaauugccgucagcauggcuaauaucuuccgcggauccuaccucgccggcacggggcuggcguuuagcaucaugaagucugugggaaccggccggagaggcacagggucccagggagagacccugggcgaaaaauggaagaagaaacucaaccaacuuagccggaaggaguucgaccuguauaaaaaguccgggauuacagaaguggaucgcaccgaggccaaagagggacugaagagaggcgaaacgacccaucacgcugucucucgggggagcgccaaacuccagugguuuguugagcgcaauauggugaucccugaaggaagagugauugaccugggcuguggcagaggagggugguccuacuauugcgcuggccuuaagaaggucacagaggugcgcggguacaccaaaggaggccccgggcaugaggaaccuguucccaugucuacauauggauggaacaucgugaagcugaugagcggcaaagaugucuucuaccucccgccugagaagugugacacccugcugugcgauauuggcgaauccagccccucucccacaguggaggaauccagaaccauccggguucucaaaaugguggagccuuggcuuaagaauaaccaguucuguauuaagguccugaaucccuacaugccuacggugaucgagcaccuggaacgccuccagagaaaauaugggggaaugcuggugcggaacccgcuuagcagaaauucuacacacgagauguacuggaucuccaacggcaccgggaauauugucagcucuguuaacauggugagccgccugcuccugaaucgguuuaccaugacacauagacgccccacgaucgaaaaggacguggaucugggagccggcacccggcacgucaacgcggagccugaaacacccaacauggacgugauuggggagagaaucaaacgcauuaaggaggaacauuccucuaccuggcacuaugacgaugagaauccuuacaaaacaugggccuaucacggaagcuacgaaguuaaggcuaccggcuccgccagcuccaugaucaacggcguggucaagcuccugacaaaacccugggacgugguuccgauggugacccaaauggcuaugacggauaccacaccuuucgggcagcagcgggucuuuaaggagaaaguggacaccagaacaccccgcccuaugcccggaacccggaagguuauggaaaucacggccgaguggcuuuggagaacacugggccgcaauaaaaagccucggcucugcaccagagaggaguucacaaagaaagugcgcaccaacgcugccaugggggcggucuuuacggaggaaaaucaaugggauucugccagagcugccguggaggacgaagaguucuggaagcuggucgaucgggagcgcgaacuucauaaacugggaaaguguggcagcugcguguauaacaugauggggaaaagagagaagaaacucggcgaauuuggaaaggcuaagggcucccgggccauuugguacauguggcugggggccagauaccuggaguucgaggcgcucggauuucugaaugaagaccacugguucucucgggagaacagcuauuccggcguugaaggggagggacuucauaaacugggcuacauccuccgcgauauuucuaagauccccgggggcgcuauguaugccgacgauaccgccggaugggacacaagaauuaccgaagacgaucugcacaaugaggagaaaaucacacagcagauggacccggaacaucggcagcuugcuaacgccaucuuuaagcugaccuaccaaaauaaaguggucaaggugcagcgcccuacacccaagggcaccgugauggauauuaucagcagaaaagaccagcggggguccggacagguuggcacguaugggcucaacacauucaccaauauggaggcucaacuggugcgccagauggaaggagagggcguccugagcaaggccgaucucgaaaacccccaucugcuugagaaaaagauuacccaguggcuggagacaaaagggguggaaagacucaagcggauggcgaucucuggcgacgauugcguugugaagccuauugacgaucgcuuugccaaugcucugcuugcccugaacgacaugggaaaagucagaaaggauaucccgcaguggcaacccuccaaaggcuggcacgacuggcaacaggugccuuucuguagccaucacuuccaugagcucaucaugaaggaugggcggaaacuggucgugcccugccgcccucaggacgaacugauugggagagcucggaucucucaaggcgccggguggucccucaaggagaccgcgugucugggaaaggccuacgcucagauguggagccuuauguauuuucaccgcagagaccugcggcucgccucuaacgcuauuugcuccgccguucccgugcacugggucccuacaagcagaacgaccugguccauccaugcucaccaucaguggaugacaaccgaagauaugcugacaguguggaaucgcguuuggauugaggacaaccccuggauggaggauaaaaccccggugacgaccugggaagacgucccuuaccuuggcaagcgggaggaucaauggugugggagccugaucggccucacaucuagagccaccugggcgcagaauauucugacagccauccaacaggugcgcagccugaucggagacgaagaguuccucgauuacaugcccuccaugaaacgguuuagaaaggaggaagagucugaaggcgcuauuugguga

SEQ ID NO: 20953 - RNA, 9867 nt, Artificial Sequence
  derived and/or modified CDS sequence (opt5) from DENV-4__KR922405__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucugcgugggugauguaugggaccugcacacagagcggagagagacggcgcgaaaagagauccgucgcucucaccccccacucuggcauggggcuggagacacgggccgaaaccuggaugagcuccgagggagccuggaaacaugcucaacgcguggagucuuggauccuuagaaauccuggcuucgcccugcucgcuggcuuuauggccuacaugaucgggcagacgggaauucagcggacaguuuucuuuauccugaugaugcuuguggcgcccagcuauggcaugcgcugugucggggugggaaacagagauuucguugaaggcguguccgggggagccugggucgaccuggugcucgagcacggcggcugcgugaccacaauggcucaggggaagccuacccuggauuuugaacugauuaagaccacagccaaagaggucgcucuccugcggacguacuguaucgaagccagcauuucuaauaucaccacagcgacccgcugcccgacacaaggagagcccuaucuuaaggaggaacaggaccagcaguacauuuguagacgggauaugguugaccgcggcugggggaacggaugcggccuguucgggaaaggaggcguggugaccugcgccaaguuuuccugucucggcaaaaucacggggaaucugguccaaaucgagaaccuugaauauacagugguugugaccguccauaauggagauacccacgcugugggcaacgacacaagcaaucacgggguuaccgccacaauuacgccuagaucucccuccguggaggucaagcugccugauuacggagaacucacccuggacugcgagccccggagcggcaucgacuucaacgagaugauucugaugaagaugaaaacaaagaccuggcucgugcauaaacagugguuucuggaucuuccgcugccuuggacaaccggggcugacacgcucgaaguccacuggaaucauaaggagagaauggugaccuucaaaguuccccacgccaagcgccaggaugugacaguccugggcucucaggaaggagccaugcacuccgcucuugcgggcgccaccgagguggacagcggggauggaaaccauauguuugcuggccaccugaaauguaagguucggauggaaaagcucagaaucaaagggauguccuacacaaugugcucuggaaaguucagcauugacaaagagauggccgagacccaacauggcacgacaguggucaaggugaaauaugaagggaccggcgccccuuguaaggugcccaucgagauccgcgauguuaauaaggaaaaagucgugggacggauuaucuccagcacacccuucgcugagaacaccaacucugugaccaauauugagcuggaaccuccguuuggcgacuccuacaucgucauuggggugggagauagcgcccugacacuccacugguucagaaagggcucuagcaucgggaaaauguuugaguccacguaucgcggagcgaagcggauggcuauccugggcgaaaccgccugggacuucgggucuguuggcggacuucugacaagccucggcaaagccgugcaucaggucuuuggguccguguacaccacaauguucggaggcguuagcuggauggugagaauucugaucgggcugcuuguccucuggauuggaaccaacucucgcaauacguccauggcuaugagcugcaucgccgugggcgggauuacacuguuucugggcuucaccguucacgcugauaugggauguguggucucuugguccggcaaggagcucaagugcgggagcggaaucuuugugauugacaacgugcacaccuggacagaacaguauaaauuccaacccgaguccccugcccggcuggcgucugccauccuuaaugcucauaaggagggcgucugugggaucagaagcaccacacgccuggaaaacguuauguggaaacagauuacgaaugagcucaacuacgugcugugggaaggaggccacgaccugaccguggucgccggcgaugugaaggggguucuuuccaaaggaaagcgggcucucgcccccccugugaaugaccugaaguauucuuggaaaacauggggcaaggcgaaaaucuuuacccccgagacaagaaacagcaccuuccuggucgaugggccggacacguccgaaugcccuaaugagcggcgcgccuggaacuuucucgagguggaagauuacggauucggcauguucaccacaaauauuuggaugaaguuuagagaggggagcucugaaguuugugaccaucggcugauguccgcugccaucaaagaucagaaggcugugcacgccgacaugggauacuggauugagagcucuaaaaaccagaccuggcaaaucgaaaaggccucccuuaucgaggucaagacaugccuguggcccaaaacccacacacucuggagcaauggcgugcuggagucucagaugcugauuccuaaggcuuaugcgggccccaucagccagcauaacuacagacagggguaugccacccaaacggcuggaccuuggcaccuuggcaaacucgaaauugauuucggggagugccccggaacaaccguuaccauccaggaagacugugaucaucgcggcccgucccugcggacaaccacggccagcgggaagcuggugacacaguggugcuguagaucuugcaccaugccuccccuccgcuuucugggagaggacggcuguugguacggcauggagauuagaccccuuaacgaaaaagaggaaaauauggucaagucccaggugagcgccgggcaaggaacauccgagaccuucucuaugggccugcucugccugacacuguuuguggaagagugucuucggcgcagagucacccggaagcacaugauccucguuguggugacgacccugugcgcuaucauucuggggggacucacauggauggaucugcuucgcgcccugaucaugcucggcgacaccaugagcgggagaaugggaggccagauucaucuggcgaucauggcugucuucaaaauguccccuggcuaugugcuggggauuuuucuucggaagcugacaucucgcgagaccgcccucaugguuaucggaauggccaugacgacagugcugagcaucccgcacgaccucauggaauucauugauggcaucucccuggggcuuauucugcucaaaauggucacccacuuugacaacacacaggugggaacccuggcucuggcccuuaccuucaucaagucuacaaugccccugguuauggcguggagaacgauuauggcugugcucuuugucgugacccugaucccucucugucggacaagcugccugcagaaacaaucccauugggucgagauuaccgcccuuauccugggcgcccaggcucuccccguguaccugaugacacugaugaagggggccagcaagcgcucuuggccucuuaaugaaggaaucauggcuguuggccuggugucccuccugggcagcgcccuccugaaaaacgaugucccccuugcggggccuaugguggccggaggccugcugcucgcugccuauguuaugucuggguccagcgcugaccugucucuugagaaggccgccaaugugcagugggaugaaauggcugacauuaccggauccagccccaucauugaggucaaacaagaugaggacggcuccuucagcaucagagauguggaagagacgaacaugauuacacugcucgugaagcuggcgcucaucaccguuucugggcuguacccgcuugccaucccugucaccaugacacugugguacauguggcaggugaaaacccagcggagcggagcucugugggacgugcccuccccugccgccgcucagaaggccacacucacggaaggcgucuauagaauuaugcaacgcggccuguuugggaagacccaggugggaguuggcauccacacagaggggguguuccauaccauguggcacgucacacggggaucugugauuugucaugaaagcggcagacuugagcccuccugggcggauguucgcaaugacaugaucucuuacgggggaggcuggcggcugggcgauaaaugggacaaggaggaagacgugcagguccucgcuauugagccggggaaaaacccuaagcacgugcagaccaaacccggacuguucaagacgcucaccggcgaaaucggggccguuacacuggauuuuaaaccuggaaccagcggcucccccaucauuaauagaaaggggaaggugaucggccuuuauggaaacggcgucgugacaaaaucuggggacuacgugagcgccauuacccaagcugagcgcaucggagagcccgauuaugaagucgacgaggauauuuuccggaagaaaagacugacaaucauggaccugcacccuggcgccgggaagacgaaacgcauucucccguccaucguucgggaagcgcugaagagacggcuucgcacccugauccucgcucccacaagagugguggccgccgagauggaagaggcucugcggggacucccuauucgcuaccagacccccgccgucaagagcgagcauaccggcagagaaaucguggaucugaugugccacgcuacauuuacgacccggcuucugucuuccacaagaguuccuaauuauaaccugauugugauggacgaggcccauuucaccgaucccagcucugucgcggcccgcggguacaucuccacacggguggaaaugggcgaggcugccgcuauuuuuaugaccgccacgccuccgggaacaaccgaccccuucccucagagcaauucccccaucgaagauaucgagagagagauuccugaacgcucuuggaacaccggcuuugacuggaucacagacuaccaggggaaaaccguuugguucgugcccagcauuaaggccggaaaugauaucgcuaacugccuccggaaauccggcaagaaagucauucaacugagcagaaagacauuugacaccgaguauccgaagacgaaacuuacagauugggacuucguggucaccacagauaucucugaaaugggggcgaacuuucgcgccggacgggugaucgacccuagacgcugucugaagcccguuauucucaccgauggccccgagagagugauccuggcugggccuauucccgugacgccugccuccgccgcucagcggcgcggcagaaucggacggaauccggcccaggaagacgaucaauacgucuucagcggcgacccccugcgcaacgaugaggaccacgcgcacuggaccgaggcuaaaaugcuccuugauaauauuuauacaccugaagggaucauucccacccuguucggaccugagagagaaaagacacaggccaucgacggcgaguuucggcugagaggggagcagcgcaaaaccuucguugaacucaugcggagaggagaccugcccguguggcuuucuuacaagguggccagcgcuggcaucuccuauaaggaucgcgaguggugcuuuacaggcgaacggaacaaucagauucuggaggaaaacauggaggucgagaucuggaccagagaaggggagaaaaagaaacuccggccgaaguggcuggacgcccgcguguacgcggauccuauggcccugaaagacuucaaggaauuugcuucuggaagaaagagcauuacgcucgauauccuuacagagauugccucccugcccauguaucugucuagccgggcuaaacucgcccuggacaauaucguuaugcuucauaccaccgaacgcggcgggaaggcuuaccaacacgcccugaacgagcucccugagucccuggaaacacugaugcucguggcgcuucugggagccaugaccgcuggcaucuuccuguuuuucaugcaggggaaaggaauuggcaagcucagcaugggccugaucgccauugcugucgccucugggcuucuguggguggccgagauccagccccaguggauugcugcguccaucauccucgaauuuuuccugaugguccugcucgugccugagcccgaaaaacaaagaacaccgcaggauaaucagcuuauuuacguuauccugacgauucugaccaucauugcccucguggcugccaacgagaugggacugaucgagaagacaaaaaccgacuuuggcuucuaucaggucaaggccgaaacaaccauucuugauguggaccugcggccugcuagcgccuggacgcucuacgcgguugccaccacaauccugacccccaugcugcgccauacaaucgagaauaccuccgcuaaccucucucuugccgcuauugccaaucaagcggccgugcugauggggcugggaaagggcuggccccuccacagaauggaucugggggucccucuucuggcuaugggauguuauagccaggugaacccgacgacacucaccgccucccuggugaugcugcucguucauuacgcuaucauuggccccggccuucaggccaaagcuacacgggaagcccagaagcgcaccgcggccgggaucaugaaaaauccuaccgucgacggaauuacagugaucgaucuggagcccaucucuuaugacccuaaguuugagaaacaacugggccaggugaugcuccugguccuuugcgcugggcagcugcuccugaugagaacgaccugggccuucugugaaguucugacacucgcuaccggacccauucuuacacugugggagggcaacccugggcgguucuggaacaccacgaucgccgugagcacagccaauauuuuuagaggauccuaccuggcgggcgcuggccucgccuucagccugaucaagaacgcucaaaccccgcgccgggggaccggaacaaccggcgaaacacuuggggagaaguggaaaagacagcugaauucucucgaccgcaaggaauuugaggaguauaaacgguccggaauucuggaaguggauagaacggaggccaagagcgcccugaaagacggcucuaagaucaaguucgcugucucccgcgggaccagcaaaauccgguggauuguggaaagaggaaugguuaagcccaaaggcaagguggucgaucucggcugcgggcgcggaggcuggucuuacuacauggccacacuuaaaaacgugaccgagguuaagggguauacaaagggaggcccugggcacgaagagcccgugccuauggcgaccuacggauggaaucuggucaaacugcacagcggcguggacguguuuuauaagcccacggagcaggucgauacccuccugugugacaucggcgaauccucuagcaacccgacaauugaggaagggcggacccuuagaguucugaaaaugguggagccuuggcucuccagcaagcccgaauucugcaucaaagugcugaaucccuacaugccuacagucauugaggagcuggaaaagcuccagcgccggcauggaggcucccuugugagauguccccugucucgcaacagcacccacgagauguauuggguuuccggggugucuggaaauaucgucagcuccgugaacacaaccucuaaaaugcugcucaauagauuuacgacacggcaucgcaagccuaccuacgaaaaggaugccgaccugggcgcugggaccagaagcguuuccacagagacggagaaaccggauaugaccauuaucggacggagacuucaacggcugcaggaagagcacaaggaaacauggcacuaugaccaugagaaccccuaccgcaccugggccuaccacggcagcuaugaagcuccuucuacaggcuccgccagcucuauggugaauggggucgugaaacuccugaccaagcccugggauguugugccuauggucacacagcuggcgaugaccgacacgacccccuucggacagcaaagaguguuuaaagagaaggucgacacacggaccccgcagccuaagcccggcacacgcgugaucaugaccacgacagccaacuggcucuggacccugcuugggagaaaaaagaauccucggcugugcacacgcgaggaauucauuuccaaaguuagaagcaacgcugccaucggagcuguguuucaggaggaacagggcuggaccucugccuccgaggcugucaaugauagccgguucugggaacucguggacaaggagcgcgcccugcaucaagaggggaaaugugaauccugcguguacaacaugaugggcaagagagagaagaaacuuggagaauuuggccgggcgaaggggagccgcgccauuugguauauguggcugggagcuagauuccucgaguucgaagcccugggcuuucugaacgaggaucacugguucgggcgggagaauucuuggagcggaguugaaggcgaggggcuccaucgccugggcuacauccuugaagacauugauaaaaaggacggagaucugaucuaugcugacgauacggccggcugggacaccagaaucacagaggaugaccuccugaacgaggaacuuauuaccgagcagauggccccccaccacaaaauccuggcgaaggcuauuuuuaagcucacauaccagaauaaaguggucaaggugcugcggccuacccccaaaggggccguuauggauaucauuuccagaaaggaccaacgcggaucuggccagguggggacauauggacugaacaccuucacgaauauggaaguccagcucauccggcagauggaggccgaaggcgugaucacacaagacgauaugcauaacccgaaagggcugaaggagagagucgagaaauggcuuaaggaaugcggcguggaccgccugaagcggauggcuauuagcggagaugacuguguugugaaaccucucgaugagagauuuuccaccucucugcuuuuccugaaugacaugggcaagguccgcaaagauaucccccagugggaacccagcaagggguggaaaaacuggcaggaggugccuuuuugcucccaccauuuccacaagauuuuuaugaaggacggacggucucucguugugccguguagaaaucaggaugaacugaucggccgcgcccggauuagccaaggggcuggauggucccugagagagaccgccugccucggcaaagcguacgcccagauguggagccugauguacuuccaccgccgggaccuuagacuggcuucuauggccaucuguuccgcuguccccacagagugguuuccuaccagccggacaacguggucuauccaugcccaccaucaguggaugaccacagaagauaugcucaagguguggaacagaguguggauugaggacaaucccaacaugaucgacaaaaccccuguucacuccugggaagauauucccuaucuggggaagcgcgaggaccuuuggugcggcagccugaucggacucuccucucgggcgacaugggccaaaaauauucauaccgcuaucacgcaggucagaaaccugauuggcaaggaagaguacguggauuauaugccugccaugcgcagauacagcgcucacuucgaguccgaaggggugcuguga

SEQ ID NO: 20954 - RNA, 9867 nt, Artificial Sequence
  derived and/or modified CDS sequence (opt5) from DENV-4__KP188557__SS-prME
agcaccaucacccugcucugccugauucccacggugauggcuuuccaccuuuccaccagagacggcgaaccucugaugaucguggcuaagcaugaacgggggcgcccgcuccuguuuaagaccaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccagcgcguggagucuuggauccuuagaaauccuggcuucgcucugcucgccggcuuuauggcuuacaugaucgggcagacaggcauucaacggaccguuuucuuugugcugaugaugcuugucgcccccagcuauggaaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggucuggccgggagcugaagugcggguccggaaucuucgucguugauaaugugcauacauggaccgaacaauacaaauuucagcccgagagcccugcgagacuggccuccgcuauucucaacgcccacaaggacggcgugugugggauccgcucuacaacgcggcuggagaaugucauguggaaacagauuaccaacgaacuuaauuaugugcugugggagggaggccacgaccucacaguuguggcuggcgaugucaagggggugcugaccaaaggaaagagagcccugacacccccugcgagcgaccuuaaguacuccuggaaaaccuggggcaaggcccggaucuucacgcccgaagcucgcaacaauaccuuucucaucgaugggccggacacaucugagugcccuaacgaaagacgggccuggaauagcuucgagguugaggauuacggauucggcauguuuaccacaaacauuuggaugaaauucagagaaggguccagcgaggugugugaccaucgccugaugucugcugccaucaaggaucagaaagccguccacgcugacaugggauauuggauugaauccagcaagaaucaaaccuggcagaucgagcgggcgucucugauugaagugaaaacaugccucuggcccaagacccauacgcugugguccaacggcguucuugagagccagaugcugaucccuaagucuuacgccggccccuuuagccagcacaacuauagacaaggguacgcuacacagaccgugggaccuuggcaccucggcaaacuggagaucgauuucggggaaugccccggaaccacagucaccauucaggagaauugugaccaucgcggcccgucccugagaacgacaaccgccagcgggaaacuugugacacaguggugcugucggucuugcaccaugccuccccuccgcuuucugggagaagauggcuguugguauggcauggagaucagaccccuguccgagaaagaagagaacauggucaagagccaagucacagccgggcagggaaccuccgaaacguucucuaugggccuccugugccuuacccuguuuguugaggaaugucuccggcgcagagugacacggaaacacaugauucuggcuguggucaucacccugugcgccauuauccuugggggacucacauggauggaccugcugcgcgcgcucaucaugcugggcgauaccaugagcgggagaauuggaggccagacgcaucuugcuaucauggccguguucaagauguccccuggcuacguucuggggguguuucuccggaagcugacaucucgcgagaccgcccugauggucauuggaauggcuaugacaaccacccuuagcaucccgcacgaccugauggagcucauugacggcaucucccuggggcucauccugcuuaaaauugugacacaguucgauaauacgcaaguuggaacccuggcccucucucugacauuuaucagaagcaccaugucccuggugauggcguggcggacaauuauggcuguccuuuucguggucacccugaucccccucuguagaacgagcugccugcagaagcagucucauuggguggaaauuacagcccucauccugggcgcccaagcccuuccuguuuaucugaugacccucaugaaaggggccucccgccggagcuggccccugaacgagggaauuauggcugugggccuggucucucuucugggcuccgcccuccugaagaaugacgugccucucgcggggcccaugguugccggaggccugcuucuggcugccuacgugaugagcgggucuuccgcugaucugagccucgaaaaagccgccaacgucagaugggacgagauggcugauaucaccggauccagcccuaucauugaagugaagcaggacgaggauggcucuuuuagcauccgcgacguggaggaaacaaauaugauuacccugcuuguuaagcuggcgcucaucacagucuccgggcuguacccccucgccauuccgaucacgaugacccugugguauauguggcaagugaaaacacagcggucuggagcucuuugggaugugccuagccccgccgccacccaaaaggcugcccuguccgagggcgucuacagaaucaugcagcgcggccuguucgggaaaacacaggugggaguuggcauucacauggaagggguguuccacaccauguggcaugucacgcggggaucugugaucugucacgagaccggcagacucgaaccuagcugggcggacguucgcaacgauaugauuuccuaugggggaggcuggcggcugggcgacaagugggauaaagaggaggacgugcagguccuugcuaucgaacccgggaagaauccgaagcaugugcaaacaaaaccuggacuguuuaagacccucacaggcgagauuggggccguuacccuggacuucaaacccggaacaucuggcagcccuaucaucaacagaaaggggaaagugauuggccucuacggaaauggcgucgugacgaaguccggggauuaugugagcgccaucacccaggcugaacggauuggagagcccgacuacgaggucgaugaagacaucuuucgcaaaaagagacugacaauuauggaucuucaccccggcgccgggaagaccaaacggauccugccuucuauuguucgcgaggcgcugaagagacggcucagaacccugauccuugcuccgacacgcgugguggccgccgaaauggaggaagcucugcggggacuccccaucagauaucagacgccugccgucaaauccgagcauaccggccgcgagauuguggaccugaugugccacgcuacauucaccacacggcuccugagcucuaccagaguucccaacuacaaucuuaucgugauggaugaagcccacuuuacggacccuuccagcgucgcggcccgcggguacauuuccacacggguggagaugggcgaagcugccgcuaucuucaugaccgccacacccccuggagccacagauccguuuccccagucuaacagcccuauugaggacaucgaaagagagauccccgagcgcuccuggaauaccggcuucgauuggauuacagacuaucaagggaagaccguuugguuugugccuagcaucaaagcuggaaacgacauugcgaacugccugagaaagucuggcaagaaagucauccagcugucccggaagacguucgauacagaauaccccaaaaccaagcucacagacugggauuuuguggucaccacggacauuagcgagaugggggccaauuuccgcgcuggaagagugaucgauccgcggcgcugucugaaaccuguuauccuuaccgacgcccccgaaagagugauucuggccggccccaucccugugacacccgcuucugccgcgcagcggagagggcgcauuggccggaacccugcucaagaggaugaccaguaugucuucagcggagauccgcucaagaaugacgaagaucaugcccacuggaccgaggccaagaugcugcuggacaacaucuacacacccgagggcauuaucccuacccucuuugggcccgaaagagagaaaacacaggcuauugauggagaguuccgccuucggggcgagcagagaaagaccuuuguugagcugaugcggcgcggggaccugccuguguggcucuccuauaaaguggccucugcgggaaucagcuacaaggacagagaauggugcuucacgggcgagcggaauaaccaaauccuggaagagaauauggaagucgagauuuggacacgcgagggcgagaagaagaaacuuagacccaaauggcuggaugcccggguguaugcugacccgauggcccucaaggauuuuaaagaguucgcuuccgggcgcaagucuaucacccuggacauucugaccgaaaucgccagccucccuacauaccuuuccagcagagcuaaacuggcccuggauaacauuguuaugcuccauaccacagagcggggaggccgcgcguaccagcacgcccugaaugaacuucccgagucucuggagacgcucaugcugguggcucugcucggggccaugaccgcuggaaucuuucuuuucuuuaugcagggcaaggggaucggaaagcuguccaugggccugauuacaaucgccgucgccagcggccuccuguggguggcugaaauucagccucaauggaucgcggccuccauuauccuugaguucuuucugaugguccuccugauccccgaaccugagaaacagagaacaccccaggacaaccagcugauuuaugugauccucacaauucuuaccaucauugggcugaucgcugccaaugaaaugggacugauugagaagacgaaaaccgauuucggcuuuuaccaaguuaagacagagaccacaauccucgacguggaucugcggccggccucugcuuggacccuuuaugccgucgcgacgacaauccugaccccuaugcucagacacacaauugaaaacaccagcgccaaucugucccuggcugccaucgcuaaccaggccgcggugcucauggggcuuggaaaaggcuggccccugcaucgcauggaccuggggguuccccuccuggccaugggauguuacucucaggugaauccuaccacacuuacggcuagccuggucaugcuccuggugcacuaugccauuaucggcccgggccugcaggcuaaggccacccgggaggcucagaagagaacagccgcggggauuaugaagaaccccaccguggauggaaucacaguuaucgaccucgaaccuauuuccuacgaucccaaguucgagaaacagcuuggccaggucaugcugcuggugcucugcgccgggcaacugcuucugaugcgcaccacgugggcuuucugugaggugcucacacuggccaccggaccuauccugacccucugggaaggcaaccccgggcgguuuuggaauacaaccauugcugucagcacagccaacaucuucagaggaucuuaucuugccggcgcgggccuggcuuuuucccugauuaagaaugcccagacgccucgccgggggaccggaacagcuggcgagacccucggggaaaaauggaagagacagcugaacagccuugaccgcaaagaguucgaagaguacaagcggucuggaauccuggagguugacagaacagaagccaaguccgcccucaaagauggcagcaagaucaaacaugcugugucucgcgggagcuccaagauucgguggaucguggagagaggaauggucaaaccgaagggcaaggugguugaccugggcugcgggcgcggaggcuggucuuacuauauggccacccugaaaaaugugacggaagucaagggguacaccaaaggaggccccgggcacgaggaaccuauucccauggcgacauauggauggaaccucgugaaacuucauagcggcguugauguguuuuacaaaccuaccgagcaggucgacacacugcugugugauaucggcgaguccagcuccaaucccaccauugaagaggggagaacacuccgggugcugaagaugguggaaccguggcuuucuagcaagccugaguucugcaucaaaguccugaaccccuauaugcccaccguuauugaagaacucgagaagcugcaacgcaaacacggaggcaaucuggugagauguccucucucccggaacucuacgcacgaaauguacugggugagcggggccuccggaaauaucgucucuagcgugaacacaaccuccaagaugcuucugaauagauuuaccacacggcaucgcaaacccacguaugagaaggacguugaucugggcgcugggaccagaagcgugucuacagaaaccgagaaaccugacaugacaaucauuggacggcgccuccagagacugcaggaggaacacaaggagaccuggcauuacgaucaggaaaacccguaccggacaugggccuaucacggcuccuacgaggcucccagcaccggcucugccuccagcauggucaauggggugguuaaacuucugacgaaaccuugggacgugauccccauggucacccaacucgcgaugacagauaccacaccuuucggacagcagcgcguguuuaaggaaaaaguugacaccagaacgccccagccgaagccuggcacacggauggugaugaccacaaccgccaacuggcugugggcucugcucgggaaaaagaagaauccccgccugugcacgagagaggaguucauuucuaaaguccgguccaacgccgcuaucggagccguguuucaagaagaacagggcuggaccagcgcuuccgaagccgucaacgacagccgcuucugggagcuuguggauaaggaaagagcgcugcaccaggaggggaaaugugagucuugcguuuauaauaugaugggcaagcgggagaagaagcucggagaguuuggccgcgccaaggggagcagagcuauuugguacauguggcugggagcccgguuccuugaguucgaggcucugggcuuucucaacgaagaccauugguucgggagagaaaauuccuggucuggaguggagggcgaagggcugcaccgccugggcuauauccucgaggaaaucgauaaaaaggacggagaucugauguacgccgacgauacagccggcugggacacccggauuacagaggaugaccuucaaaacgaggaacugaucaccgagcagauggcgccucaucacaaaauucucgcuaaggccaucuuuaaacugacauaucagaauaaggucgugaaggugcuuagacccaccccucgcggggccguuauggauauuaucagccggaaagaccagagaggauccggccaaguggggacguacggacugaacacauucaccaauauggaaguccagcucauccgccagauggaggcugaaggcgugauuacccaggaugacaugcaaaaccccaaggggcugaaagagcggguugagaaguggcugagagaaugcggcguggaccgccucaaacggauggccaucucuggagaugacugugucgugaagccgcuggaugagagauuuggcacaagccuucuguuccucaaugacauggggaaaguccgcaaggauauuccucagugggaacccuccaagggauggaaaaacuggcaggaggugcccuuuugcucucaucacuuccacaagaucuuuaugaaagacggccggagccugguugugccuuguagaaaucaggaugaacuuauugggcgggcuagaaucucccaaggagccggcuggagccugcgcgagaccgcgugccucgggaaggccuacgcucagauguggucucugauguauuuccaucggagagaccugcgccucgccuccauggcuaucuguagcgccgucccgacagagugguuucccacgucuagaaccacaugguccauucacgcgcaucaccaguggaugaccacagaagauaugcugaaaguguggaaccggguuuggaucgaggacaauccuaacaugauugauaagacccccgugcacagcugggaagacaucccuuaccuuggcaagcgcgaggaccuguggugcggaucccucauuggccugucuagcagagccacgugggcuaaaaauauccauaccgccauuacacagguccggaaccuuaucgggaaggaagaguauguggauuacaugcccgugaugaaacgcuauuccgcuccuagcgagucugaaggaguucuguga

SEQ ID NO: 20955 - RNA, 9867 nt, Artificial Sequence
  derived and/or modified CDS sequence (opt5) from DENV-4__KP188558__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucaugauggagacacccacgccgugggcaaugauacaagcaaccacggggucacggcuaccaucacaccuagaucucccuccguggaggucaagcugccugacuacggagaacucacccuggacugcgagccccggagcggcaucgauuucaaugagaugauucugaugaagaugaaaaagaaaacauggcucgugcauaagcagugguuucuggaccuuccgcugccuuggaccacgggggccgauaccucugaaguucacuggaacuacaaagagagaauggugacauucaaggucccccaugcuaaacgccaggacgugaccguucucggcucccaggaaggagccaugcacagcgcccuggcuggcgcgacagagguggauuccggggacggaaaucacauguuugccggccaucuuaaguguaagguccggauggaaaaacugagaaucaaggggaugucuuauaccaugugcagcggaaaauucuccauugauaaggagauggcugagacgcaacacggcacaaccguggugaaaguuaaguacgaaggggccggcgccccuuguaagguccccaucgagauucgcgacgugaacaaagaaaagguggucggacgggugaucagcgcuacaccccucgccgagaauaccaacucuguuaccaacaucgagcuggaaccuccguucggcgauuccuauauugugaucggggucggaaauagcgcgcugacacuccauugguuuagaaaaggcucuagcauugggaagauguucgaguccacguaccgcggagcuaaacggauggccauccugggcgaaaccgccugggacuuugggucugugggcggacuuuucacaagccugggcaaggcuguucaccagguguuuggguccgucuauaccacaauguucggaggcgugagcuggaugauuagaauccucaucggguuucugguucuguggauuggaaccaacucucgcaauacguccauggccaugacaugcaucgcugugggcgggauuacccuuuuccucggcuuuaccguccaggccgauaugggauguguggugagcuggucuggccgggagcugaagugcggguccggaaucuucgucguugacaacgugcauacauggaccgaacaauacaaauuucagcccgagagcccugcgagacuggccuccgcuauucucaaugcccacaaggacggcgugugugggauccgcucuacaacgcggcuggagaacgucauguggaaacagauuaccaaugaacuuaacuaugugcugugggagggaggccacgaucucacaguuguggcuggcgacgucaagggggugcugaccaaaggaaagagagcccugacacccccugcgagcgaucuuaaguacuccuggaaaaccuggggcaaggccaaaaucuucacgcccgaagcucggaauucuaccuuucucaucgacgggccggauacaagcgagugcccuaacgaacgcagagccuggaauuccuucgagguugaggacuacggauucggcauguuuaccacaaacauuuggaugaaguuccgggaagggagcucugaggugugugaucauagacugauguccgcugccaucaaagaccagaaggccguccacgcugauaugggauauuggauugaaagcucuaaaaaucaaaccuggcagaucgagcgcgcgucccugauugaagugaagacaugccucuggcccaagacccauacgcuguggagcaacggcguucuugagucucagaugcugaucccuaaaagcuacgccggccccuuuucccagcacaauuaucggcaaggguacgcuacacagaccgugggaccuuggcaccucggcaagcuggagaucgacuucggggaaugccccggaaccacagucaccauucaggagaacugugaucauagaggcccgagccugcgcacgacaaccgccucugggaaacuugugacacaguggugcuguagauccugcaccaugccuccccuccgguuucugggagaagacggcuguugguauggcauggagauccgcccccugagcgagaaggaagagaacauggugaaaucccaagucacagccgggcagggaaccucugaaacguucagcaugggccuccugugccuuacccuguuuguugaggaaugucucagacggcgcgugacaagaaagcacaugauucuggcuguggucaucacccugugcgccauuauccuugggggacucacauggauggaucugcugcgggcgcucaucaugcugggcgacaccauguccgggcgcauuggaggccagacgcaucuugcuaucauggccguguucaagaugucuccuggcuacguucuggggguguuucucagaaaacugacaagccgggagaccgcccugauggucauuggaauggcuaugacaaccacccuuuccaucccgcacgaccugauggagcucauugauggcaucucucuggggcucauccugcuuaagauugugacacaguucgacaauacgcaaguuggaacccuggcccucagccugacauuuauccgcuccaccauuagccuggugauggcguggagaacaaucauggcuguccuuuucguggucacccugauuccccucugucggacgucuugccugcagaaacagucccauuggguggaaaucacagcccucauucugggcgcccaagcucuuccuguuuaucugaugacccucaugaagggggccagcagacgcucuuggccccugaacgagggaaucauggcugugggccuggucucccuucugggcagcgcccuccugaaaaaugaugugccucucgcggggcccaugguugccggaggccugcuucuggcugccuacgugaugucuggguccagcgcugaccugucccucgaaaaggccgccaacguccagugggaugagauggcugacaucaccggaagcucuccuauuaucgaagugaagcaggaugaggacggcagcuuuuccauucgggauguggaggaaacaaauaugaucacccugcuuguuaaacuggcgcucauuacagucucugggcuguacccccucgccaucccgaucacgaugacccugugguauauguggcaggugaagacacaaagaagcggagcucuuugggacgugccuucccccgccgccacccagaaagcugcccugucugagggcgucuaccgcauuaugcagcggggccuguucgggaagacacaggugggaguuggcauccacauggaagggguguuccacaccauguggcaugucacgagaggaagcgugauuugucacgagaccggccgccucgaaccuuccugggcggauguucggaacgacaugaucucuuaugggggaggcuggagacugggcgauaaaugggacaaggaggaggacgugcaaguccuugcuauugaacccgggaagaauccgaaacaugugcagacaaagccuggacuguuuaaaacccucacaggcgagaucggggccguuacccuggauuucaagcccggaacaagcggcuccccuaucauuaaccgcaaagggaaggugaucggccucuacggaaauggcgucgugacgaaaagcggggacuaugugucugccauuacccaggcugaacggaucggagagcccgauuacgaggucgacgaagauauuuuuagaaagaagcggcugacaaucauggaccuucaccccggcgccgggaaaaccaagcgcauucugccuuccaucguuagagaggcgcugaaacggcgccucagaacccugauccuugcuccgacacgggugguggccgccgaaauggaggaagcucugagaggacuccccauucgcuaucagacgccugccgucaagagcgagcauaccggccgggagaucguggaucugaugugccacgcuacauucaccacaagacuccugucuuccacccgcguucccaacuacaaucuuauugugauggacgaagcccacuuuacggauccuagcuccgucgcggcccggggguacaucucuacaagaguggagaugggcgaagcugccgcuauuuucaugaccgccacccccccuggagccacagacccguuuccccaaagcaacuccccuaucgaggauaucgaacgcgagauucccgagcggagcuggaauaccggcuucgacuggaucacagacuaucaggggaaaaccguuugguuugugccuucuauuaaggcuggaaacgauaucgcgaauugccugagaaaguccggcaaaaaggucauucagcugagccgcaaaacguucgacacagaauaccccaagaccaaacucacagauugggacuuuguggucaccacggauaucucugagaugggggccaacuucagagcuggacgggugaucgacccgcgcagaugucugaagccuguuauucuuaccgauggccccgaacgggugauccuggccgggcccauuccugugacacccgccagcgcugcccaacgcagaggccggaucggaagaaacccugcgcaggaggacgaucaguaugucuucuccggcgacccgcucaagaaugaugaagaccaugcucacuggaccgaggccaaaaugcugcuggauaacauuuacacacccgaggggaucauuccuacccucuuuggacccgaacgcgagaagacacaggccaucgacggcgaauuccggcuuagaggggagcaacgcaaaaccuuuguugagcugaugcggagaggagaccugccuguguggcucucuuauaagguggcuagcgccggcaucuccuacaaagaucgggaauggugcuucacgggcgagcgcaauaaccagauucuggaagagaauauggaagucgagaucuggacaagagagggggaaaagaagaaacuucggcccaaguggcuggacgcgcgcguguaugccgauccgauggcucucaaagacuuuaaggaguucgccucuggaagaaaaagcauuacccuggauauccugaccgaaauugcuucccucccuacauaccuuagcucucgggccaagcuggcucuggacaacaucguuaugcuccauaccacagagcgcggcgggagagccuaccagcacgcgcugaaugaacuucccgagucccuggagacgcucaugcugguggcccugcucggagcuaugaccgccggcaucuuucuuuucuuuaugcaggggaagggaauuggcaaacugagcaugggccugaucacaauugcugucgccuccgggcuccuguggguggccgaaauccaaccucaguggauugcugcgucuaucauccuugaguucuuucugaugguccuccugauucccgaaccugagaagcagcggaccccccaggauaaccaacugaucuaugugauucucacaauccuuaccauuaucggacugauugccgcuaaugaaaugggccugaucgagaaaacgaagaccgacuucggguuuuaccagguuaaaacagagaccacaauccucgauguggaccugcgcccggccagcgccuggacccuuuaugcugucgccacgacaauucugaccccuaugcucagacacacaaucgaaaacaccuccgcgaaucugucucuggccgcuauugccaaccaggcugccgugcucaugggacuuggcaagggguggccccugcaucggauggaucugggaguuccccuccuggcgaugggcuguuacagccaggugaauccuaccacacuuacggccucccuggucaugcuccuggugcacuaugcuaucauuggcccggggcugcaagccaaagcuaccagagaggcccagaagcgcacagcugccggaaucaugaagaaccccaccguggacggcaucacaguuauugaucucgaaccuaucagcuacgaccccaaauucgagaagcagcuugggcaagucaugcugcuggugcucugcgcgggacagcugcuucugaugcggaccacgugggccuucugugaggugcucacacuggcuaccggcccuauucugacccucugggaagggaaucccggaagauuuuggaacacaaccaucgccgucucuacagcuaacauuuuccgcggcuccuaucuugccggcgccgggcuggcguuuagccugaucaaaaaugcucagacgccucggagaggaaccggcacagccggggagacccucggagaaaaguggaaacgccagcugaacucucuugaccggaaggaguucgaagaguacaagagauccggcauccuggagguugaucgcacagaagcuaaaagcgcccucaaggacgggucuaaaauuaagcaugccgugagccggggauccucuaaaaucagauggauuguggagcgcggcauggucaagccgaagggcaaagugguugaucuggggugcggacggggcggguggagcuacuauauggcuacccugaagaaugugacggaagucaaaggauacaccaagggcgggcccggacacgaggaaccuauccccauggccacauauggcuggaaccucgugaaacuucauuccggcguugacguguuuuacaagccuaccgagcaagucgauacacugcugugugacauuggggagagcuccucuaaucccaccaucgaagagggaagaacacuccgcgugcugaagaugguggaaccguggcuuagcuccaaaccugaguucugcauuaagguccugaaccccuauaugcccaccguuaucgaagagcucgagaaacugcagagaaagcacggcgggaaucuggugcgguguccucucucucgcaacagcacgcacgaaauguacuggguguccggagcgucuggcaauaucgucagcuccgugaacacaaccagcaaaaugcuucugaauagauuuaccacacggcauagaaagcccacguaugagaaagauguugaccugggggccggaacccggucuguguccacagaaaccgagaagccugauaugacaauuaucggccgcagacuccagcggcugcaggaggaacacaaggagaccuggcauuacgaccaagaaaacccguaccgcacaugggcuuaucacggcagcuacgaggcccccucuaccggguccgcuagcucuauggucaauggagugguuaaacuucugacgaagccuugggaugugauucccauggucacccagcucgccaugacagacaccacaccuuucggccagcagagaguguuuaaagaaaagguugacacccggacgccccaaccgaaaccugggacacgcauggugaugaccacaaccgcgaacuggcugugggcccugcucggaaagaagaaaaaucccagacugugcacgcgggaggaguucaucuccaagguccgcagcaacgcugccauuggcgcuguguuucaggaagagcagggguggaccuccgccagcgaagcugucaaugauucuagauucugggagcuuguggacaaagaacgggcccugcaccaagagggcaagugugagagcugcguuuauaacaugaugggaaaacgcgaaaagaagcucggcgaguuugggagagcgaaaggaucccgggccaucugguacauguggcugggcgcucgcuuccuugaauucgaggcccugggguuucucaacgaagaucauugguucggaagagagaauucuuggagcggcguggagggggaaggccugcaccggcugggauauauccucgaggaaauugacaagaaagauggcgaccugauguacgcugaugacacagccgggugggauaccagaaucacagaggacgaucuucagaacgaggaacugauuaccgagcagauggccccucaucacaagauccucgcgaaagcuauuuuuaagcugacauaucagaauaaggucgugaaagugcuucgccccaccccucggggagccguuauggacaucaucuccagaaaggaucaacgcggcucugggcaggugggaacguacggccugaacacauucaccaauauggaaguccagcucauucggcagauggaggccgaaggggugaucacccaagacgacaugcagaaccccaaaggccugaaggagagaguugagaaauggcugcgcgaaugcggaguggaucggcucaagagaauggcuauuagcggcgacgauugugucgugaaaccgcuggacgagcgcuuugggacaucccuucuguuccucaaugauaugggaaagguccggaaggacaucccucagugggaacccucuaaaggcuggaagaacuggcaggaggugcccuuuugcagccaucacuuccacaaaauuuuuaugaaggaugggagaucccugguugugccuugucgcaaucaagacgaacuuaucggacgggccagaaucagccagggcgcuggguggucucugcgggagaccgccugccucggcaaagcguacgcccagauguggucccugauguauuuccauagacgcgaucugcggcucgcuagcauggccauuuguucugcugucccgacagagugguuucccacguccagaaccacauggagcauccacgcccaucaccaguggaugaccacagaagacaugcugaagguguggaaccgcguuuggauugaggauaauccuaacaugaucgacaagacccccgugcacuccugggaagacauuccuuaccuuggaaaaagagaggaucuguggugcggcucucucaucgggcugagcucccgggcgacgugggccaagaauauucauaccgcuaucacacaaguccgcaaccuuaucggaaaagaagaguauguggacuacaugcccgugaugaagagauauagcgccccuucugaguccgaaggcguucuguga

SEQ ID NO: 20956 - RNA, 9867 nt, Artificial Sequence
  derived and/or modified CDS sequence (opt5) from DENV-4__KP188563__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggucuggccgggagcugaagugcggguccggaaucuucgucguugauaaugugcauacauggaccgaacaauacaaauuucagcccgagagcccugcgagacuggccuccgcuauucucaacgcccacaaggacggcgugugugggauccgcucuacaacgcggcuggagaaugucauguggaaacagauuaccaacgaacuuaauuaugugcugugggagggaggccacgaccucacaguuguggcuggcgaugucaagggggugcugaccaaaggaaagagagcccugacacccccugcgagcgaccuuaaguacuccuggaaaaccuggggcaaggccaaaaucuucacgcccgaagcucggaacucuaccuuucucaucgaugggccggacacaagcgagugcccuaaugaacgcagagccuggaacuccuucgagguugaggauuacggauucggcauguuuaccacaaauauuuggaugaaguuccgggaagggagcucugaggugugugaccauagacugauguccgcugccaucaaagaucagaaggccguccacgcugacaugggauauuggauugaaagcucuaaaaaccaaaccuggcagaucgagcgcgcgucccugauugaagugaagacaugccucuggcccaagacccauacgcuguggagcaauggcguucuugagucucagaugcugaucccuaaaagcuacgccggccccuuuucccagcacaacuaucggcaaggguacgcuacacagaccgugggaccuuggcaccucggcaagcuggagaucgauuucggggaaugccccggaaccacagucaccauucaggagaacugugaccauagaggcccgagccugcgcacgacaaccgccucugggaaacuugugacacaguggugcuguagauccugcaccaugccuccccuccgguuucugggagaagauggcuguugguauggcauggagauccgcccccugagcgagaaggaagagaauauggugaaaucccaagucacagccgggcagggaaccucugaaacguucagcaugggccuccugugccuuacccuguuuguugaggaaugucucagacggcgcgugacaagaaagcacaugauucuggcuguggucaucacccugugcgccauuauccuugggggacucacauggauggaccugcugcgggcgcucaucaugcugggcgauaccauguccgggcgcauuggaggccagacgcaucuugcuaucauugccguguucaagaugucuccuggcuacguucuggggguguuucucagaaaacugacaagccgggagaccgcccugauggucaucggaauggcuaugacaaccacccuuuccauuccgcacgaccugauggagcucaucgacggcaucucucuggggcucauucugcuuaagaucgugacacaguucgauaacacgcaaguuggaacccuggcccucagccugacauuuauucgcuccaccaugagccuggugauggcguggagaacaaucauggcuguccuuuucguggucacccugauuccccucugucggacgucuugccugcagaaacagucccauuggguggaaaucacagcccucauucugggcgcccaagcucuuccuguuuaucugaugacccucaugaagggggccagcagacgcucuuggccccugaaugagggaaucauggcugugggccuggucucccuucugggcagcgcccuccugaaaaacgacgugccucucgcggggcccaugguugccggaggccugcuucuggcugccuacgugaugucuggguccagcgcugaucugucccucgaaaaggccgccaauguccagugggacgagauggcugauaucaccggaagcucuccuauuaucgaagugaagcaggacgaggauggcagcuuuuccauucgggacguggaggaaacaaacaugaucacccugcuuguuaaacuggcgcucauuacagucucugggcuguacccccucgccaucccgaucacgaugacccugugguauauguggcaggugaagacacaaagaagcggagcucuuugggaugugccuucccccgccgccacccagaaagcugcccugucugagggcgucuaccgcauuaugcagcggggccuguucgggaagacacaggugggaguuggcauccacauggaagggguguuccacaccauguggcaugucacgagaggaagcgugauuugucacgagaccggccgccucgaaccuuccugggcggacguucggaaugauaugaucucuuaugggggaggcuggagacugggcgacaaaugggaucgcgaggaggacgugcaaguccuugcuauugaacccgggaagaacccgaagcaugugcagacaaaaccuggacuguuuaagacccucacaggcgagaucggggccguuacccuggacuucaaacccggaacaagcggcuccccuaucauuaaucggaaggggaaagugaucggccucuacggaaacggcgucgugacgaagagcggggauuaugugucugccauuacccaggcugaaagaaucggagagcccgacuacgaggucgaugaagacauuuuucggaaaaagcgccugacaaucauggaucuucaccccggcgccgggaagaccaaaagaauucugccuuccaucguucgggaggcgcugaagcgcagacuccggacccugauccuugcuccgacaagagugguggccgccgaaauggaggaagcucugcgcggacuccccauucgguaucagacgccugccgucaaaagcgagcauaccggcagagagaucguggaccugaugugccacgcuacauucaccacacgccuccugucuuccacccggguucccaauuacaaccuuauugugauggaugaagcccacuuuacggacccuagcuccgucgcggccagaggguacaucucuacacgcguggagaugggcgaagcugccgcuauuuucaugaccgccacccccccuggagccacagauccguuuccccaaagcaauuccccuaucgaggacaucgaacgggagauucccgagagaagcuggaacaccggcuucgauuggaucacagacuaucaggggaagaccguuugguuugugccuucuauuaaagcuggaaaugacaucgcgaacugccugcgcaaguccggcaagaaagucauucagcugagcagaaagacguucgauacagaauaccccaaaaccaagcucacagacugggauuuuguggucaccacggacaucucugagaugggggccaacuuccgggcuggacgcgugaucgauccgagacggugucugaaaccuguuauucuuaccgacggccccgaacgcgugauccuggccgggcccauuccugugacacccgccagcgcugcccaaagacggggcagaaucggacgcaauccugcgcaggaggaugaccaguaugucuucuccggcgauccgcucaagaacgacgaagaucaugcucacuggaccgaggccaagaugcugcuggacaauauuuacacacccgaggggaucauuccuacccucuuuggacccgaacgggagaaaacacaggccaucgauggcgaauucagacuucgcggggagcaacggaagaccuuuguugagcugaugagacggggagaccugccuguguggcucucuuauaaaguggcuagcgccggcaucuccuacaaggaccgcgaauggugcuucacgggcgagagaaacaaucagauucuggaagagaacauggaagucgagaucuggacacgggagggggaaaaaaagaagcuucgccccaaauggcuggaugcgagaguguaugccgacccgauggcucucaaggauuuuaaagaguucgccucuggacggaagagcauuacccuggacauccugaccgaaauugcuucccucccuacauaccuuagcucucgcgccaaacuggcucuggauaauaucguuaugcuccauaccacagagagaggcgggcgggccuaccagcacgcgcugaacgaacuucccgagucccuggagacgcucaugcugguggcccugcucggagcuaugaccgccggcaucuuucuuuucuuuaugcaggggaagggaauuggcaagcugagcaugggccugaucacaauugcugucgccuccgggcuccuguggguggccgaaauccaaccucaguggauugcugcgucuaucauccuugaguucuuucugaugguccuccugauucccgaaccugagaaacagcgcaccccccaggacaaucaacugaucuaugugauucucacaauccuuaccauuaucggacugauugccgcuaacgaaaugggccugaucgagaagacgaaaaccgauuucggguuuuaccagguuaagacagagaccacaauccucgacguggaucugagaccggccagcgccuggacccuuuaugcugucgccacgacaauucugaccccuaugcuccggcacacaaucgaaaauaccuccgcgaaccugucucuggccgcuauugccaaucaggcugccgugcucaugggacuuggcaaaggguggccccugcauagaauggaccugggaguuccccuccuggcgaugggcuguuacagccaggugaacccuaccacacuuacggccucccuggucaugcuccuggugcacuaugcuaucauuggcccggggcugcaagccaaggcuacccgcgaggcccagaaacggacagcugccggaaucaugaagaaucccaccguggauggcaucacaguuauugaccucgaaccuaucagcuacgaucccaaguucgagaaacagcuugggcaagucaugcugcuggugcucugcgcgggacagcugcuucugaugagaaccacgugggccuucugugaggugcucacacuggcuaccggcccuauucugacccucugggaagggaaccccggacgcuuuuggaacacaaccaucgccgucucuacagcuaauauuuuccggggcuccuaucuugccggcgccgggcuggcguuuagccugaucaagaacgcucagacgccuagacgcggaaccggcacagccggggagacccucggagaaaaauggaagcggcagcugaauucucuugacagaaaagaguucgaagaguacaagcgcuccggcauccuggagguugaccggacagaagcuaagagcgcccucaaagaugggucuaagauuaaacaugccgugagcagaggauccucuaagauccgcuggauuguggagcggggcauggucaaaccgaagggcaaggugguugaccuggggugcggaagaggcggguggagcuacuauauggcuacccugaaaaacgugacggaagucaagggauacaccaaaggcgggcccggacacgaggaaccuauccccauggccacauauggcuggaaucucgugaagcuucauuccggcguugauguguuuuacaaaccuaccgagcaagucgacacacugcugugugauauuggggagagcuccucuaaccccaccaucgaagagggacgcacacucagagugcugaagaugguggaaccguggcuuagcuccaagccugaguucugcauuaaaguccugaaucccuauaugcccaccguuaucgaagagcucgagaagcugcagcggaaacacggcgggaaccuggugcgcuguccucucucuagaaauagcacgcacgaaauguacuggguguccggagcgucuggcaacaucgucagcuccgugaauacaaccagcaagaugcuucugaaccgguuuaccacaagacaucggaaacccacguaugagaaggacguugaucugggggccggaacccgcucuguguccacagaaauugagaaaccugacaugaccaucauuggcagacggcuccagcgccugcaggaggaacacaaggagacauggcauuacgaucaagaaaauccguacagaaccugggcuuaucacggcagcuacgaggcccccucuacaggguccgcuagcucuauggucaacggagugguuaagcuucugaccaaaccuugggacgugauccccauggucacgcagcucgccaugaccgauacaaccccuuucggccagcagcggguguuuaaggaaaaaguugacacacgcaccccccaaccgaagccugggacgagaauggugaugacaaccacagcgaauuggcugugggcccugcucggaaaaaagaagaacccccggcugugcacccgcgaggaguucauuuccaaagucagaagcaaugcugccaucggcgcuguguuucaggaagagcagggguggacguccgccagcgaagcugucaacgacucucgguucugggagcuuguggauaaggaacgcgcccugcaccaagagggcaaaugugagagcugcguuuauaacaugaugggaaagagagaaaaaaagcucggcgaguuugggcgggcgaagggaucccgcgccaucugguacauguggcugggcgcuagauuccuugaauucgaggcccugggguuucucaaugaagaccauugguucggacgggagaacucuuggagcggcguggagggggaaggccugcacagacugggauauauucucgaggaaaucgauaaaaaggacggcgaucugauguacgcugacgauaccgccgggugggacacacgcauuaccgaggaugaccuucagaaugaggaacugaucacagagcagauggccccucaucacaaaauucucgcgaaggcuaucuuuaaacugaccuaucagaacaaggucgugaaggugcuucggcccacaccuagaggagccguuauggauaucauuucccgcaaagaccaacggggcucugggcaggugggaaccuacggccugaauacguucacaaacauggaaguccagcucaucagacagauggaggccgaaggggugauuacccaagaugacaugcagaaucccaagggccugaaagagcgcguugagaaguggcugcgggaaugcggaguggacagacucaaacgcauggcuaucagcggcgaugacugugucgugaagccgcuggaugagcgguuugggaccucccuucuguuccucaacgacaugggaaaagucagaaaggauauuccucagugggaacccucuaagggcuggaaaaauuggcaggaggugcccuuuugcagccaucacuuccacaagaucuuuaugaaagacgggcgcucccugguugugccuugucggaaccaagaugaacuuaucggaagagcccggauuagccagggcgcuggguggucucugagagagacagccugccucggcaaggcguacgcccagauguggucccugauguauuuccaucgccgggaccugagacucgcuagcauggccaucuguucugcugucccgaccgagugguuucccacaucccgcacgaccuggagcauucacgcccaucaccaguggaugacaaccgaagauaugcugaaaguguggaauagaguuuggaucgaggacaacccuaauaugauugauaagacacccgugcacuccugggaagacaucccuuaccuuggaaagcgggaggaccuguggugcggcucucucauugggcugagcucccgcgcgaccugggccaaaaacauccauacggcuaucacccaagucagaaaucuuauuggaaaggaagaguauguggauuacaugagcgugaugaaacgguauucugcccccuccgagagcgaaggcguucuguga

SEQ ID NO: 20957 - RNA, 9867 nt, Artificial Sequence
  derived and/or modified CDS sequence (opt5) from DENV-4__KP188564__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccaucgcccaggggaagccuacccuggauuuugaacugacaaagacgaccgcuaaagagguugcccuccugcggacauacuguauugaagcucuuaucagcaauauuaccacagccacccgcugcccgacgcaaggagagcccuaucugaaggaggaacaggaccagcaguacaucuguagacgggaugugguggaccgcggcugggggaacggaugcggccucuucgggaaaggaggcgucgugacaugcgcgaaguuuucuuguuccggcaaaauuaccgggaaucugguucaaaucgagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcauugacuucaacgagaugauccugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaauuaaggggaugucuuauaccaugugcagcggaaaauucuccaucgacaaggagauggcugagacgcaacacggcacaaccguggugaaaauuaaguacgaaggggccggcgccccuuguaagguucccaucgagauccgcgaugucaauaaagaaaagguggugggacgggucauuagcgcuacaccccucgccgagaacaccaacucugugaccaauaucgagcuggaaccuccguucggcgacuccuauauuguuaucggggugggaaacagcgcgcugacacuccauugguuuagaaaaggcucuagcauugggaagauguucgaguccacguaccgcggagcuaaacggauggccauccugggcgaaaccgccugggauuuugggucugucggcggacuuuucacaagccugggcaaggcugugcaccagguuuuuggguccguguauaccacaauguucggaggcgucagcuggaugaucagaauucucaucggguuucuggugcuguggauuggaaccaauucucgcaacacguccauggccaugacaugcaucgcuguuggcgggauuacccuuuuccucggcuuuaccgugcaggccgacaugggaugugucgugagcuggucuggccgggagcugaagugcggguccggaaucuucguggucgauaauguucauacauggaccgaacaauacaaauuucagcccgagagcccugcgagacuggccuccgcuauucucaacgcccacaaggacggcgugugugggauccgcucuacaacgcggcuggagaaugugauguggaaacagaucaccaacgaacuuaauuauguccugugggagggaggccacgaccucacagugguugcuggcgaugugaaggggguccugaccaaaggaaagagagcccugacacccccugcgagcgaccuuaaguacuccuggaaaaccuggggcaaggccaaaauuuucacgcccgaagcucggaacucuaccuuucucaucgaugggccggacacaagcgagugcccuaaugaacgcagagccuggaacuccuucgagguggaggauuacggauucggcauguuuaccacaaauauuuggaugaaguuccgggaagggagcucugagguuugugaccauagacugauguccgcugccaucaaagaucagaaggccgugcacgcugacaugggauauuggauugaaagcucuaaaaaccaaaccuggcagaucgagcgcgcgucccugaucgaagucaagacaugccucuggcccaagacccauacgcuguggagcaauggcgugcuugagucucagaugcugauuccuaaaagcuacgccggccccuuuucccagcacaacuaucggcaaggguacgcuacacagaccguuggaccuuggcaccucggcaagcuggagaucgauuucggggaaugccccggaaccacagugaccauucaggagaacugugaccauagaggcccgagccugcgcacgacaaccgccucugggaaacuugucacacaguggugcuguagauccugcaccaugccuccccuccgguuucugggagaagauggcuguugguauggcauggagauccgcccccugagcgagaaggaagagaauauggugaaaucccaagugacagccgggcagggaaccucugaaacguucagcaugggccuccugugccuuacccuguuugucgaggaaugucucagacggcgcguuacaagaaagcacaugauucuggcuguggugaucacccugugcgccaucauucuugggggacucacauggauggaccugcugcgggcgcucaucaugcugggcgauaccauguccgggcgcauuggaggccagacgcaucuugcuaucauggccgucuucaagaugucuccuggcuacgugcuggggguuuuucucagaaaacugacaagccgggagaccgcccugauggugauuggaauggcuaugacaaccacccuuuccaucccgcacgaccugauggagcucaucgacggcauuucucuggggcucauccugcuuaagauugucacacaguucgauaacacgcaagugggaacccuggcccucagccugacauuuauccgcuccaccaugagccugguuauggcguggagaacaauuauggcugugcuuuucgucgugacccugaucccccucugucggacgucuugccugcagaaacagucccauugggucgaaauuacagcccucauccugggcgcccaagcucuuccuguguaucugaugacccucaugaagggggccagcagacgcucuuggccccugaaugagggaaucauggcuguuggccuggugucccuucugggcagcgcccuccugaaaaacgacgucccucucgcggggcccaugguggccggaggccugcuucuggcugccuacguuaugucuggguccagcgcugaucugucccucgaaaaggccgccaaugugcagugggacgagauggcugauauuaccggaagcucuccuaucauugaagucaagcaggacgaggauggcagcuuuuccauccgggacguggaggaaacaaacaugauuacccugcuugugaaacuggcgcucaucacaguuucugggcuguacccccucgccaucccgauuacgaugacccugugguauauguggcaggucaagacacaaagaagcggagcucuuugggaugugccuucccccgccgccacccagaaagcugcccugucugagggcguguaccgcaucaugcagcggggccuguucgggaagacacaggucggagugggcauucacauggaagggguuuuccacaccauguggcaugugacgagaggaagcgucaucugucacgagaccggccgccucgaaccuuccugggcggacgugcggaaugauaugauuucuuaugggggaggcuggagacugggcgacaaaugggauaaggaggaggacguucaagugcuugcuaucgaacccgggaagaacccgaaacauguccagacaaagccuggacuguuuaaaacccucacaggcgagaucggggccgugacccuggacuucaagcccggaacaagcggcuccccuauuaucaaucgcaaagggaagguuauuggccucuacggaaacggcguggucacgaaaagcggggauuaugugucugccaucacccaggcugaacggauuggagagcccgacuacgagguggaugaagacaucuuuagaaagaagcggcugacaauuauggaucuucaccccggcgccgggaaaaccaagcgcauccugccuuccaucgucagagaggcgcugaaacggcgccucagaacccugauucuugcuccgacacggguuguggccgccgaaauggaggaagcucugagaggacuccccauccgcuaucagacgccugccgugaagagcgagcauaccggccgggagauugucgaccugaugugccacgcuacauucaccacaagacuccugucuuccacccgcgugcccaauuacaaccuuaucguuauggaugaagcccacuuuacggacccuagcuccguggcggcccggggguacauuucuacaagagucgagaugggcgaagcugccgcuaucuucaugaccgccacccccccuggagccacagauccguuuccccaaagcaauuccccuaucgaggacauugaacgcgagauccccgagcggagcuggaacaccggcuucgauuggauuacagacuaucaggggaaaaccgugugguuuguuccuucuaucaaggcuggaaaugacauugcgaacugccugagaaaguccggcaaaaaggugauccagcugagccgcaaaacguucgauacagaauaccccaagaccaaacucacagacugggauuuugucgugaccacggacaucucugagaugggggccaacuucagagcuggacgggucauugauccgcgcagaugucugaagccugugauccuuaccgacggccccgaacggguuauucuggccgggcccaucccugugacacccgccagcgcugcccaacgcagaggccggauuggaagaaauccugcgcaggaggaugaccaguauguguucuccggcgauccgcucaagaacgacgaagaucaugcucacuggaccgaggccaaaaugcugcuggacaauaucuacacacccgaggggauuaucccuacccucuuuggacccgaacgcgagaagacacaggccaucgauggcgaauuccggcuuagaggggagcaacgcaaaaccuuugucgagcugaugcggagaggagaccugccuguuuggcucucuuauaagguggcuagcgccggcauuuccuacaaagaccgggaauggugcuucacgggcgagcgcaacaaucagauccuggaagagaacauggaaguggagauuuggacaagagagggggaaaagaagaaacuucggcccaaguggcuggaugcgcgcgucuaugccgacccgauggcucucaaagauuuuaaggaguucgccucuggaagaaaaagcaucacccuggacauucugaccgaaaucgcuucccucccuacauaccuuagcucucgggccaagcuggcucuggauaauaucgugaugcuccauaccacagagcgcggcgggagagccuaccagcacgcgcugaacgaacuucccgagucccuggagacgcucaugcugguugcccugcucggagcuaugaccgccggcauuuuucuuuucuuuaugcaggggaagggaaucggcaaacugagcaugggccugauuacaaucgcuguggccuccgggcuccugugggucgccgaaauucaaccucaguggaucgcugcgucuaucauucuugaguucuuucugauggugcuccugauccccgaaccugagaagcagcggaccccccaggacaaucaacugauuuaugucauccucacaauucuuaccaucauuggacugaucgccgcuaacgaaaugggccugaucgagaaaacgaagaccgauuucggguuuuaccaggugaaaacagagaccacaauucucgacguugaucugcgcccggccagcgccuggacccuuuaugcuguggccacgacaauccugaccccuaugcucagacacacaauugaaaauaccuccgcgaaccugucucuggccgcuaucgccaaucaggcugccguccucaugggacuuggcaagggguggccccugcaucggauggaccugggagugccccuccuggcgaugggcuguuacagccagguuaacccuaccacacuuacggccucccuggugaugcuccugguccacuaugcuauuaucggcccggggcugcaagccaaagcuaccagagaggcccagaagcgcacagcugccggaaucaugaagaaucccaccguggauggcauuacagugaucgaccucgaaccuauuagcuacgaucccaaauucgagaagcagcuugggcaaguuaugcugcugguccucugcgcgggacagcugcuucugaugcggaccacgugggccuucugugaggugcucacacuggcuaccggcccuacccugacacucugggaagggaaccccggaagauuuuggaacaccacaaucgccgugucuacggcuaauauuuuccgcggcuccuaucuugccggcgccgggcuggcguuuagccugaucaaaaacgcucagaccccucggagaggaacaggcaccgccggggagacacucggagaaaaguggaaacgccagcugaauucucuugaccggaaggaguucgaagaguacaagagauccggcauccuggaggucgaccgcaccgaagcuaaaagcgcccucaaggaugggucuaaaauuaagcaugccguuagccggggauccucuaaaaucagauggauuguggagcgcggcauggugaagccgaagggcaaagucguggaccuggggugcggacggggcggguggagcuacuauauggcuacgcugaagaacguuaccgaagugaaaggauacacaaagggcgggcccggacacgaggaaccuauccccauggccaccuauggcuggaaucucgucaaacuucauuccggcguggauguuuuuuacaagccuacagagcaaguggacacccugcugugugauauuggggagagcuccucuaaccccacaaucgaagagggaagaacccuccgcguccugaagaugguggaaccguggcuuagcuccaaaccugaguucugcauuaaggugcugaaucccuauaugcccacggucaucgaagagcucgagaaacugcagagaaagcacggcgggaaccugguucgguguccucucucucgcaauagcacacacgaaauguacuggguguccggagcgucuggcaacaucgugagcuccgucaauaccaccagcaaaaugcuucugaacagauuuacaacgcggcauagaaagcccaccuaugagaaagacguggaucugggggccggaacacggucuguuuccaccgaaacagagaagccugacaugaccauuaucggccgcagacuccagcggcugcaggaggaacacaaggagacauggcauuacgaucaagaaaauccguaccgcaccugggcuuaucacggcagcuacgaggcccccucuacgggguccgcuagcucuauggugaacggagucgugaaacuucugaccaagccuugggacguuauucccauggugacacagcucgccaugaccgauacaaccccuuucggccagcagagagucuuuaaagaaaagguggacacgcggacaccccaaccgaaaccugggacccgcaugguuaugacaaccacggcgaauuggcugugggcccugcucggaaagaagaaaaaccccagacugugcacccgggaggaguucaucuccaaggugcgcagcaaugcugccauuggcgcugucuuucaggaagagcagggguggacauccgccaacgaagcugugaacgacagcagauucugggagcuugucgauaaagaacgggcccugcaccaagagggcaagugugagucuugcguguauaauaugaugggaaaacgcgaaaagaagcucggcgaguuugggagagcgaaaggaagccgggccaucugguacauguggcugggcgcucgcuuccuugaauucgaggcccugggguuucucaacgaagaccauugguucggaagagagaauuccuggucuggcguugagggggaaggccugcaccggcugggauauauccucgaggaaauugauaagaaagacggcgaucugauguacgcugacgauaccgccgggugggacacaagaaucaccgaggaugaccuucagaacgaggaacugauuacagagcagauggccccucaucacaagauccucgcgaaagcuauuuuuaagcugaccuaucagaauaagguggucaaagugcuucgccccacgccucggggagccgugauggauaucaucagcagaaaggaccaacgcggcuccgggcagguuggaacauacggccugaacaccuucaccaauauggaagugcagcucauucggcagauggaggccgaaggggucaucacacaagaugacaugcagaaccccaaaggccugaaggagagaguggagaaauggcugcgcgaaugcggaguugaccggcucaagagaauggcuauuucuggcgaugacuguguggucaaaccgcuggaugagcgcuuugggaccagccuucuguuccucaaugacaugggaaaggugcggaaggauaucccucagugggaacccuccaaaggcuggaagaacuggcaggagguccccuuuugcucucaucacuuccacaaaauuuuuaugaaggacgggagaagccuggugguuccuugucgcaaucaagaugaacuuaucggacgggccagaaucucccagggcgcuggguggagccugcgggagacagccugccucggcaaagcguacgcccagauguggucucugauguauuuccauagacgcgaccugcggcucgcuuccauggccauuuguagcgcugugccgacggagugguuucccaccucuagaacaaccugguccauccacgcccaucaccaguggaugacaaccgaagauaugcugaaggucuggaaccgcguguggauugaggacaauccuaacaugaucgauaagacgcccguucacagcugggaagacauuccuuaccuuggaaaaagagaggaccuguggugcggcucccucaucgggcugucuagccgggcgaccugggccaagaauauucauacagcuaucacccaagugcgcaaccuuaucggaaaagaagaguaugucgauuacaugcccgugaugaagagauauuccgccccuagcgagucugaaggcgugcuguga

SEQ ID NO: 20958 - RNA, 9867 nt, Artificial Sequence
  derived and/or modified CDS sequence (opt5) from DENV-4__JN983813__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggucuggccgggagcugaagugcggguccggaaucuucgucguugauaaugugcauacauggaccgaacaauacaaauuucagcccgagagcccugcgagacuggccuccgcuauucucaacgcccacaaggacggcgugugugggauccgcucuacaacgcggcuggagaaugucauguggaaacagauuaccaacgaacuuaauuaugugcugugggagggaggccacgaccucacaguuguggcuggcgaugucaagggggugcugaccaaaggaaagagagcccugacacccccugcgagcgaccuuaaguacuccuggaaaaccuggggcaaggccaaaaucuucacgcccgaagcucggaacucuaccuuucucaucgaugggccggacacaagcgagugcccuaaugaacgcagagccuggaacuccuucgagguugaggauuacggauucggcauguuuaccacaaauauuuggaugaaguuccgggaagggagcucugaggugugugaccauagacugauguccgcugccaucaaagaucagaaggccguccacgcugacaugggauauuggauugaaagcucuaaaaaccaaaccuggcagaucgagcgcgcgucccugauugaagugaagacaugccucuggcccaagacccauacgcuguggagcaauggcguucuugagucucagaugcugaucccuaaaagcuacgccggccccuuuucccagcacaacuaucggcaaggguacgcuacacagaccgugggaccuuggcaccucggcaagcuggagaucgauuucggggaaugccccggaaccacagucaccauucaggagaacugugaccauagaggcccgagccugcgcacgacaaccgccucugggaaacuugugacacaguggugcuguagauccugcaccaugccuccccuccgguuucugggagaagauggcuguugguauggcauggagauccgcccccugagcgagaaggaagagaauauggugaaaucccaagucacagccgggcagggaaccucugaaacguucagcaugggccuccugugccuuacccuguuuguugaggaaugucucagacggcgcgugacaagaaagcacaugauucuggcuguggucaucacccugugcgccauuauccuugggggacucacauggauggaccugcugcgggcgcucaucaugcugggcgauaccauguccgggcgcauuggaggccagacgcaucuugcuaucauggccguguucaagaugucuccuggcuacguucuggggguguuucucagaaaacugacaagccgggagaccgcccugauggucauuggaauggcuaugacaaccacccuuuccaucccgcacgaccugauggagcucauugacggcaucucucuggggcucauccugcuuaagauugugacacaguucgauaacacgcaaguuggaacccuggcccucagccugacauuuauccgcuccaccaugagccuggugauggcguggagaacaauuauggcuguccuuuucguggucacccugaucccccucugucggacgucuugccugcagaaacagucccauuggguggaaauuacagcccucauccugggcgcccaagcucuuccuguuuaucugaugacccucaugaagggggccagcagacgcucuuggccccugaaugagggaauuauggcugugggccuggucucccuucugggcagcgcccuccugaaaaacgacgugccucucgcggggcccaugguugccggaggccugcuucuggcugccuacgugaugucuggguccagcgcugaucugucccucgaaaaggccgccaauguccagugggacgagauggcugauaucaccggaagcucuccuaucauugaagugaagcaggacgaggauggcagcuuuuccauccgggacguggaggaaacaaacaugauuacccugcuuguuaaacuggcgcucaucacagucucugggcuguacccccucgccauuccgaucacgaugacccugugguauauguggcaggugaagacacaaagaagcggagcucuuugggaugugccuucccccgccgccacccagaaagcugcccugucugagggcgucuaccgcaucaugcagcggggccuguucgggaagacacaggugggaguuggcauucacauggaagggguguuccacaccauguggcaugucacgagaggaagcgugaucugucacgagaccggccgccucgaaccuuccugggcggacguucggaaugauaugauuucuuaugggggaggcuggagacugggcgacaaaugggauaaggaggaggacgugcaaguccuugcuaucgaacccgggaagaacccgaaacaugugcagacaaagccuggacuguuuaaaacccucacaggcgagauuggggccguuacccuggacuucaagcccggaacaagcggcuccccuaucaucaaucgcaaagggaaggugauuggccucuacggaaacggcgucgugacgaaaagcggggauuauaucucugccauuacccaggcugaacggaucggagagcccgacuacgagguggaugaagacauuuuuagaaagaagcggcugacaaucauggaucuucaccccggcgccgggaaaaccaagcgcauucugccuuccaucgucagagaggcgcugaaacggcgccucagaacccugauccuugcuccgacacggguuguggccgccgaaauggaggaagcucugagaggacuccccauucgcuaucagacgccugccgugaagagcgagcauaccggccgggagaucgucgaccugaugugccacgcuacauucaccacaagacuccugucuuccacccgcgugcccaauuacaaccuuauuguuauggaugaagcccacuuuacggacccuagcuccguggcggcccggggguacaucucuacaagagucgagaugggcgaagcugccgcuauuuucaugaccgccacccccccuggagccacagauccguuuccccaaagcaauuccccuaucgaggacaucgaacgcgagauucccgagcggagcuggaacaccggcuucgauuggaucacagacuaucaggggaaaaccgugugguuuguuccuucuauuaaggcuggaaaugacaucgcgaacugccugagaaaguccggcaaaaaggugauucagcugagccgcaaaacguucgauacagaauaccccaagaccaaacucacagacugggauuuugucgugaccacggacaucucugagaugggggccaacuucagagcuggacgggucaucgauccgcgcagaugucugaagccugugauucuuaccgacggccccgaacggguuauccuggccgggcccauuccugugacacccgccagcgcugcccaacgcagaggccggaucggaagaaauccugcgcaggaggaugaccaguauguguucuccggcgauccgcucaagaacgacgaagaucaugcucacuggaccgaggccaaaaugcugcuggacaauauuuacacacccgaggggaucauuccuacccucuuuggacccgaacgcgagaagacacaggccaucgauggcgaauuccggcuuagaggggagcaacgcaaaaccuuugucgagcugaugcggagaggagaccugccuguuuggcucucuuauaagguggcuagcgccggcaucuccuacaaagaccgggaauggugcuucacgggcgagcgcaacaaucagauucuggaagagaacauggaaguggagaucuggacaagagagggggaaaagaagaaacuucggcccaaguggcuggaugcgcgcgucuaugccgacccgauggcucucaaagauuuuaaggaguucgccucuggaagaaaaagcauuacccuggacauccugaccgaaauugcuucccucccuacauaccuuagcucucgggccaagcuggcucuggauaauaucgugaugcuccauaccacagagcgcggcgggagagccuaccagcacgcgcugaacgaacuucccgagucccuggagacgcucaugcugguugcccugcucggagcuaugaccgccggcaucuuucuuuucuuuaugcaggggaagggaauuggcaaacugagcaugggccugaucacaauugcuguggccuccgggcuccugugggucgccgaaauccaaccucaguggauugcugcgucuaucauccuugaguucuuucugauggugcuccugauucccgaaccugagaagcagcggaccccccaggacaaucaacugaucuaugucauucucacaauccuuaccauuaucggacugauugccgcuaacgaaaugggccugaucgagaaaacgaagaccgauuucggguuuuaccaggugaaaacagagaccacaauccucgacguugaucugcgcccggccagcgccuggacccuuuaugcuguggccacgacaauucugaccccuaugcucagacacacaaucgaaaauaccuccgcgaaccugucucuggccgcuauugccaaucaggcugccguccucaugggacuuggcaagggguggccccugcaucggauggaccugggagugccccuccuggcgaugggcuguuacagccagguuaacccuaccacacuuacggccucccuggugaugcuccugguccacuaugcuaucauuggcccggggcugcaagccaaagcuaccagagaggcccagaagcgcacagcugccggaaucaugaagaaucccaccguggauggcaucacagugauugaccucgaaccuaucagcuacgaucccaaauucgagaagcagcuugggcaaguuaugcugcugguccucugcgcgggacagcugcuucugaugcggaccacgugggccuucugugaggugcucacacuggcuaccggcccuauucugacccucugggaagggaaccccggaagauuuuggaacacaaccaucgccgugucuacagcuaauauuuuccgcggcuccuaucuugccggcgccgggcuggcguuuagccugaucaaaaacgcucagacgccucggagaggaaccggcacagccggggagacccucggagaaaaguggaaacgccagcugaauucucuugaccggaaggaguucgaagaguacaagagauccggcauccuggaggucgaccgcacagaagcuaaaagcgcccucaaggaugggucuaaaauuaagcaugccguuagccggggauccucuaaaaucagauggauuguggagcgcggcauggugaagccgaagggcaaagucguggaccuggggugcggacggggcggguggagcuacuauauggcuacccugaagaacguuacggaagugaaaggauacaccaagggcgggcccggacacgaggaaccuauccccauggccacauauggcuggaaucucgucaaacuucauuccggcguggauguuuuuuacaagccuaccgagcaaguggacacacugcugugugauauuggggagagcuccucuaaccccaccaucgaagagggaagaacacuccgcguccugaagaugguggaaccguggcuuagcuccaaaccugaguucugcauuaaggugcugaaucccuauaugcccaccgucaucgaagagcucgagaaacugcagagaaagcacggcgggaaccugguucgguguccucucucucgcaauagcacgcacgaaauguacuggguguccggagcgucuggcaacaucgugagcuccgucaauacaaccagcaaaaugcuucugaacagauuuaccacacggcauagaaagcccacguaugagaaagacguggaucugggggccggaacccggucuguuuccacagaaaccgagaagccugacaugacaauuaucggccgcagacuccagcggcugcaggaggaacacaaggagaccuggcauuacgaucaagaaaauccguaccgcacaugggcuuaucacggcagcuacgaggcccccucuaccggguccgcuagcucuauggugaacggagucgugaaacuucugacgaagccuugggacguuauucccauggugacccagcucgccaugacagauaccacaccuuucggccagcagagagucuuuaaagaaaagguggacacccggacgccccaaccgaaaccugggacacgcaugguuaugaccacaaccgcgaauuggcugugggcccugcucggaaagaagaaaaaccccagacugugcacgcgggaggaguucaucuccaaggugcgcagcaaugcugccauuggcgcugucuuucaggaagagcagggguggaccuccgccagcgaagcugugaacgacucuagauucugggagcuugucgauaaagaacgggcccugcaccaagagggcaagugugagagcugcguguauaacaugaugggaaaacgcgaaaagaagcucggcgaguuugggagagcgaaaggaucccgggccaucugguacauguggcugggcgcucgcuuccuugaauucgaggcccugggguuucucaaugaagaccauugguucggaagagagaacucuuggagcggcguugagggggaaggccugcaccggcugggauauauccucgaggaaauugauaagaaagacggcgaucugauguacgcugacgauacagccgggugggacaccagaaucacagaggaugaccuucagaaugaggaacugauuaccgagcagauggccccucaucacaagauccucgcgaaagcuauuuuuaagcugacauaucagaacaagguggucaaagugcuucgccccaccccucggggagccgugauggauaucaucuccagaaaggaccaacgcggcucugggcagguuggaacguacggccugaauacauucaccaacauggaagugcagcucauucggcagauggaggccgaaggggucaucacccaagaugacaugcagaaucccaaaggccugaaggagagaguggagaaauggcugcgcgaaugcggaguugaccggcucaagagaauggcuauuagcggcgaugacuguguggucaaaccgcuggaugagcgcuuugggacaucccuucuguuccucaacgacaugggaaaggugcggaaggauaucccucagugggaacccucuaaaggcuggaagaauuggcaggagguccccuuuugcagccaucacuuccacaaaauuuuuaugaaggacgggagaucccuggugguuccuugucgcaaccaagaugaacuuaucggacgggccagaaucagccagggcgcuggguggucucugcgggagaccgccugccucggcaaagcguacgcccagauguggucccugauguauuuccauagacgcgaccugcggcucgcuagcauggccauuuguucugcugugccgacagagugguuucccacguccagaaccacauggagcauccacgcccaucaccaguggaugaccacagaagauaugcugaaggucuggaaucgcguguggauugaggacaacccuaauaugaucgauaagacccccguucacuccugggaagacauuccuuaccuuggaaaaagagaggaccuguggugcggcucucucaucgggcugagcucccgggcgacgugggccaagaacauucauaccgcuaucacacaagugcgcaaucuuaucggaaaagaagaguaugucgauuacaugcccgugaugaagagauauagcgccccuucugaguccgaaggcgugcuguga

SEQ ID NO: 20959 - RNA, 9867 nt, Artificial Sequence
  derived and/or modified CDS sequence (opt5) from DENV-4__KF041260__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucugcgugggugauguaugggaccugcacacagagcggagagagacggcgcgaaaagagauccgucgcucucaccccccacucuggcauggggcuggagacacgggccgaaaccuggaugagcuccgagggagccuggaaacaugcucaacgcguggagucuuggauccuuagaaauccuggcuucgcccugcucgcuggcuuuauggccuacaugaucgggcagacgggaauucagcggacaguuuucuuuauccugaugaugcuuguggcgcccagcuauggcaugcgcugugucggggugggaaacagagauuucguugaaggcguguccgggggagccugggucgaccuggugcucgagcacggcggcugcgugaccacaauggcucaggggaagccuacccuggauuuugaacugauuaagaccacagccaaagaggucgcucuccugcggacguacuguaucgaagccagcauuucuaauaucaccacagcgacccgcugcccgacacaaggagagcccuaucuuaaggaggaacaggaccagcaguacauuuguagacgggauguuguggaccgcggcugggggaacggaugcggccuguucgggaaaggaggcguggucaccugcgccaaguuuuccuguagcggcaaaaucacggggaaucucauccaaauugagaaccuggaauauacagugguugugaccguccauaauggagauacccacgcugugggcaacgacacaucuaaucacgggguuaccgccacagugacgccuagaucccccagcgucgagguggaacuuccugauuacggagagcugacccucgacugcgagccccggucuggcaucgacuucaacgaaaugauucugaugaagaugaauaagaaaacauggcugguccauaagcagugguuucucgaucugccgcuuccuuggaccgcuggggccgacacauccgaggugcacuggaaccauaaagaaagaaugguuaccuucaaggugccccacgccaaacgccaggaugucacggugcugggcagccaggagggagcuaugcacuccgcgcucaccggcgccacagaaguugacucuggggauggaaaucauauguuugcuggccaccugaaguguaaagugcggauggagaagcuuagaaucaaggggaugagcuacaccaugugcuccggaaaauucagcauugacaaggagauggccgaaacacaacauggcaccacggucgugaaagugaaguaugagggggccggcgcuccuuguaaaguucccaucgaaauccgcgaugucaacaaggagaagguggugggacggauuaucucuuccacacccuucgccgagaacaccaauagcgucacaaacauugaacuggagccuccguuuggcgacucuuacaucgugauugggguuggagauagcgcgcucacccugcacugguucagaaaaggcuccucuaucgggaagauguuugaaagcaccuaucgcggagcuaaacggauggccauccugggcgagacagccugggacuucggguccgugggcggacuccugacgagccuuggcaaggcuguccaucagguguuugggucuguuuacaccacaauguucggaggcguguccuggauggucagaauucugaucggguuucucgugcuguggauuggaaccaauagccgcaacacaucuauggccauguccugcaucgcuguuggcgggauuacccuguuccuuggcuuuacggugcacgccgauaugggaugugcggucagcugguccggcaaagaacucaagugcgggucuggaaucuucauuaucgacaaugugcacacauggaccgagcaguauaaguuucaacccgagagcccugcccggcuggcuuccgccauccugaacgcucauaaagacggcgugugugggauuagaucuaccacacgccucgaaaaugucauguggaagcagaucaccaacgagcugaauuacguucuuugggaaggaggccacgaucugacagugguggccggcgacgucaaaggggugcucagcaagggaaaacgggcgcuggcccccccuguuaacgaucugaaguauuccuggaagacguggggcaaagcuaagauuuucacccccgagacaagaaauagcaccuuucuuaucgacgggccggauacaucugaaugcccuaacgagcggcgcgccuggaauuuccucgagguggaagacuacggauucggcauguuuaccacgaacauuuggaugaaauucagagagggguccagcgaagucugugaucaucggcugaugucugcugccaucaaggaccagaaagccgugcacgcugauaugggauacuggaucgaguccagcaagaaucagaccuggcaaauugaaaaagcgucucugaucgagguuaagacaugccucuggcccaagacccacacacuguggagcaacggcgugcuugagucccagaugcugauuccuaaagccuaugcuggccccuuuagccagcauaacuacagacagggguaugccacccaaacaaugggaccuuggcaccucggcaagcuggaaaucgacuucggggagugccccggaaccacggucacaauucaggaagauugugaccaucgcggcccgucucugcggaccaccacagccuccgggaaacuugugacccaguggugcuguagaagcugcacgaugccuccccuccgcuuucugggagaggauggcuguugguacggcauggagaucagaccccuguccgaaaaggaggaaaauaugguuaaaucucaggugagcgcugggcaaggaacauccgagaccuucucuaugggccuccugugccuuacacuguuugucgaagagugucuccggcgcagagugacccggaagcacaugauccugguggucguuacaacccugugcgccauuauccuugggggacucacguggauggaccugcugcgcgcgcucauuaugcugggcaacaccaugagcuccagaauggggggacagacacaucuugcuaucauggccguguucaagaugucuccuggcuaugugcugggcauuuuucuccggaaacugaccagccgcgagacagcccugauggucaucgggauggcuaugaccacggugcuuuccaucccgcacgaccugauggaauucauugauggaaucagccucggccugauucuccugaagaugguuacacacuuugacaauacccagguggggacacuugcccugucucucaccuucaucaaauccaccaugccccuggucauggcguggagaacaauuauggcugugcuguuuguugugacgcuuaucccucugugucggaccagcugccuccagaagcaaucucauugggucgagauuacagcccugauccucggagcccaggcucugcccguguaccuuaugacccugaugaaaggcgccuccaagcgcagcuggccucucaacgaagggaucauggcugucggacuggugucucugcuuggcuccgcccugcucaagaaugauguuccccuggcgggcccuaugguggccgggggacuccugcuugcugccuaugucaugagcggcuccagcgcugaccugucucuggagaaagccgccacagugcagugggaugaaauggcugacauuaccgggagcucccccaucauugagguuaagcaagaugaggacggaucuuucagcaucagagauguggaagagacgaacaugauuacacuccuggucaaacuugcgcugaucaccguguccggccucuacccgcuggccaucccugugaccaugacacucugguacauguggcagguuaagacccagcggucuggggcucugugggacguccccagcccugccgccacacagaaagcuacgcuuaccgaaggaguguauagaauuaugcaacgcggccuguucggcaagacacaggugggggucggaauccacauggagggcguguuucauaccauguggcacguuacacggggguccgugauuugucaugaaucuggaagacuggagcccagcugggccgaugucaagaaugacaugaucuccuacggcgggggauggcgccucggcgauaaaugggacaaggaggaagacgugcagguucuggcgguggagccgggcaaaaacccuaagcacguccagaccaaacccgggcuuuucaagacgcugaccggagaaauuggcgcugugacacucgauuuuaaaccugggaccagcggaucucccaucaucaaucggaagggcaagguuauugggcuguauggcaacggaguggucacaaaauccggcgacuacgugagcgccaucacccaagccgagagaauuggggagcccgauuaugaaguggacgaggauaucuuccgcaagaaacggcucacaauuauggaccugcacccuggagcuggcaagacgaaaagaauccuuccgucuauuguccgcgaagcccugaagcggagacugcggacccucauccuggcgcccacacgcguuguggcugccgagauggaagaggcccuuagagggcugccuauccgguaccagacccccgcugugaagaccgagcauacaggacgcgaaauugucgaucucaugugccacgccacguuuaccacaagacugcucuccagcacccgggugccuaauuauaaccugaucguuauggacgaggcucauuucacagaucccuccucuguggccgcgagaggcuacauuagcacccgcgucgaaaugggggaggccgcugccaucuuuaugacggcuacaccuccgggcaccaccgaccccuucccucaguccaauagccccauugaagauaucgagcgggagaucccugaaagaucuuggaacacaggauuugacuggauuaccgacuaccagggcaaaacagugugguucguucccuccaucaaggccgggaaugauauugccaacugccuucgcaaaagcggaaagaaagugguccaacugucucggaagaccuuugacacggaguauccgaagacaaaacugaccgauugggacuucguggucacaaccgauaucagcgaaaugggcgcuaacuucagagcggggcgcgugauugacccucggagaugucucaagcccguuaucaucacggauggacccgagcgcgugauucuggccggcccuauccccgugaccccugcuuccgccgcccagagacgggggcgcauuggcagaaauccggcucaggaagacgaucaauacgucuuuucuggagacccccuucggaacgaugaggaccacgcccacuggacagaggcgaaaaugcugcucgauaauauccauaccccugaaggcauuauccccacacuguucgggccugagcgcgaaaagacccaggcuauugacggagaguuuagacugcggggcgagcagagaaaaacauucguugaacucaugcgccggggggaccuucccguguggcugagcuauaagguggccuccgccggaaucucuuacaaggauagagaguggugcuuuaccggcgaacgcaacaaucagauccuggaggaaaacauggaggucgagauuuggacgcgggaaggcgagaaaaagaaacucagaccgaaguggcuggacgcucggguguaugccgauccuguugcgcuuaaagacuucaaggaauuugccagcgggcgcaaguccaucacacuggauauucucaccgagaucgcuagccugcccaccuaccugucuuccagagccaaacucgcucuugacaauauugugaugcugcacacaaccgaacggggaggcaaggccuaucaacaugcucugaacgagcucccugagagccuggaaacacuuaugcuggucgcccuccugggggcgaugacggccggaaucuuccuguuuuucaugcagggcaaagggaugggaaagcucuccaugggccuuaucgcuauugccguggcuucuggccugcugugggucgccgagauccagccccaguggauugccgcuagcaucauucucgaauuuuuccugauggcgcuucugaucccugagcccgaaaaacaacgcaccccgcaggauaaucagcucaucuacgugauucugacaauccugaccauuaucgggcucguugccgcuaacgagaugggacuuauugagaagacaaaaaccgacuuuggcuucuaccaggugaagacggaaaccacaauccuggaugucgaccugagaccugccuccgccuggacccucuaugcuguggccacaaccauucugacgcccaugcuucggcacacaaucgagaauaccucugcgaaccugagccucgccgcuaucgccaaucaagcugccguucugauggggcugggaaagggcuggccccuccaucgcauggaucuuggggugccucugcuggcgaugggauguuacucccaggucaacccgacaacccucaccgccagccuggugaugcuucuggugcacuaugcuauuaucggccccggccuccaggccaaagcuacaagagaagcccagaagcggacggcugccgggauuaugaaaaauccuaccguugacggaaucacagucauugaucuggagcccaucucuuacgacccuaaguucgagaaacaacugggccaggugaugcuccuugugcugugcgcggggcagcugcuccugaugcgcaccacaugggccuuuugugaaguccuuacccuggcuacgggacccauccucacacugugggagggcaacccugggagauucuggaacaccaccauugccguuuccacagcuaauaucuuucggggaagcuaucuggccggcgccggccucgcguucucucuuauuaagaacacccaaacaccgagacgcgggacgggaaccacaggcgaaacccugggggagaaguggaaacggcagcugaauucccucgacagaaaggaauuugaggaguacaaacgcagcggaauccuggaaguggaucggacagaggcuaagucugcccuuaaagacggcagcaagauuaaguaugcuguguccagagggaccucuaaaauccgcuggaucgucgaacggggaauggugaagcccaaaggcaagguuguggaucugggcugcgggagaggaggcuggagcuacuacauggccacgcucaaaaacgucaccgaggugaagggguauacaaagggaggcccugggcacgaagagcccauuccuauggccaccuacggauggaaucugguuaaacugcauuccggcguggacgucuucuauaagcccacagagcagguggauacccuccuuugugacaucggcgaaagcuccucuaacccgacaauugaggaagggcgcacccugcgggugcugaaaauggucgagccuuggcucagcuccaagcccgaauuuugcaucaaaguucugaaucccuacaugccuacggugauugaggagcuugaaaagcugcagagaaaacacggaggcucucucgugcgcuguccccugagccggaacuccacacaugagauguauugggucucuggggugagcggaaauaucguuuccagcgugaacaccaccucuaagaugcugcucaauagauucacaacgcgcuacagaaagccuaccuaugaaaaagaugcugaccuuggcgccgggacacgguccgucagcaccgagacagagaagccggauauggcgauuaucggacgcagacugcaacggcugcaggaagagcacaaagaaaccuggcacuacgaccaggagaaccccuacagaacaugggccuaucauggcucuuacgaagcuccuuccaccggcagcgccucuuccauggugaaugggguugugaagcuccugacgaaacccugggaugucaucccuauggugacccagcuugcuaugacagacaccacacccuuuggacaacagcggguuuucaaggagaagguggacacccgcacgccgcagccuaaacccggcacaagaaugauuaugaccacaaccgccaacuggcugugggcgcuccuggggaagaaaaagaauccucggcugugcacgcgcgaggaauuuaucagcaaagucagauccaacgccgcuauuggagccguguuccaggaggaacaaggcuggaccagcgcuucugaggccgucaaugauagccgguuuugggaacucguggacaaggagcgcgcucugcaccaggaggggaagugugaauccugcguuuauaacaugaugggcaaaagagagaagaaacuuggagaauucggccgggccaaggggucucgcgcgaucugguacauguggcugggagccagauuccucgaguuugaagcucugggcuuccuuaacgaggaucauugguuugggcgggagaauagcugguccggaguggaaggcgaggggcugcaccgccucggcuauauucuggaagacaucgauaaaaaggacggagaucugaucuacgccgacgauacagcuggcugggacaccagaauuacagaggaugaccuccugaacgaggaacuuaucaccgagcagauggccccccaucacaagauucuggccaaagcgaucuucaagcucacauaucaaaauaaagucgugaaggugcugcggccuacccccaaaggggcuguuauggauauuaucucucgcaaggaccagagaggaagcggccagguggggacguacggacuuaacacauuuaccaauauggaaguccagcugauccggcaaauggaggccgaaggcgugauuaccagagacgauaugcacaacccgaaagggcucaaggagcgcguugagaaguggcugaaagaaugcggcguggaccggcugaagagaauggccaucuccggagaugacugugucgugaaaccucucgaugagcgcuucucuacaagccugcuuuuucugaaugacaugggcaagguccggaaagauauuccccagugggaacccuccaagggguggaagaacuggcaggaggugccuuucugcagccaucacuuucauaaaaucuucaugaaggacggaagaucucucguugugccgugucgcaaucaggaugaacugauuggccgggcuagaaucucccaaggggccggauggagccuucgcgagaccgcuugccugggcaaagccuacgcgcagauguggucucucauguauuuucaccggagagaccugcgccuggccuccauggcuaucuguagcgccguccccacagagugguucccuacgucccggaccacauggucuauucacgcucaucaccaguggaugaccacagaagauaugcucaagguguggaacagaguuuggaucgaggacaaucccaacaugaccgacaaaacgccugugcauagcugggaagauauucccuaccuggggaagcgggaggaccuuuggugcggcucccugaucggacucagcucuagagccaccugggcgaagaauauucacacagccaucacccagguccgcaaccugauuggcaaagaagaguauguggauuacaugccugugaugaagcgguauuccgcucccuuugagagcgaagggguucuuuga

SEQ ID NO: 20960 - RNA, 9867 nt, Artificial Sequence
  derived and/or modified CDS sequence (opt5) from DENV-4__FJ024476__SS-prME
agcacaaucacgcugcucugccugauucccacggugauggccuuccaccuuuccacccgggacggagagccucugaugaucgucgcuaagcaugaacgggggcgcccgcuccuguuuaagacaaccgagggaauuaacaaguguacacuuaucgccauggaucugggcgaaaugugcgaggacaccguuacauacaaauguccccuccuggugaauaccgaaccugaggauauugacugcugguguaaccugacggcgaccugggugauguaugggacaugcacccagucuggagagagacggcgcgaaaagagaagcgucgcucucacaccccacuccggcauggggcuggagacccgggccgaaacguggaugucuagcgagggagccuggaaacaugcucaacgcguggaguccuggauccuuagaaauccuggcuucgcccugcucgcuggcuuuauggccuacaugaucgggcagacaggcauucagcggaccguuuucuuugugcugaugaugcuugucgcgcccucuuauggcaugcgcuguguggggguuggaaacagagauuucguggaaggcgucagcgggggagccuggguggaccuggugcucgagcacggcggcugcgucacaaccauggcucaggggaagccuacccuggauuuugaacugacaaagacgaccgccaaagagguugcucuccugcggacauacuguaucgaagccuccauuagcaauaucaccacagcgacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgccaaguuuucuuguuccggcaaaaucaccgggaaucucguucaaauugagaaccuggaauauaccguggucgugacaguucauaauggagauacccacgcugugggcaacgacacaagcaaucacggggucacggccaugaucaccccuagaucucccuccguggaggucaaacuuccugauuacggagaacugacacucgacugcgagccccggagcggcaucgacuucaacgagaugauucugaugaagaugaaaaagaaaaccuggcuggugcauaagcagugguuucucgaucugccgcuuccuuggacagcuggggccgacaccucugaaguucacuggaauuacaaagagagaauggugacguucaaggucccccaugccaaacgccaggaugugaccguucugggcucccaggaaggagcuaugcacagcgcgcucgccggcgcuacagagguggacuccggggauggaaaccacauguuugccggccaucugaaguguaagguccggauggaaaaacuuagaaucaaggggaugucuuauaccaugugcagcggaaaauucuccauugacaaggagauggccgagacacaacacggcaccacgguggugaaaguuaaguacgaaggggcuggcgccccuuguaagguccccaucgagauucgcgaugugaauaaagaaaagguggucggacggaucaucagcucuacaccccuggcggagaacaccaacuccgugacaaauauugagcucgaaccuccguucggcgacagcuauaucguuauuggggugggaaacucugcucugacccugcauugguuuagaaaaggcagcuccaucgggaagauguucgagucuaccuaccgcggagccaaacggauggccauucucggcgaaacagcuugggauuuugggagcgucggcggacuguucacgucccuuggcaaggccgugcaccagguuuuugggagcguguauaccacaauguucggaggcgucucuuggaugaucagaauccugauugggcuccuggugcuguggaucggaaccaauucccgcaacacaagcauggcuaugaccugcauugccguuggcgggaucacgcuuuuucucggcuucacagugcaggcggacaugggaugugucgugucuugguccggcaaggagcugaaaugcgggagcggaauuuuuguggucgauaauguucauaccuggaccgaacaauacaaguuccagcccgaguccccugcccggcuggcuucugccauccucaacgcucacaaagacggcgugugugggauuagaagcacaacccgccuggagaaugugauguggaagcagaucacaaacgaacuuaauuauguccugugggagggaggccacgaccucacggugguugccggcgaugugaaagggguccugaccaagggaaagcgggcgcugacacccccuguguccgaccuuaaauacucuuggaagaccuggggcaaagccagaaucuuuacacccgaagcucggaacagcaccuuccucauugaugggccggacacguccgagugcccuaaugaacgcagagccuggaacagccuggagguugaggauuacggauuuggcauguucaccacaaauaucuggaugaaguuccgggaagggucuuccgaggugugugaccauagacugaugagcgcugccauuaaagaucagaaggccguccacgcugacaugggauauuggaucgaaucuuccaaaaaccaaaccuggcagauugagcgcgcgagccucaucgaagugaagacaugccuguggcccaagacccauacacuuuggucuaauggcguucuggagagccagaugcucaucccuaaauccuacgccggccccuuuagccagcacaacuaucggcaaggguacgcuacccagacgaugggaccuuggcaccugggcaagcuggagauuggguucggagaaugccccggcacaaccgugaccauccaggaggauugugaccauagagggccgucucuucgcacaaccacggccuccggaaaacucgucacacaguggugcuguagaagcugcaccaugccuccccugcgguuucugggcgaagauggcuguugguaugggauggagauucgcccccucuccgagagagaagagaacauggugaagucucaagugacagccggacagggcaccagcgaaacauucuccauggggcugcuuugccugacccucuuugucgaggaaugucugcggcgcagaguuacgcggaaacacaugauccuggugguggucauuacccuuugcgcuaucauccucggaggccugacauggauggaccugcuccgcgcccugauuaugcuuggggauaccaugucuggaagaaucggcggccagauucaucuggcgaucauggcuguguucaagaugagcccuggguacguucucggaguguuucugcggaagcugacaucccgcgagaccgcccuuauggucauuggcauggccaugacgacagugcugucuaucccgcacgaccucauggagcugaucgacgggauuagccucggacugauccuucugaaaauuguuacccaguucgauaauacacaagugggcacccucgcucugucccugaccuuuaucagaagcacaaugccccuugucauggccuggcggacgauuauggcggugcuguucgucgugacccucaucccucuguguagaacaucuugccuccagaagcagucccauuggguugaaauuaccgcucugauccuuggggcccaagcccugcccguguaucucaugacacugaugaaaggagcuagccgccggucuuggccucugaacgagggcaucauggccgucggccuugugucccugcucgggagcgcucugcucaagaaugacguuccccuggccggaccuaugguggcgggcgggcuucugcuggccgcuuacgucaugucuggauccagcgccgaucucucccuggaaaaagcugccaacgugcagugggacgagauggccgauauuaccggcagcucucccaucauugaagugaagcaggacgaggaugggagcuuuuccaucagagacguugaggaaacgaauaugauuacacuucuggucaagcucgcucugaucaccgugucuggacucuacccgcuggcgaucccugugaccaugacacuuugguauauguggcaggucaaaacccaacgcagcggcgcccugugggaugugcccuccccugcugccacacagaaggccgcucugucugagggcguuuaccggauuaugcagagaggacuguucggaaaaacacaggugggcgucgggauccacauggaaggaguguuucacaccauguggcauguuacacgcggcagcgugauuugucacgagaccgggcggcuggaacccuccugggccgacgucagaaacgauaugaucucuuauggaggcggcuggcgccuuggggacaagugggauaaagaggaggacgugcaaguucuggcgauugaaccgggaaagaauccuaagcaugugcagacaaaacccggccucuucaagacccugacgggggagaucggagcugucacccucgacuucaaaccuggcacaagcgggucccccaucauuaaccggaagggcaaagugaucggacuguacggcaaugggguggucaccaagagcggagauuauguuucugccauuacacaggccgaaagaaucggcgagcccgacuacgagguggaugaagacauuuuucggaaaaagcgccuuaccaucauggaucugcacccuggggcuggaaagacaaaacggauucugccguccaucgugagagaggcccucaagcgcagacugcggacgcuuauccuggcgcccaccagagucguggcugccgaaauggaggaagcccuccgcggccugccuauucgguaucagacacccgcuguuaaaagcgagcauaccgggagagagaucguggaccucaugugccacgccaccuucacaacgcgccugcuuucuuccacccgggucccuaacuacaaucugauugugauggaugaagcucacuuuacagaccccagcuccguugccgcgagaggcuacaucucuacccgcguggagaugggagaagccgcugccauuuucaugacagcuaccccuccgggcgccacggaucccuuuccucaaagcaacucccccaucgaggacaucgaacgggagauuccugagagaagcuggaauacaggguucgauuggaucaccgacuaucagggaaagaccgucugguuugugcccucuauuaaagccggcaacgacaucgcuaauugccugcgcaaguccgggaagaaagucgugcagcucagcagaaagacauucgauaccgaauacccgaaaacaaagcugaccgacugggauuuuguugugacgacagacauuucugagaugggagcgaacuuccgggccggccgcgugaucgauccuagacggugucuuaaacccgucauccugaccgacgggcccgaacgcguuauucucgcuggcccuauccccgugaccccugccagcgccgcucaaagacggggaagaauuggccgcaacccggcccaggaggaugaccaguauguguuuuccggggauccccugaagaaugacgaagaucaugcgcacuggaccgaggcuaagaugcugcucgacaacaucuacacgccugagggaauuauccccacccuuuucggcccugaacgggagaaaacacaggccauugauggggaguucagacugcgcggagagcaacggaagaccuuugucgagcugaugagacggggcgaccuccccguguggcugucuuauaaaguugccagcgcuggcaucuccuacaaggaccgcgaauggugcuucacaggggagagaaauaaccagauccuugaagagaauauggaaguggagauuuggacccgggagggagagaagaagaagcugcgcccgagauggcucgaugcccgggucuaugcggacccuauggcccugaaagauuuuaaggaguucgcuucuggccgcaaaagcaucacacuggacauucucaccgaaaucgccucccuucccacguaccugagcucuagagcuaagcuggcccucgauaacauugugaugcugcauacaaccgagagaggcgggcgcgcuuaccagcacgcccuuaaugaacugccugagucccucgagacccugaugcuggucgcgcuccuuggggccaugacagcugggaucuuucuguucuuuaugcagggaaaaggcaucggcaagcugagcauggggcucauuaccaucgccguggcuuccggacugcuuuggguugccgaaauucaaccccaguggaucgccgcuucuauuauccuggaguucuuucucauggugcugcugaucccugaacccgagaagcagagaacaccgcaggacaaccaacucauuuaugucauccuuacgauucugaccaucauuggccugaucgcggccaaugaaauggggcucauugagaaaacaaagaccgauuucggauuuuaccaggugaaaacagagaccacgauccuggacguugaucuucggccugcuagcgccuggacccuguaugccguggcuacaaccauccucacacccaugcugagacacaccauugaaaacacguccgccaaucugucucucgcggccaucgcuaaccaggccgcuguccuuaugggccuggggaagggauggccccugcaucgcauggaccucggcgugccucugcuugccaugggcuguuacagccaggugaauccgacaacccugacagcgucccucguuaugcugcugguccacuaugccauuaucgggcccggacuccaagcuaaagccacccgggaggcucagaagagaaccgccgcuggcauuaugaaaaacccuacaguggaugggaucacggugaucgaccuugaacccauuagcuacgauccuaaguucgagaagcagcugggacaagucaugcugcucguucugugcgccggccagcuucugcucaugcgcaccacaugggcguuuugugaggugcugacccuggccacagggcccauccucacccuuugggaaggaaauccuggccgguucuggaacacgacaauugcugugucuaccgccaacaucuucagaggcuccuaucuggcuggggccggacuggccuuuagccucauuaaaaaugcgcagaccccgcgccggggcacagggaccacaggagagacgcugggcgaaaaguggaaaagacagcuuaacucucuggaccgcaaggaguucgaagaguacaaacgguccgggauccucgaggucgacagaaccgaagcuaagagcgcccugaaggauggaucuaaaaucaagcaugcugugagccgcggcuccucuaaaauucgguggaucguugagagaggcauggugaagcccaaagggaaggucguggaccugggaugcggccgcgggggauggagcuacuauauggccacacucaagaauguuaccgaagugaaaggcuacacaaaagggggaccuggccacgaggaacccauuccuauggccaccuauggcuggaaccuugucaaacugcauuccgggguggauguguuuuacaagcccacggagcaagucgacacccugcucugugauaucggagagagcuccucuaauccgacaauugaagagggcagaacccugcggguucuuaaaaugguggaaccuuggcugagcuccaagcccgaguucugcaucaaggugcucaaccccuauaugccuacagucauugaggaacuggagaaacugcagcgcaagcacgggggaaaucucgugagauguccccuuucucggaacagcacccacgaaauguacuggguuuccggcgcuucugggaauaucgugagcuccgucaacacaaccagcaaaaugcugcugaauagauuuacgacacggcaucgcaagccuaccuaugagaaagacguggaucucggagccggcaccagaucuguuuccacagaaacggagaagccggacaugaccaucauuggccggcgccugcagagacuucaggaggaacacaaagagacauggcauuacgaucaagaaaaccccuaccggaccugggcguaucacgggagcuacgaggccccuucuacaggauccgcuagcucuauggugaauggcgucgugaagcugcucaccaagcccugggacguuaucccuauggugacacagcuggccaugaccgauacgacccccuucgggcagcagcgcgucuuuaaagaaaagguggacacaagaaccccgcaaccuaaacccggaacacggauggucaugaccacgacagcuaacuggcugugggcccuccugggcaagaaaaagaauccucgccuuugcaccagagaggaguucauuuccaaggugcggagcaacgcggccaucggggcuguuuuucaggaagaacagggcuggacauccgccagcgaagcugugaaugacucucgcuucugggagcuggucgauaaagaaagagcccuccaccaagagggaaagugugagagcugcguguauaacaugaugggcaaacgggaaaagaaacugggggaguuuggacgcgcuaagggcuccagagccauuugguacauguggcuuggggcgcgguuccuggaauuugaggcccucggauuccugaacgaagaccauugguucggcagagaaaauucuuggagcgggguggagggcgaaggacugcaccgccucggcuauauccuggaggaaaucgauaagaaagacggggaucuuauguacgcugacgauaccgccggaugggacacgcggauuaccgaggaugaccugcagaacgaggaacucaucacagagcagauggcuccccaucacaagauucuggccaaagccaucuuuaaacuuaccuaucagaauaaaguugugaagguccugagaccuacaccccgcggcgcggugauggauauuaucucccggaaggaccaaagagggucuggacagguuggcaccuacgggcucaacacauucaccaauauggaagugcagcugauccgccagauggaggcugaaggcgucauuacgcaagaugacaugcagaacccgaaaggacugcgggagagaguggagaaguggcucaaagaaugcggcgucgaccgccugaagcggauggccaucagcggggaugacugugugguuaaaccucuugaugagagauuuggaacaucccuccucuuccugaaugacaugggcaaggugcgcaaagauauuccccagugggaacccucuaagggguggaagaacuggcaggaggucccuuuuugcagccaucacuuccacaaaaucuuuaugaaggacggacggucccuugugguuccguguagaaaucaagaugaacugauuggccgggccagaaucagccagggggcuggcuggucucuccgcgagaccgccugccugggaaaggcuuacgcccagauguggucccugauguauuuccaucggagagaccuccgccuggcgagcauggccaucuguucugcugugcccaccgagugguuuccuacauccagaaccacauggagcauucacgcccaucaccaguggaugacgaccgaagauaugcuuaaggucuggaaccggguguggaucgaggacaaucccaacaugacagauaaaaccccugugcacuccugggaagacauucccuaccugggcaagcgcgaggaccucuggugcgggucucugaucggacuuagcuccagagcuacaugggccaagaauauucauaccgcgaucacgcaaguucggaaccugauuggcaaagaagaguaugucgauuacaugccugugaugaagcgcuauagcgcccccucugaguccgaaggggugcucuga

SEQ ID NO: 20961 - RNA, 9867 nt, Artificial Sequence
  derived and/or modified CDS sequence (opt5) from DENV-4__GQ868579__SS-prME
uccaccaucacccugcucugccugauucccacgaucauggcguuccaccuuuccaccagagacggagagccucugaugauuguggcuaagcaugaacgggggcgcccgcuccuguuuaaaaccaccgagggaaucaacaaguguacccuuauugccauggaucugggagaaaugugcgaggacaccgucaccuacaaauguccccuccugaucaauaccgaaccugaggauaucgacugcugguguaaccugacgucuaccuggguuauguaugggacgugcacccagagcggagagagacggcgcgaaaagagauccguggcgcucacaccccacucuggaauggggcuggagacccgggcugaaacguggaugagcuccgagggagccuggaaacaugcccaacgcguggagucuuggauucuuagaaauccuggcuucgcucugcucgccggcuuuauggcuuacaugaucgggcagacagggauucaacggaccgucuucuuuauccugaugaugcuuguggcccccagcuauggcaugcgcuguguuggggugggaaacagagauuucgucgaaggcguguccgggggagcguggguugaccuggugcucgagcacggcggcugcgucacaaccauggcccaggggaagccuacccuggauuuugaacugacaaagacgaccgcuaaagagguggcccuccugcggacauacuguauugaagcucuuaucagcaauauuaccacagccacccgcugcccgacgcaaggagagcccuaucugaaggaggaacaggaccagcaguacaucuguagacgggauguggucgaccgcggcugggggaacggaugcggccucuucgggaaaggaggcguugugacaugcgcgaaguuuucuuguuccggcaaaaucaccgggaaucuggugcaaauugagaaccuugaauauaccgucgugguuacagugcauaauggagauacccacgccgucggcaacgacacaagcaaucacggggugacggcuaccaucacaccuagaucucccuccguugaggugaagcugccugauuacggagaacucacccuggacugcgagccccggagcggcauugacuucaacgagaugauccugaugaagaugaaaaagaaaacauggcucguccauaagcagugguuucuggaucuuccgcugccuuggaccgccggggcugacacgucugaagugcacuggaauuacaaagagagaauggucaccuucaaggugccccaugccaaacgccaggauguuacagugcucggcucccaggaaggagccaugcacagcgcucuggcgggcgccaccgaggucgacuccggggauggaaaccacauguuugcuggccaucuuaaguguaaggugcggauggaaaaacugagaauuaaggggaugucuuauacaaugugcagcggaaaauucuccaucgacaaggagauggccgagacccaacacggcacgacaguugugaaagucaaguacgaaggggccggcgcuccuuguaaggugcccaucgagauucgcgaugugaauaaagaaaagguugucggacgggugaucagcucuacaccccucgccgagaacacaaacuccgugaccaauauugagcuggaaccuccguucggcgacagcuauaucgucauuggggugggaaacucugcgcugacccuccauugguuuagaaaaggcagcuccaucgggaagauguucgagucuacauaccgcggagcuaaacggauggccauccugggcgaaacggccugggauuuugggagcguuggcggacuuuucaccucccugggcaaggcugugcaccaggucuuugggagcguguauacaaccauguucggaggcguuucuuggaugauuagaauccucauuggguuucuggugcuguggaucggaacaaauucccgcaacaccagcauggccaugacgugcauugcugucggcgggaucacacuuuuccucggcuuuaccgugcgggccgacaugggauguguugugucuugguccggcagagagcugaagugcgggagcggaauuuucgucguggauaaugugcauaccuggacagaacaguacaaauuucaacccgaguccccugcgcgccuggccucugcuauccucaacgcccacaaggacggcgucugugggauccggagcaccacaagacuggagaauguuauguggaaacagauuacgaacgaacuuaauuaugugcugugggagggaggccacgaccucaccguggucgcuggcgaugugaaggggguucugacaaaaggaaagcgggcccugacacccccuguguccgaccuuaaguacucuuggaaaacauggggcaaggcgaaaaucuucacccccgaagcccgcaacagcacguuucucauugaugggccggacaccuccgagugcccuaaugaaagacgggcuuggaacagccuggaggucgaggauuacggauucggcauguucacaaccaauaucuggaugaaguuuagagaagggucuuccgaggugugugaccaucgccugaugagcgccgcuauuaaagaucagaaggccguucacgccgacaugggauauuggaucgaaucuuccaaaaaccagacauggcaaaucgagcgggcuagccucauugaagugaagaccugccuguggcccaagacacauacccuuuggucuaauggcguccuggagagccagaugcucaucccuaaauccuacgcgggccccuucagccagcacaacuauagacagggguacgccacgcaaacagugggaccuuggcaccugggcaagcuggagauugauuuuggggaaugccccggaaccaccguuacaauccaggaggacugugaucaucgcggcccgucucuuagaaccacgacagcuuccgggaaacucgugacccaguggugcugucggagcugcacaaugccuccccugcgcuuccugggagaagacggcuguugguauggcauggagauuagaccccucuccgagaaggaagagaacauggucaaaucucaggugaccgccgggcaaagcacauccgaaaccuuuucuaugggacugcuuugccugacacucuucguggaggaaugucugcggcgcagagucacccggaagcacaugauccuggccguugugaucacacuuugcgcuauuauccucggcgggcugaccuggauggaucugcuccgcgcccugauuaugcuuggagacacaaugagcggcagaaucgggggacagacccaucuggcgauuauggcuguguuuaagauguccccuggcuacguccucggcguguuccugcggaaacugacgucucgcgagacagcccuuaugguuaucgggauggccaugaccacaacccugagcaucccgcacgaccucauggagcugauugauggaaucucccucggccugauucuucugaagaucgugacccaguuugacaauacacaggucgggacgcucgcucugagccugaccuucauuagaucuacaaugucccuugugauggccuggcggaccaucauggcgguucuguuuguggucacacucauuccccuguguagaaccagcugccuccaaaaacagucucauuggguggaaaucacggcucugauccuuggagcccaggcccugccugucuaucucaugacacugaugaagggcgcuucccgccggagcuggccccugaacgaggggauuauggccgugggacuuguuucucugcucggcuccgcucugcucaaaaaugaugugccucuggccggccccauggucgccgggggacuucugcuggccgcuuacgugaugagcggcuccagcgccgaccucucucuggaaaaggcugccaacguucaaugggaugagauggccgacaucaccgggagcuccccuauuaucgaagugaagcaggaugaggacggaucuuucagcauuagagaugucgaggaaaccaauaugaucacacuucuggugaaacucgcucugaucaccguguccggccucuacccccuggcgauuccgguuacaaugacgcuuugguauauguggcaggucaagacccagcgcucuggggcccugugggacgugccuagccccgcugccacacaaaaagccgcucuguccgagggaguguaccggaucaugcagagaggccucuuuggcaagacccaggucggggugggcauucacauggaaggcguuuuccacacaauguggcaugugacccgcgggucugucaucugucacgagacgggacggcuggaaccuagcugggccgaugugagaaacgacaugauuuccuauggcgggggauggcgccuuggcgauaaaugggaccgggaggaggacguucaggugcuggcgaucgaacccggcaagaauccgaagcauguccaaaccaaaccuggacucuucaagacacugaccggagagaucggcgcugugacacucgauuuuaaacccgggaccagcggaucuccuauuaucaacaagaaaggcaagguuauugggcuguacggcaauggaguggucacaaaauccggcgacuaugugagcgccaucacgcaggccgaaagaauuggggagcccgauuacgagguggacgaagauaucuuccggaagaagcgccuuaccauuauggaccugcaccccggagcuggcaaaacaaagagaauccugccuucuaucguccgggaggcccucaaacgcagacugcggacccuuauucuggcgccgaccagaguuguggcugccgaaauggaggaagcccuccgcgggcugcccauccgguaucagaccccugcugugaaguccgagcauacgggaagagagauugucgaucucaugugccacgccaccuuuacaacccgccugcuuagcuccacacgggugcccaacuacaaucugaucguuauggacgaagcucacuucaccgauccuucuagcguggccgcgagaggcuacauuuccacgcgcgucgagaugggggaagccgcugccaucuuuaugacagcuacacccccuggcgccaccgacccguucccccagagcaacucuccuaucgaggauauugaacgggagauccccgagagauccuggaauacaggauuugacuggauuaccgacuaucaaggcaaaacagugugguucguuccuagcaucaaggccgggaacgauauugcuaauugccugcgcaagucuggcaaaaaggugauccagcucagcagaaaaaccuuugacacggaauaccccaagacaaaacugaccgauugggacuucgucgugacaaccgauaucuccgagaugggcgcgaacuuucgggccgggcgcgucauugacccgagacggugucuuaagccugugauccugacggauggacccgaacgcguuauucucgcuggccccaucccugugacccccgccucugccgcucagagacgggggagaauuggccgcaacccugcccaagaggacgaucaguauguguucagcggagacccgcugaagaaugaugaagaccaugcgcacuggacagaggcuaaaaugcugcucgauaacaucuacacccccgagggcauuaucccuacacuuuucgggcccgaacgggagaagacccaggccaucgacggagaauuuagacugcgcggcgagcagcggaaaacauucgucgagcugaugagaagaggggaccucccuguuuggcuguccuauaagguggccucugcuggaauuagcuacaaagaucgcgaauggugcuuuaccggcgagagaaauaaccaaauccuugaagagaauauggaaguggagauuuggacgcgggagggcgaaaagaagaaacugcgccccagauggcucgacgcccgggucuaugcggauccgauggcccugaaggacuucaaagaguuugcuuccgggcgcaagagcaucacacuggauauucucaccgaaaucgccucucuuccuaccuaccuguccagcagagcuaaacuggcccucgacaacaucgugaugcugcauacaaccgagcggggaggccgcgcuuaccagcacgcccuuaaugaacugcccgagucccucgagacacugaugcugguugcgcuccuuggggccaugacggcuggaaccuuccuguuuuucaugcagggcaaggggauuggaaagcugucuaugggccucaucacaauugccauggcuagcggccugcuuuggaucgccgaaauucagccucaauggaucgccgcuuccaucauucuggaguuuuuccucauggugcugcugauccccgaaccugagaaacagagaacaccccaggauaaccagcucauuuaugucauccuuacaauucuggcgaucauugggcugaucgccgcuaaugaaaugggacucaucgagaagaccaaaacggacuuuggcuucuaccaagugaagaccgagacaaccauucuggaugucgaccuucggccggccucugccuggacacuguaugcuguggccaccacgauccucacaccuaugcugagacacaccauugaaaacacaagcgcgaaucugucccucgccgcuaucgccaaccaggcugccguucuuauggggcugggaaaaggcuggccccugcaucgcauggaucucggggugccccugcuugcgaugggauguuacagccaggucaauccuaccacccugacagccucucucgugaugcugcugguucacuaugcuauuaucggcccgggccuccaggccaaggcuacgcgggaggcccagaaacggaccgcugccgggaucaugaagaaccccacaguggacggaauuaccgucaucgaucuugaaccuauuuccuacgaccccaaguuugagaaacagcugggccaggugaugcugcucgugcugugcgcggggcaacuucugcucaugcgcacaaccugggccuucugugagguucugacgcuggcuacaggaccuauccucacccuuugggaaggcaaucccgggcgguucuggaacaccacaauugccgucagcaccgcuaacaucuuuagaggaucuuaucuggccggcgccggccuggcguucucccucaucaagaaugcucaggccccucgccgggggacaggaacgaccggcgagacacugggggaaaaauggaagagacagcuuaacagccuggaccgcaaagaguuugaagaguacaagcggucuggcauucucgagguggauagaaccgaagcuaagagcgcccugaaagacggcuccaagaucaaacaugccgugucucgcgggagcuccaagauucgguggaucgucgagagaggaaugguuaaaccgaagggcaaggugguggaucugggcugcgggcgcggaggcuggagcuacuauauggcuacacucaaaaaugucaccgaagugaagggguacacgaaaggaggccccgggcacgaggaaccuauucccauggccaccuauggauggaaccuuguuaagcugcauuccggcguggacgucuucuacaaaccuacagaacagguggauacccugcucugugacaucggcgagucuagcuccaaucccacaauugaagaggggagaacccugcggguucuuaagaugguggaaccguggcugucuagcaagccugaguuuugcaucaaaguccucaaccccuauaugcccacagugaucgaagaacuggagaagcugcaacgcaaacacggaggcaaucucgugagauguccucuuucccggaacucuacccacgaaauguacugggucagcggggcguccggaaauauuguuagcucugugaacacgacauccaagaugcugcugaauagauucaccacccggcaucgcaaacccacauaugagaaggauguggaccucggcgccgggacgagaagcgucucuaccgaaacagagaaaccugauaugaccaucauuggacggcgccugcagagacuucaggaggaacacaaggagacauggcauuacgaccaggaaaacccguaccggaccugggcuuaucacggcuccuacgaggcccccagcacaggcucugcuuccagcauggugaaugggguugugaagcugcucaccaaaccuugggaugucauccccauggugacgcaacuggccaugaccgacacaaccccuuuuggacagcagcgcguuuucaaggaaaaaguggacacaagaacaccccagccgaagccuggcacgcggauggucaugacaaccacagcgaacuggcugugggcccuccuggggaaaaagaaaagcccccgccuuugcaccagagaggaguuuauuagcaaggugcggucuaaugcugccaucggagcuguuuuccaagaggaacagggcuggacgagcgccuccgaagcugugaacgauucucgcuuuugggagcuggucgacaaggaaagagcccuccaccaggaggggaaaugugagagcugcguguauaauaugaugggcaagcgggagaaaaagcugggagaguucggccgcgcgaagggguccagagccaucugguacauguggcuuggagcucgguuucuggaguucgaggcccucggcuuccugaacgaagaucauugguuugggagagagaacucuuggagcggagucgagggcgaagggcugcaccgccucggcuauauucuggaggaaaucgacaaaaaggauggagaccuuauguacgcugaugacaccgccggcugggauacacggauuaccgaggacgaucugcaaaaugaggaacucaucacagagcagauggccccucaucacaaaauucuggcgaaggcuaucuucaaacuuaccuaucagaacaaggugguuaaggugcugagacccacaccucgcggggccgucauggacaucauuucccggaaagaucagagaggaucuggccaaguggggaccuacggacucaauacguuuacaaacauggaagugcagcugauccgccagauggaggccgaaggcguuauuacccaggacgacaugcaaaaucccaaggggcugaaagagcggguggagaacuggcucagagaaugcggcgucgaucgccugaagcggauggcuaucagcggagacgauugugugguuaaaccgcuugacgagagauucggcaccucccugcucuuucugaaugauauggggaaggugcgcaaagacauuccucagugggaacccagcaagggauggaagaacuggcaggagguccccuucugcucucaucacuuucacaaaaucuucaugaaggauggccggucccuuguggucccuuguagaaaucaggacgaacugaucgggcgggccagaauuagccaaggagcuggcuggucucuccgcgagacagccugccuggggaaagcguacgcccagauguggucccugauguauuuucaucggagagaucuccgccuggcuagcauggccaucuguuccgcugugccgaccgagugguuccccacaucuagaacgaccuggagcauucacgcccaucaccaguggaugacaaccgaagacaugcuuaagguuuggaaccggguguggaucgaggauaauccuaacaugauugacaaaacacccguccacuccugggaagacaucccuuaccugggcaagcgcgaggaucucuggugcggaagccugauuggccuuucuuccagagcgaccugggccaagaauauccauacggcuaucacccaggugcggaaccugauugggaaagaagaguauguugacuacaugcccgugaugaagcgcuauagcgccccuucugagagcgaaggaguccucuga

SEQ ID NO: 20962 - RNA, 9867 nt, Artificial Sequence
  derived and/or modified CDS sequence (opt5) from DENV-4__GQ868580__SS-prME
agcaccaucacgcugcucugccugauucccacgaucauggcguuccaccuuuccacccgggacggagagccucugaugauuguggcuaagcaugaacgggggcgcccgcuccuguuuaaaaccaccgagggaaucaacaaguguacccuuauugccauggaucugggagaaaugugcgaggacaccgucacauacaaauguccccuccugaucaauaccgaaccugaggauaucgacugcugguguaaccugacgucuaccuggguuauguaugggacaugcacccagagcggagagcggcggcgcgaaaagagauccguggcgcucacaccccacucuggcauggggcuggagacccgggcugaaacguggaugagcuccgagggagccuggaaacaugcccaacgcguggagucuuggauucuuagaaauccuggcuucgcucugcucgccggcuuuauggcuuacaugaucgggcagacaggcauucagcggaccgucuucuuugugcugaugaugcuuguugcccccagcuauggcaugcgcugugugggggucggaaacagagauuucguggaaggcguuuccgggggagcguggguggaccugguccucgagcacggcggcugcgugacaaccauggcccaggggaagccuacccuggauuuugaacugacaaagacgaccgcuaaagagguggcccuccugcggacauacuguaucgaagcucuuauuagcaauaucaccacagccacccgcugcccgacgcaaggagagcccuaucugaaggaggaacaggaccagcaguacauuuguagacgggaugucguugaccgcggcugggggaacggaugcggccucuucgggaaaggaggcguggugacaugcgcgaaguuuucuuguuccggcaaaaucaccgggaaucugguccaaaucgagaaccuugaauauaccgugguugugacaguccauaauggagauacccacgccgugggcaacgacacaagcaaucacgggguuacggcuaccauuacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccgccggggcugacacgucugaaguccacuggaauuacaaagagagaauggugaccuucaagguuccccaugccaaacgccaggaugugacaguccucggcucccaggaaggagccaugcacagcgcucuggcgggcgccaccgagguggacuccggggauggaaaccacauguuugcuggccaucuuaaguguaagguucggauggaaaaacugagaaucaaggggaugucuuauacaaugugcagcggaaaauucuccauugacaaggagauggccgagacccaacacggcacgacaguggucaaagugaaguacgaaggggccggcgcuccuuguaaggugcccaucgagauccgcgauguuaauaaagaaaaggucgugggacggauuaucagcucuacaccccucgccgagaacacaaacuccgugaccaauauugagcuggaaccuccguucggcgacagcuauaucgucauuggggugggaaacucugcgcugacccuccauugguuuagaaaaggcagcuccaucgggaagauguucgagucuacauaccgcggagcuaaacggauggccauccugggcgaaacggccugggauuuugggagcguuggcggacuuuucaccucccugggcaaggcugugcaccaggucuuugggagcguguauacaaccauguucggaggcguuucuuggaugauuagaauccucauuggguuucuggugcuguggaucggaacaaauucccgcaacaccagcauggccaugacgugcauugcugucggcgggaucacacuuuuccucggcuuuaccgugcaggccgacaugggauguguugugucuugguccggccgggagcugaagugcgggagcggaauuuucgucguggauaaugugcauaccuggacagaacaauacaaauuucagcccgaguccccugcgagacuggccucugcuauccucaacgcccacaaggacggcgucugugggauccgcagcaccacacggcuggagaauguuauguggaaacagauuacgaacgaacuuaauuaugugcugugggagggaggccacgaccucaccguggucgcuggcgaugugaaggggguucugacaaaaggaaagagagcccugacacccccuguguccgaccuuaaguacucuuggaaaacauggggcaaggcgaaaaucuucacccccgaagcccggaacagcacguuucucauugaugggccggacaccuccgagugcccuaaugaacgcagagcuuggaacagccuggaggucgaggauuacggauucggcauguucacaaccaauaucuggaugaaguuucgggaagggucuuccgaggugugugaccauagacugaugagcgccgcuauuaaagaucagaaggccguucacgccgacaugggauauuggaucgaaucuuccaaaaaccaaacauggcagaucgagcgcgcuagccucauugaagugaagaccugccuguggcccaagacacauacccuuuggucuaauggcguccuggagagccagaugcucaucccuaaauccuacgcgggccccuucagccagcacaacuaucggcaaggguacgccacgcagacagugggaccuuggcaccugggcaagcuggagauugauuuuggggaaugccccggaaccaccguuacaauccaggaggacugugaucauagaggcccgucucuucgcaccacgacagcuuccgggaaacucgugacccaguggugcuguagaagcugcacaaugccuccccugcgguuccugggagaagacggcuguugguauggcauggagauucgcccccucaacgagaaggaagagaauauggucaaaucccaagugaccgccgggcagucuacaagcgaaaccuuuuccaugggacugcuuugccugacacucuucguggaggaaugucugagacggcgcgucaccagaaagcacaugauccuggccguugugaucacacuuugcgcuauuauccucggcgggcugaccuggauggaucugcuccgggcccugauuaugcuuggagacacaaugucuggccgcaucgggggacagacccaucuggcgauuauggcuguguuuaagaugagcccuggcuacguccucggcguguuccugagaaaacugacgucccgggagacagcccuuaugguuaucgggauggccaugaccacaaccuuuucuaucccgcacgaccugauggagcucauugauggaaucagccugggccucauucugcuuaagaucgugacccaguucgacaacacacaagucgggacgcuggcucucucccugaccuuuauucgcagcacaaugucucuggugauggccuggagaaccaucauggcgguucuuuucguggucacacugauuccccucugucggaccuccugccugcagaaacagagccauuggguggaaaucacggcucucauccugggagcccaagcccuuccugucuaucugaugacacucaugaagggcgcuucuagacgcuccuggccccugaaugaggggauuauggccgugggacugguuagccuucugggcucugcucuccugaaaaacgaugugccucucgccggccccauggucgccggcgggcugcuucuggccgcuuacgugauguccgggagcuccgccgaccugagccucgaaaaggcugccaauguucagugggaugagauggccgacaucaccgggucuagcccuauuaucgaagugaagcaggaugaggacggauccuuuucuauucgggaugucgaggaaaccaacaugaucacacugcuugugaaacuggcucucaucaccgugagcggccuguacccccucgcgauuccgguuacaaugacgcugugguauauguggcaggucaagacccaaagauccggggcccuuugggacgugccuucucccgcugccacacagaaagccgcucugagcgagggaguguaccgcaucaugcagcggggccugcucggcaagacccaggucggggugggcauucacauggaaggcguuuuccacacaauguggcaugugaccagaggguccgucaucugucacgagacgggacgccuggaaccuucuugggccgaugugcggaaugacaugauuagcuauggcgggggauggagacuuggcgauaaaugggaccgcgaggaggacguucaagugcuggcgaucgaacccggcaagaacccgaagcauguccagaccaaaccuggacucuucaagacacugaccggagagaucggcgcugugacacucgauuuuaaacccgggaccuccggaagcccuauuaucaaucggaagggcaaaguuauugggcuguacggcaacggaguggucacaaagucuggcgacuauguguccgccaucacgcaggccgaaagaauuggggagcccgauuacgagguggacgaagauaucuuccggaaaaagcgccuuaccauuauggaccugcaccccggagcuggcaagacaaaaagaauccugccuagcaucguccgggaggcccucaagcgcagacugcggacccuuauucuggcgccgaccagaguuguggcugccgaaauggaggaagcccuccgcgggcugcccauccgguaucagaccccugcugugaaaucugagcauacgggaagagagauugucgaucucaugugccacgccaccuuuacaacccgccugcuuuccagcacacgggugcccaauuacaaccugaucguuauggacgaagcucacuucaccgauccuuccucuguggccgcgagaggcuacauuagcacgcgcgucgagaugggggaagccgcugccaucuuuaugacagcuacacccccuggcgccaccgacccguucccccaauccaauagcccuaucgaggauauugaacgggagauccccgagagaucuuggaacacaggauuugacuggauuaccgacuaucagggcaagacagugugguucguuccuuccaucaaagccgggaaugauauugcuaacugccugcgcaagagcggaaagaaagugauccagcucucuagaaagaccuuugacacggaauaccccaaaacaaagcugaccgauugggacuucgucgugacaaccgauaucagcgagaugggcgcgaacuuucgggccgggcgcgucauugacccgagacggugucuuaaaccugugauccugacggauggacccgaacgcguuauucucgcuggccccaucccugugacccccgccuccgccgcucaaagacgggggagaauuggccgcaauccugcccaggaggacgaucaguauguguucucuggagacccgcugaagaacgaugaagaccaugcgcacuggacagaggcuaagaugcugcucgauaauaucuacacccccgagggcauuaucccuacacuuuucgggcccgaacgggagaaaacccaggccaucgacggagaauuuagacugcgcggcgagcaacggaagacauucgucgagcugaugagaagaggggaccucccuguuuggcugagcuauaaaguggccuccgcuggaauuucuuacaaggaucgcgaauggugcuuuaccggcgagagaaacaaucagauccuugaagagaacauggaaguggagauuuggacgcgggagggcgagaagaagaagcugcgccccagauggcucgacgcccgggucuaugcggauccgauggcccugaaagacuucaaggaguuugcuagcgggcgcaaauccaucacacuggauauucucaccgaaaucgccagccuuccuaccuaccugucuuccagagcuaagcuggcccucgacaauaucgugaugcugcauacaaccgagcggggaggccgcgcuuaccagcacgcccuuaacgaacugcccgagagccucgagacacugaugcugguugcgcuccuuggggccaugacggcuggaauuuuccuguuuuucaugcagggcaaagggaucggaaagcuguccaugggccucauuaccaucgccauggcuucuggccugcuuuggauugccgaaauccaaccucaguggaucgccgcuagcauuauccuggaguuuuuccucauggugcugcugauucccgaaccugagaagcagagaacaccccaggauaaucaacucaucuaugucauucuuaccauccugacaauuaucgggcugaucgcggccaacgaaaugggacucauugagaaaaccaagacggacuuuggcuucuaccaggugaaaaccgagacaaccauccuggaugucgaccuucggccggcuuccgccuggacacuguaugccguggcuaccacgauucucacaccuaugcugagacacaccaucgaaaauacaucugccaaccugagccucgcggccauugcuaaucaggccgcuguucuuauggggcugggaaagggcuggccccugcaucgcauggaucucggggugccccugcuugccaugggauguuacucccaggucaacccuaccacccugacagcgagccucgugaugcugcugguucacuaugccaucaucggcccgggccuccaagcuaaagccacgcgggaggcucagaagagaaccgccgcugggauuaugaaaaaucccacaguggacggaaucaccgucauugaucuugaaccuaucucuuacgaccccaaguuugagaagcagcugggccaagugaugcugcucgugcugugcgccgggcagcuucugcucaugcgcacaaccugggcguucugugagguucugacgcuggccacaggaccuauucucacccuuugggaaggcaaccccgggcgguucuggaacaccacaaucgcugucuccaccgccaauaucuuuagaggaagcuaucuggcuggcgccggccuggccuucucucucauuaaaaacgcgcagacaccucgccgggggacgggaaccacaggcgagacccugggggaaaaguggaaaagacagcuuaauucccuggaccgcaaggaguuugaagaguacaaacggagcggaauccucgagguggauagaacagaagcuaagucugcccugaaggacggcagcaaaauuaagcaugcugugucccgcgggucuagcaaaauccgguggauugucgagagaggaaugguuaagccgaaaggcaaggugguggaucugggcugcgggcgcggaggcugguccuacuauauggccacccucaagaacgucacggaagugaaaggguacaccaagggaggccccgggcacgaggaaccuauccccauggccacauauggauggaaucuuguuaaacugcauagcggcguggacgucuucuacaagccuaccgagcaaguggauacacugcucugugacauuggcgaguccucuagcaaccccaccaucgaagaggggagaacacugcggguucuuaaaaugguggaaccguggcuguccucuaagccugaguuuugcaucaagguccucaaucccuauaugcccaccgugauugaagaacuggagaaacugcagcgcaagcacggaggcaaccucgugagauguccucuuagcagaaauuccacgcacgaaauguacugggucucuggggcuagcggaaacaucguuuccagcgugaauacaaccucuaaaaugcugcugaacagauucaccacacggcaucgcaagcccacguaugagaaagauguggaccucggcgccgggaccagauccgucagcacagaaaccgagaagccugauaugacaauuaucggacggcgccugcagagacuucaggaggaacacaaagagaccuggcauuacgaccaagaaaauccguaccggacaugggcguaucacggcucuuacgaggcccccuccaccggcagcgcuucuuccauggugaacgggguugugaagcugcucacgaagccuugggaugucauucccauggugacccagcuggccaugacagacaccacaccuuuuggacagcagcgcguuuucaaagaaaagguggacaccagaacgccccaaccgaaaccuggcacacggauggucaugaccacaaccgcuaauuggcugugggcccuccuggggaagaaaaagagcccccgccuuugcacgagagaggaguuuaucuccaaggugcggagcaacgcggccaucggagcuguuuuccaggaagaacagggcuggaccucugccagcgaagcuguguccgauucucgcuuuugggagcuggucgacaaagaaagagcccuccaccaagaggggaagugugagagcugcguguauaauaugaugggcaaacgggaaaagaaacugggagaguucggccgcgcuaagggguccagagccauuugguacauguggcuuggagcgcgguuucuggaguucgaggcccucggcuuccugaacgaagaucauugguuugggagagagaacucuuggagcggagucgagggcgaagggcugcaccgccucggcuauauccuggaggaaauugacaagaaagauggagaccuuauguacgcugaugacacagccggcugggauacccggaucacagaggacgaucugcagaaugaggaacucauuaccgagcagauggcuccucaucacaagauccuggccaaagccaucuucaaacuuacauaucagaacaaagugguuaaggugcugagacccaccccucgcggggcggucauggacauuaucucccggaaggaucaaagaggaucuggccagguggggacguacagccucaauacauuuaccaacauggaagugcagcugauucgccagauggaggcugaaggaguuaucacccaagacgacaugcagaaucccaaaggccugaaggagcggguggagaacuggcucagagaaugcggggucgaucgccugaaacggauggccauuuccggcgacgauugugugguuaagccgcuugacgagagauucggaacaagccugcucuuucugaaugauaugggcaaagugcgcaaggacaucccucagugggaacccucuaaaggguggaagaacuggcaggagguccccuucugcucccaucacuuucacaagaucuucaugaaagauggacggagccuuguggucccuuguagaaaucaagacgaacugauuggccgggccagaaucucucagggggcuggauggucccuccgcgagaccgccugccugggcaaggcuuacgcccagauguggagccugauguauuuucaucggagagaucuccgccuggcguccauggccauuuguucugcugugccgacagagugguuccccacgagcagaaccacaugguccauccacgcccaucaccaguggaugaccacagaagacaugcuuaaaguuuggaaccggguguggauugaggauaauccuaacaugaucgacaagacccccguccacagcugggaagacauuccuuaccuggggaaacgcgaggaucucuggugcggcucucugaucggacuuuccagcagagcuacgugggccaagaauauccauaccgcgauuacacaagugcggaaccugaucggcaaggaagaguauguugacuacaugcccgugaugaaacgcuauucugccccuagcgaguccgaagggguccucuga

SEQ ID NO: 20963 - RNA, 9867 nt, Artificial Sequence
  derived and/or modified CDS sequence (opt5) from DENV-4__GQ868583__SS-prME
agcaccaucacccugcucugccugauucccacggugauggccuuccaccuuuccaccagagacggagaaccucugaugaucgucgcuaagcaugaacgggggcgcccgcuccuguuuaaaacaaccgaggggauuaacaaguguacacuuaucgccauggaucugggagaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauuaugaucggggugggaaacagcgcgcugacacuccauugguuuagaaaaggcucuagcauugggaagauguucgaguccacguaccgcggagcuaaacggauggccauccugggcgaaaccgccugggauuuugggucugucggcggacuuuucacaagccugggcaaggcugugcaccagguuuuuggguccguguauaccacaauguucggaggcgucagcuggaugauuagaauccucaucggguuucuggugcuguggauuggaaccaauucucgcaacacguccauggccaugacaugcaucgcuguuggcgggauuacccuuuuccucggcuuuaccgugcaggccgacaugggaugugucgugagcuggucuggccgggagcugaagugcggguccggaaucuucguggucgauaauguucauacauggaccgaacaauacaaauuucagcccgagagcccugcgagacuggccuccgcuauucucaacgcccacaaggacggcgugugugggauccgcucuacaacgcggcuggagaaugugauguggaaacagauuaccaacgaacuuaauuauguccugugggagggaggccacgaccucacagugguugcuggcgaugugaaggggguccugaccaaaggaaagagagcccuggcgcccccugccagcgaccuuaaguacuccuggaaaacauggggcaaggcuaaaaucuucacccccgaagcccggaacucuacguuucucaucgaugggccggacaccagcgagugcccuaaugaacgcagagcuuggaacuccuucgagguggaggauuacggauucggcauguuuacaaccaauauuuggaugaaguuccgggaagggagcucugagguuugugaccauagacugauguccgccgccaucaaagaucagaaggcugugcacgcggacaugggauauuggauugaaagcucuaaaaaccaaacauggcagaucgagcgcgccucccugauugaagucaagaccugccucuggcccaagacacauacccuguggagcaauggcgugcuugagucucagaugcugaucccuaaaagcuacgcuggccccuuuucccagcacaacuaucggcaaggguacgccacgcagacaguuggaccuuggcaccucggcaagcuggagaucgauuucggggaaugccccggaaccaccgugacaauucaggaggacugugaucauagaggcccgagccugcgcaccacgacagccucugggaaacuugucacccaguggugcuguagauccugcacaaugccuccccuccgguuucugggagaagacggcuguugguauggcauggagauccgcccccugagcgagaaggaagagaacauggugaaaucccaagugaccgcugggcagggaacaucugaaaccuucagcaugggccuccugugccuuacgcuguuugucgaggaaugucucagacggcgcguuaccagaaagcacaugauucuggccguggugaucacacugugcgcgauuauccuugggggacucaccuggauggaucugcugcgggcucucaucaugcugggcgacacaauguccgggcgcauuggaggccagacccaucuugccaucauggccgucuucaagaugucuccuggcuacgugcuggggguuuuucucagaaaacugacgagccgggagacagcucugauggugauuggaauggccaugaccacaacccuuuccaucccgcacgaccugauggagcucauugauggcaucucucuggggcucauccugcuuaagauugucacccaguucgacaauacacaagugggaacgcuggcgcucagccugaccuuuauccgcuccacaaugagccugguuauggcuuggagaaccauuauggccgugcuuuucgucgugacacugaucccccucugucggaccucuugccugcagaaacagucccauugggucgaaauuacggcccucauccugggcgcucaagcccuuccuguguaucugaugacacucaugaagggggcuagcagacgcucuuggccccugaacgagggaauuauggccguuggccuggugucccuucugggcagcgcgcuccugaaaaaugaugucccucucgccgggcccaugguggcuggaggccugcuucuggccgcuuacguuaugucuggguccagcgccgaccugucccucgaaaaggccgcuaacgugcagugggaugagauggcggacaucaccggaagcucuccuaucauugaagucaagcaggaugaggacggcagcuuuuccauccgggauguggaggaaaccaauaugauuacacugcuugugaaacuggcccucaucaccguuucugggcuguacccccucgcuauuccggucacaaugacgcugugguauauguggcaagugaagacccaaagaagcggagcccuuugggacgugccuucccccgccgcuacacagaaagccgcgcugucugagggcgucuaccgcaucaugcagcggggccuguucgggaagacccaggugggaguuggcauccacauggaagggguguuccacacaauguggcaugucaccagaggaagcgugauuugucacgagacgggccgccucgaaccuuccugggcugauguucggaacgacaugaucucuuaugggggaggcuggagacugggcgauaaaugggacaaggaggaggacgugcaaguccuugccauugaacccgggaagaauccgaaacaugugcagaccaagccuggacuguuuaaaacacucaccggcgagaucggggccguuacacuggauuucaagcccggaaccagcggcuccccuauuaucaaccgcaaagggaaggugaucggccucuacggaaauggcgucgugacaaaaagcggggacuaugugucugcuauuacgcaggccgaacggaucggagagcccgauuacgaggucgacgaagauauuuuuagaaagaagcggcugaccaucauggaccuucaccccggcgcggggaaaacaaagcgcauucugccuuccaucguuagagaggcucugaaacggcgccucagaacccugauucuugccccgacccgggugguggccgcugaaauggaggaagcccugagaggacuccccauccgcuaucagacgccugcugucaagagcgagcauacaggccgggagaucguggaucugaugugccacgccaccuucacaaccagacuccugucuuccacacgcguucccaacuacaaucuuauugugauggacgaagcgcacuuuaccgauccuagcuccgucgccgcucggggguacaucucuacgagaguggagaugggcgaagccgcugccauuuucaugacagccacacccccuggagcuaccgacccguuuccccaaagcaacuccccuaucgaggauauugaacgcgagauccccgagcggagcuggaauacaggcuucgacuggaucaccgacuaucaggggaaaacaguuugguuugugccuucuauuaaggcgggaaacgauaucgccaauugccugagaaaguccggcaaaaaggucauucagcugagccgcaaaaccuucgacacggaauaccccaagacaaaacucaccgauugggacuuuguggucacaaccgauaucucugagaugggggcuaacuucagagccggacgggugauugacccgcgcagaugucugaagccuguuauccuuacggauggccccgaacgggugauccuggccgggcccauuccugugacccccgcuagcgccgcgcaacgcagaggccggaucggaagaaacccugcucaggaggacgaucaguaugucuucuccggcgacccgcucaagaaugaugaagaccaugcccacuggacagaggccaaaaugcugcuggauaacauuuacacccccgaggggaucauuccuacacucuuuggacccgaacgcgagaagacccaggcuaucgacggcgaguuccggcuuagaggggagcaacgcaaaacauuuguugagcugaugcggagaggagaccugccuguguggcucucuuauaagguggccagcgcgggcauuuccuacaaagaucgggaauggugcuucaccggcgagcgcaauaaccagauccuggaagagaauauggaagucgagaucuggacgagagagggggaaaagaagaaacuucggcccaaguggcuggacgcccgcguguaugcugauccgauggcccuccaggacuuuaaagaguucgcuucuggaagaaagagcauuacacuggauauccugaccgaaauugccucccucccuaccuaccuuagcucucgggcuaaacuggcccuggacaacaucguuaugcuccauacaaccgagcgcggcgggagagcguaccagcacgcccugaaugaacuucccgagucccuggagacacucaugcugguggcucugcucggagccaugacggcuggcauuuuucuuuucuuuaugcaagggaagggaaucggcaagcugagcaugggccugaucaccauugccgucgccuccgggcuccuguggguggcugaaauccagccucaguggauugcggccucuaucauucuugaguucuuucugaugguccuccugauccccgaaccugagaaacagcggacaccccaagauaaccagcugaucuaugugauucucaccauccuuacaauuaucggacugauugcugccaaugaaaugggccugaucgagaagaccaaaacggacuucggguuuuaccagguuaagaccgagacaaccauucucgauguggaccugcgcccggccagcgcuuggacacuuuaugccgucgcgaccacgauccugacaccuaugcucagacacaccaucgaaaacacauccgccaaucugucucuggcugccauugcuaaccaggccgcggugcucaugggacuuggcaaaggguggccccugcaucggauggaucugggaguuccccuccuggccaugggcuguuacagccaagugaauccuaccacccuuacagcuucccuggucaugcuccuggugcacuaugccaucauuggcccggggcugcaggcuaaggccacgagagaggcucagaaacgcaccgccgcgggaaucaugaagaaccccacaguggacggcauuaccguuaucgaucucgaaccuaucagcuacgaccccaaguucgagaaacaacuugggcaggucaugcugcuggugcucugcgccggacagcugcuucugaugcggacaaccugggcuuucugugaggugcucacgcuggccacaggcccuauucugacccucugggaagggaaucccggaagauuuuggaacaccacaaucgcugucucuaccgccaacauuuuccgcggcuccuaucuugccggcgcggggcuggcuuuuagccugaucaagaaugcccagacaccucggagaggaacgggcaccacaggggagacccucggagaaaaauggaagcgccaacugaacucucuugaccggaaagaguucgaagaguacaagagauccggcauucuggagguugaucgcacagaagcuaagagcgcccucaaagacgggucuaagaucaaacaugccgugagccggggauccucuaagaucagauggauuguggagcgcggcauggucaaaccgaagggcaaggugguugaucuggggugcggacggggcggguggagcuacuauauggcuacccugaaaaaugugacggaagucaagggauacaccaaaggcgggcccggacacgaggaaccuauccccauggccacauauggcuggaaccucgugaaacuucauuccggcguugacguguuuuacaaaccuaccgagcaggucgauacacugcugugugacauuggggagagcuccucuaaucccaccaucgaagagggaagaacacuccgcgugcugaagaugguggaaccguggcuuagcuccaagccugaguucugcauuaaaguccugaaccccuauaugcccaccguuaucgaagaacucgagaagcugcagagaaaacacggcgggaaucuggugcgguguccucucucucgcaacagcacgcacgaaauguacuggguguccggagcgucuggcaauauugucagcuccgugaacacaaccagcaagaugcuucugaauagauuuaccacacggcauagaaaacccacguaugagaaggauguugaccugggggccggaacccggucuguguccacagaaaccgagaaaccugauaugacaaucaucggccgcagacuccagcggcugcaagaggaacacaaggagaccuggcauuacgaccaggaaaacccguaccgcacaugggcuuaucacggcagcuacgaggcccccucuaccggguccgcuagcucuauggucaauggagugguuaaacuucugacgaaaccuugggaugugauucccauggucacccagcucgccaugacagacaccacaccuuucggccagcaaagaguguuuaaggaaaaaguugacacccggacgccccagccgaagccugggacacgcauggugaugaccacaaccgcgaacuggcugugggcccugcucggcaagaagaagaaucccagacugugcacgcgggaggaguucaucuccaaaguccgcagcaacgcugccauuggcgcuguguuucaggaagaacagggguggaccuccgccagcgaagcugucucugauagcagauucugggagcuuguggacaaggaacgggcccugcaccaggagggcaaaugugaguccugcguuuauaauaugaugggaaagcgcgagaagaagcucggcgaguuugggagagcgaagggaucucgggccaucugguacauguggcugggcgcucgcuuccuugaguucgaggcccugggguuucucaacgaagaucauugguucggaagagagaacagcugguccggcguggagggggaaggccugcaccggcugggauauauucucgaggaaaucgacaaaaaggauggcgaccugauguacgcugaugacacagccgggugggauaccagaaucacagaggacgaucuucagaaugaggaacugauuaccgagcagauggccccucaucacaaaauccucgcgaaggcuauuuuuaaacugacauaucaaaacaaggucgugaaggugcuucgccccaccccucggggagccguuauggacaucauuucuagaaaagaucagcgcggcagcggacaggugggaacguacggccugaauacauucaccaacauggaaguccagcucauccggcaaauggaggccgaaggggugaucacccaggacgacaugcagaaucccaagggccugaaagagagaguugagaaguggcugcgcgaaugcggaguggaucggcucaaaagaauggcuauuuccggcgacgauugugucgugaagccgcuggacgagcgcuuugggacaucucuucuguuccucaacgauaugggaaaaguccggaaggacaucccucagugggaacccagcaagggcuggaaaaauuggcaagaggugcccuuuugcucccaucacuuccacaagauuuuuaugaaagaugggagaagccugguugugccuugucgcaaccaggacgaacuuaucggacgggccagaauuucucagggcgcuggguggucccugcgggagaccgccugccucggcaaggcguacgcccagauguggagccugauguauuuccauagacgcgaucugcggcucgcuucuauggccaucuguuccgcugucccgacagagugguuucccacgagcagaaccacaugguccauccacgcccaucaccaauggaugaccacagaagacaugcugaaaguguggaaucgcguuuggauugaggauaacccuaauaugaucgacaagacccccgugcacucuugggaagacauuccuuaccuuggaaagagagaggaucuguggugcggcagccucaucgggcuguccagccgggcgacgugggccaaaaacauucauaccgcuaucacacagguccgcaaucuuauuggaaaggaagaguauguggacuacaugcccgugaugaaaagauauucugccccuuccgagagcgaaggcguucuguga

SEQ ID NO: 20964 - RNA, 9867 nt, Artificial Sequence
  derived and/or modified CDS sequence (opt5) from DENV-4__GQ868584__SS-prME
agcaccaucacccugcucugccugauucccacggugauggccuuccaccuuuccaccagagacggagagccucugaugaucgucgcuaagcaugaacgggggagaccgcuccuguuuaaaacaaccgagggaauuaacaaguguacacuuaucgccauggaucugggagaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccagcgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggacagacaguacauuugucggcgcgaugugguggacagaggcugggggaacggaugcggccucuucgggaaaggaggcgucgugacaugcgcgaaguuuucuuguuccggcaaaaucaccgggaaucugguucagauugagaaccuugaauauaccguggucgugacaguucauaauggagauacccacgccgugggcaacgacacaagcaaucacggggucacggcuaccaucacaccucggucucccuccguggaggucaagcugccugauuacggagaacucacccuggacugcgagcccagaagcggcaucgacuucaacgagaugauucugaugaagaugaaaaagaaaacauggcucgugcauaagcaaugguuucuggaucuuccgcugccuuggaccacgggggccgacaccucugaaguucacuggaauuacaaagagcgcauggugacauucaaggucccccaugcuaaacggcaggaugugaccguucucggcucccaggaaggagccaugcacagcgcccuggcuggcgcgacagagguggacuccggggauggaaaccacauguuugccggccaucuuaaguguaaggucagaauggaaaaacugcgcaucaaggggaugucuuauaccaugugcagcggaaaauucuccauugacaaggagauggcugagacgcagcacggcacaaccguggugaaaguuaaguacgaaggggccggcgccccuuguaagguccccaucgagauucgggaugugaauaaagaaaagguggucggaagagugaucagcgcuacaccccucgccgagaacaccaacucuguuaccaauaucgagcuggaaccuccguucggcgacuccuauauuaugaucggggugggaaacagcgcgcugacacuccauugguuucgcaaaggcucuagcauugggaagauguucgaguccacguaccggggagcuaaaagaauggccauccugggcgaaaccgccugggauuuugggucugucggcggacuuuucacaagccugggcaaggcugugcaccaaguuuuuggguccguguauaccacaauguucggaggcgucagcuggaugauucgcauccucaucggguuucuggugcuguggauuggaaccaauucucggaacacguccauggccaugacaugcaucgcuguuggcgggauuacccuuuuccucggcuuuaccgugcaggccgacaugggaugugucgugagcuggucuggcagagagcugaagugcggguccggaaucuucguggucgauaauguucauacauggaccgaacaguacaaauuucaacccgagagcccugcgcgccuggccuccgcuauucucaacgcccacaaggacggcgugugugggauccggucuacaacgagacuggagaaugugauguggaaacagauuaccaacgaacuuaauuauguccugugggagggaggccacgaccucacagugguugcuggcgaugugaaggggguccugaccaaaggaaagcgggcccuggcgcccccugccagcgaccuuaaguacuccuggaaaacauggggcaaggcuaaaaucuucacccccgaagcccgcaacucuacguuucucaucgaugggccggacaccagcgagugcccuaaugaaagacgggcuuggaacuccuucgagguggaggauuacggauucggcauguuuacaaccaauauuuggaugaaguucagagaagggagcucugagguuugugaccaucgccugauguccgccgccaucaaagaucagaaggcugugcacgcggacaugggauauuggauugaaagcucuaaaaaccagacauggcaaaucgagcgggccucccugauugaagucaagaccugccucuggcccaagacacauacccuguggagcaauggcgugcuugagucucagaugcugaucccuaaaagcuacgcuggccccuuuucccagcacaacuauagacagggguacgccacgcaaacaguuggaccuuggcaccucggcaagcuggagaucgauuucggggaaugccccggaaccaccgugacaauucaggaggacugugaucaucgcggcccgagccugagaaccacgacagccucugggaaacuugucacccaguggugcugucgguccugcacaaugccuccccuccgcuuucugggagaagacggcuguugguauggcauggagaucagaccccugagcgagaaggaagagaacauggugaaaucccaggugaccgcugggcaaggaacaucugaaaccuucagcaugggccuccugugccuuacgcuguuugucgaggaaugucuccggcgcagaguuacccggaagcacaugauucuggccguggugaucacacugugcgcgauuauccuugggggacucaccuggauggaucugcugcgcgcucucaucaugcugggcgacacaauguccgggagaauuggaggccagacccaucuugccaucauggccgucuucaagaugucuccuggcuacgugcuggggguuuuucuccggaaacugacgagccgcgagacagcucugauggugauuggaauggccaugaccacaacccuuuccaucccgcacgaccugauggagcucauugauggcaucucucuggggcucauccugcuuaagauugucacccaguucgacaauacacaggugggaacgcuggcgcucagccugaccuuuaucagauccacaaugagccugguuauggcuuggcggaccauuauggccgugcuuuucgucgugacacugaucccccucuguagaaccucuugccugcaaaaacagucccauugggucgaaauuacggcccucauccugggcgcucaggcccuuccuguguaucugaugacacucaugaagggggcuagccgccggucuuggccccugaacgagggaauuauggccguuggccuggugucccuucugggcagcgcgcuccugaaaaaugaugucccucucgccgggcccaugguggcuggaggccugcuucuggccgcuuacguuaugucuggguccagcgccgaccugucccucgaaaaggccgcuaacgugcaaugggaugagauggcggacaucaccggaagcucuccuaucauugaagucaagcaggaugaggacggcagcuuuuccaucagagauguggaggaaaccaauaugauuacacugcuugugaaacuggcccucaucaccguuucugggcuguacccccucgcuauuccggucacaaugacgcugugguauauguggcaagugaagacccagcgcagcggagcccuuugggacgugccuucccccgccgcuacacaaaaagccgcgcugucugagggcgucuaccggaucaugcagagaggccuguucgggaagacccaggugggaguuggcauccacauggaagggguguuccacacaauguggcaugucacccgcggaagcgugauuugucacgagacgggccggcucgaaccuuccugggcugauguuagaaacgacaugaucucuuaugggggaggcuggcgccugggcgauaaaugggacaaggaggaggacgugcagguccuugccauugaacccgggaagaauccgaaacaugugcaaaccaagccuggacuguuuaaaacacucaccggcgagaucggggccguuacacuggauuucaagcccggaaccagcggcuccccuauuaucaaccggaaagggaaggugaucggccucuacggaaauggcgucgugacaaaaagcggggacuaugugucugcuauuacgcaggccgaaagaaucggagagcccgauuacgaggucgacgaagauauuuuucggaagaagcgccugaccaucauggaccuucaccccggcgcggggaaaacaaagcgcauucugccuuccaucguucgggaggcucugaaacgcagacuccggacccugauucuugccccgaccagagugguggccgcugaaauggaggaagcccugcgcggacuccccauccgguaucagacgccugcugucaagagcgagcauacaggcagagagaucguggaucugaugugccacgccaccuucacaacccgccuccugucuuccacacggguucccaacuacaaucuuauugugauggacgaagcgcacuuuaccgauccuagcuccgucgccgcuagaggguacaucucuacgcgcguggagaugggcgaagccgcugccauuuucaugacagccacacccccuggagcuaccgacccguuuccccagagcaacuccccuaucgaggauauugaacgggagauccccgagagaagcuggaauacaggcuucgacuggaucaccgacuaucaagggaaaacaguuugguuugugccuucuauuaaggcgggaaacgauaucgccaauugccugcgcaaguccggcaaaaaggucauucagcugagcagaaaaaccuucgacacggaauaccccaagacaaaacucaccgauugggacuuuguggucacaaccgauaucucugagaugggggcuaacuuccgggccggacgcgugauugacccgagacggugucugaagccuguuauccuuacggauggccccgaacgcgugauccuggccgggcccauuccugugacccccgcuagcgccgcgcagagacggggcagaaucggacgcaacccugcucaagaggacgaucaguaugucuucuccggcgacccgcucaagaaugaugaagaccaugcccacuggacagaggccaaaaugcugcuggauaacauuuacacccccgaggggaucauuccuacacucuuuggacccgaacgggagaagacccaggcuaucgacggcgaguucagacuucgcggggagcagcggaaaacauuuguugagcugaugagacggggagaccugccuguguggcucucuuauaagguggccagcgcgggcauuuccuacaaagaucgcgaauggugcuucaccggcgagagaaauaaccaaauccuggaagagaauauggaagucgagaucuggacgcgggagggggaaaagaagaaacuucgccccaaguggcuggacgccagaguguaugcugauccgauggcccucaaagacuuuaaggaguucgcuucuggacggaaaagcauuacacuggauauccugaccgaaauugccucccucccuaccuaccuuagcucucgcgcuaagcuggcccuggacaacaucguuaugcuccauacaaccgagagaggcgggcgggcguaccagcacgcccugaaugaacuucccgagucccuggagacacucaugcugguggcucugcucggagccaugacggcuggcauuuuucuuuucuuuaugcaggggaagggaaucggcaaacugagcaugggccugaucaccauugccgucgccuccgggcuccuguggguggcugaaauccagccucaauggauugcggccucuaucauucuugaguucuuucugaugguccuccugauccccgaaccugagaagcagcgcacaccccaggauaaccagcugaucuaugugauucucaccauccuuacaauuaucggacugauugcugccaaugaaaugggccugaucgagaaaaccaagacggacuucggguuuuaccaaguuaaaaccgagacaaccauucucgauguggaccugagaccggccagcgcuuggacacuuuaugccgucgcgaccacgauccugacaccuaugcuccggcacaccaucgaaaacacauccgccaaucugucucuggcugccauugcuaaccaggccgcggugcucaugggacuuggcaagggguggccccugcauagaauggaucugggaguuccccuccuggccaugggcuguuacagccaggugaauccuaccacccuuacagcuucccuggucaugcuccuggugcacuaugccaucauuggcccggggcugcaggcuaaagccacgcgcgaggcucaaaagcggaccgccgcgggaaucaugaagaaccccacaguggacggcauuaccguuaucgaucucgaaccuaucagcuacgaccccaaauucgagaagcagcuugggcaggucaugcugcuggugcucugcgccggacaacugcuucugaugagaacaaccugggcuuucugugaggugcucacgcuggccacaggcccuauucugacccucugggaagggaaucccggacgcuuuuggaacaccacaaucgcugucucuaccgccaacauuuuccggggcuccuaucuugccggcgcggggcuggcuuuuagccugaucaaaaaugcccagacaccuagacgcggaacgggcaccacaggggagacccucggagaaaaguggaaacggcagcugaacucucuugacagaaaggaguucgaagaguacaagcgcuccggcauucuggagguugaucggacagaagcuaaaagcgcccucaaggacgggucuaaaaucaagcaugccgugagcagaggauccucuaaaauccgcuggauuguggagcggggcauggucaagccgaagggcaaagugguugaucuggggugcggaagaggcggguggagcuacuauauggcuacccugaagaaugugacggaagucaaaggauacaccaagggcgggcccggacacgaggaaccuauccccauggccacauauggcuggaaccucgugaaacuucauuccggcguugacguguuuuacaagccuaccgagcaggucgauacacugcugugugacauuggggagagcuccucuaaucccaccaucgaagagggacgcacacucagagugcugaagaugguggaaccguggcuuagcuccaaaccugaguucugcauuaagguccugaaccccuauaugcccaccguuaucgaagaacucgagaaacugcaacggaagcacggcgggaaucuggugcgcuguccucucucuagaaacagcacgcacgaaauguacuggguguccggagcgucuggcaauauugucagcuccgugaacacaaccagcaaaaugcuucugaaucgguuuaccacaagacaucggaagcccacguaugagaaagauguugaccugggggccggaacccgcucuguguccacagaaaccgagaagccugauaugacaaucaucggcagacggcuccagcgccugcaggaggaacacaaggagaccuggcauuacgaccaggaaaacccguacagaacaugggcuuaucacggcagcuacgaggcccccucuaccggguccgcuagcucuauggucaauggagugguuaaacuucugacgaagccuugggaugugauucccauggucacccaacucgccaugacagacaccacaccuuucggccagcagcggguguuuaaagaaaagguugacacccgcacgccccagccgaaaccugggacaagaauggugaugaccacaaccgcgaacuggcugugggcccugcucggaaagaagaaaaauccccggcugugcacgcgcgaggaguucaucuccaaggucagaagcaacgcugccauuggcgcuguguuucaagaagaacagggguggaccuccgccagcgaagcugucucugauagccgguucugggagcuuguggacaaagaacgcgcccugcaccaggagggcaagugugaguccugcguuuauaauaugaugggaaaaagagaaaagaagcucggcgaguuugggcgggcgaaaggaucucgcgccaucugguacauguggcugggcgcuagauuccuugaguucgaggcccugggguuucucaacgaagaucauugguucggacgggagaacagcugguccggcguggagggggaaggccugcacagacugggauauauucucgaggaaaucgacaagaaagauggcgaccugauguacgcugaugacacagccgggugggauacccgcaucacagaggacgaucuucaaaaugaggaacugauuaccgagcagauggccccucaucacaagauccucgcgaaagcuauuuuuaagcugacauaucagaacaaggucgugaaagugcuucggcccaccccuagaggagccguuauggacaucauuucucgcaaggaucagcggggcagcgggcaagugggaacguacggccugaauacauucaccaacauggaaguccagcucaucagacagauggaggccgaaggggugaucacccaggacgacaugcaaaaucccaaaggccugaaggagcgcguugagaaauggcugcgggaaugcggaguggauagacucaagcgcauggcuauuuccggcgacgauugugucgugaaaccgcuggacgagcgguuugggacaucucuucuguuccucaacgauaugggaaaggucagaaaggacaucccucagugggaacccagcaaaggcuggaagaauuggcaggaggugcccuuuugcucccaucacuuccacaaaauuuuuaugaaggaugggcgcagccugguugugccuugucggaaccaggacgaacuuaucggcagagcccggauuucucaaggcgcuggguggucccugagagagaccgccugccucggcaaagcguacgcccagauguggagccugauguauuuccaucgccgggaucugagacucgcuucuauggccaucuguuccgcugucccgacagagugguuucccacgagccgcaccacaugguccauccacgcccaucaccaguggaugaccacagaagacaugcugaagguguggaauagaguuuggauugaggauaacccuaauaugaucgacaagacccccgugcacucuugggaagacauuccuuaccuuggaaaacgggaggaucuguggugcggcagccucaucgggcuguccagccgcgcgacgugggccaagaacauucauaccgcuaucacacaggucagaaaucuuauuggaaaagaagaguauguggacuacaugcccgugaugaagcgguauucugccccuuccgagagcgaaggcguucuguga

SEQ ID NO: 20965 - RNA, 9867 nt, Artificial Sequence
  derived and/or modified CDS sequence (opt5) from DENV-4__GQ868585__SS-prME
agcaccaucacccugcugugccugauucccacggugauggcuuuccaccuuuccacccgggacggagaaccucugaugaucguugcuaagcaugaacgggggcgcccgcuccuguuuaaaaccaccgaaggaauuaacaaguguacacuuaucgccauggaucugggagaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggaauggggcuggagacccgggcugaaacguggaugagcuccgagggagccuggaaacaugcccagcgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggaugaaaaccacauguuugccggacaucuuaaguguaagguccggauggagaaacugagaaucaagggcaugucuuauaccaugugcagcgggaaauucuccauugacaaggagauggcugaaacgcaacacggaacaaccguggugaaaguuaaguacgagggcgccggggccccuuguaagguccccaucgaaauucgcgaugugaauaaagagaagguggucggccgggugaucagcgcuacaccccucgccgagaacaccaacucuguuaccaauaucgaacuggagccuccguucggagacuccuauauugugaucggcgucgggaacagcgcgcugacacuccauugguuuagaaaaggaucuagcauuggcaagauguucgaauccacguaccgcggggcuaaacggauggccauccugggagagaccgccugggauuuuggcucuguugggggacuuuucacaagccugggaaaggcugugcaccagguguuuggcuccgucuauaccacaauguucgggggagugagcuggaugauuagaauccucaucggcuuucugguucuguggauugggaccaauucucgcaacacguccauggccaugacaugcaucgcugugggaggcauuacccuuuuccucggguuuaccguccaggccgacaugggcuguguggugagcuggucuggacgggaacugaagugcggcuccgggaucuucgucguugauaaugugcauacauggaccgagcaauacaaauuucagcccgagagcccugcgagacuggccuccgcuauucucaacgcccacaaggacggaguguguggcauccgcucuacaacgcggcuggaaaaugucauguggaaacagauuaccaacgagcuuaauuaugugcugugggaagggggacacgaccucacaguuguggcuggcgaugucaagggcgugcugaccaaagggaagagagcccugacacccccugcgagcgaccuuaaguacuccuggaaaaccuggggaaaggccaaaaucuucacgcccgaggcucggaacucuaccuuucucaucgauggcccggacacaagcgaaugcccuaaugagcgcagagccuggaacuccuucgagguugaagauuacggguucggaauguuuaccacaaauauuuggaugaaguuccgggagggcagcucugaagugugugaccauagacugauguccgcugccaucaaagaucagaaggccguccacgcugacaugggguauuggauugagagcucuaaaaaccaaaccuggcagaucgaacgcgcgucccugauugaggugaagacaugccucuggcccaagacccauacgcuguggagcaauggaguucuugagucucagaugcugaucccuaaaagcuacgccggccccuuuucccagcacaacuaucggcaaggcuacgcuacacagaccguggggccuuggcaccucggaaagcuggaaaucgauuucggcgagugccccgggaccacagucaccauucaggaaaacugugaccauagaggaccgagccugcgcacgacaaccgccucuggcaaacuugugacacaguggugcuguagauccugcaccaugccuccccuccgguuucugggggaggauggauguugguauggcauggagauccgcccccugagcgaaaaggaggaaaauauggugaaaucccaagucacagccggccaggggaccucugagacguucagcaugggacuccugugccuuacccuguuuguugaagagugucucagacggcgcgugacaagaaagcacaugauucuggcuguggucaucacccugugcgccauuauccuuggcgggcucacauggauggaccugcugcgggcgcucaucaugcugggagauaccauguccggccgcauugggggacagacgcaucuugcuaucauggccguguucaagaugucuccuggcuacguucugggcguguuucucagaaaacugacaagccgggagaccgcccugauggucauugggauggcuaugacaaccacccuuuccaucccgcacgaccugauggaacucauugacggaaucucucugggccucauccugcuuaagauugugacacaguucgauaacacgcaaguugggacccuggcccucagccugacauuuauccgcuccaccaugagccuggugauggcguggagaacaauuauggcuguccuuuucguggucacccugaucccccucugucggacgucuugccugcagaaacagucccauuggguggagauuacagcccucauccugggagcccaagcccuuccuguuuaucugaugacccucaugaagggcgccagcagacgcucuuggccccugaaugaagggauuauggcugugggacuggucucccuucugggcagcgcccuccugaaaaacgacgugccucucgcgggccccaugguugccgggggacugcuucuggcugccuacgugaugucuggcuccagcgcugaucugucccucgagaaggccgccaauguccagugggacgaaauggcugauaucaccgggagcucuccuaucauugaggugaagcaggacgaggauggcagcuuuuccauccgggacguggaagagacaaacaugauuacccugcuuguuaaacuggcgcucaucacagucucuggccuguacccccucgccauuccgaucacgaugacccugugguauauguggcaagugaagacacaaagaagcggggcucuuugggaugugccuucccccgccgccacccagaaagcugcccugucugaaggagucuaccgcaucaugcagcggggccuguucggcaagacacagguggggguuggcauucacauggagggcguguuccacaccauguggcaugucacgagagggagcgugaucugucacgaaaccggacgccucgagccuuccugggcggacguucggaaugauaugauuucuuauggcgggggauggagacugggcgacaaaugggauaaggaggaagacgugcaaguccuugcuaucgagcccggcaagaacccgaaacaugugcagacaaagccugggcuguuuaaaacccucacaggagaaauuggcgccguuacccuggacuucaagcccgggacaagcggauccccuaucaucaaucgcaaaggcaaggugauugggcucuacggcaacggagucgugacgaaaagcggcgauuaugugucugccaucacccaggcugagcggauuggggagcccgacuacgaagucgaugaggacaucuuuagaaagaagcggcugacaauuauggaucuucaccccggagccggcaaaaccaagcgcauccugccuuccauuguuagagaagcgcugaaacggcgccucagaacccugauccuugcuccgacacgggugguggccgccgagauggaagaggcucugagagggcuccccauccgcuaucagacgccugccgucaagagcgagcauaccggacgggaaauuguggaccugaugugccacgcuacauucaccacaagacuccugucuuccacccgcguucccaauuacaaccuuaucgugauggaugaggcccacuuuacggacccuagcuccgucgcggcccggggcuacauuucuacaagaguggaaaugggggaggcugccgcuaucuucaugaccgccacacccccuggcgccacagauccguuuccccaaagcaauuccccuauugaagacaucgagcgcgagauccccgaacggagcuggaacaccggauucgauuggauuacagacuaucagggcaaaaccguuugguuugugccuucuaucaaggcugggaaugacauugcgaacugccugagaaaguccggcaaaaaggucauccagcugagccgcaaaacguucgauacagaguaccccaagaccaaacucacagacugggauuuuguggucaccacggacauuucugaaaugggcgccaacuucagagcugggcgggugaucgauccgcgcagaugucugaagccuguuauccuuaccgacggacccgagcgggugauucuggccggccccaucccugugacacccgccagcgcugcccaacgcagagggcggauuggcagaaauccugcgcaggaagaugaccaguaugucuucuccggagauccgcucaagaacgacgaggaucaugcucacuggaccgaggccaaaaugcugcuggacaauaucuacacacccgaaggcauuaucccuacccucuuugggcccgagcgcgaaaagacacaggccauugauggagaguuccggcuuagaggcgagcaacgcaaaaccuuuguugaacugaugcggagaggggaccugccuguguggcucucuuauaagguggcuagcgccggaaucuccuacaaagaccgggaguggugcuucacgggcgaacgcaacaaucagauccuggaggaaaacauggaggucgagauuuggacaagagaaggcgagaagaagaaacuucggcccaaguggcuggaugcgcgcguguaugccgacccgauggcucucaaagauuuuaaggaguucgccucugggagaaaaagcaucacccuggacauucugaccgagaucgcuucccucccuacauaccuuagcucucgggccaagcuggcucuggauaauauuguuaugcuccauaccacagaacgcggaggcagagccuaccagcacgcgcugaacgagcuucccgagucccuggaaacgcucaugcugguggcccugcucggggcuaugaccgccggaaucuuucuuuucuuuaugcagggcaaggggaucggaaaacugagcaugggccugauuacaaucgcugucgccuccggccuccuguggguggccgagauucaaccucaguggaucgcugcgucuauuauccuugaguucuuucugaugguccuccugauccccgagccugaaaagcagcggacaccccaggacaaucaacugauuuaugugauccucacaauucuuaccaucauugggcugaucgccgcuaacgagaugggacugauugagaaaacgaagaccgauuucggcuuuuaccagguuaaaacagaaaccacaauccucgacguggaucugcgcccggccagcgccuggacccuuuaugcugucgccacgacaauccugaccccuaugcucagacacacaauugagaauaccuccgcgaaccugucucuggccgcuaucgccaaucaggcugccgugcucauggggcuuggaaagggcuggccccugcaucggauggaccuggggguuccccuccuggcgaugggauguuacagccaggugaacccuaccacacuuacggccucccuggucaugcuccuggugcacuaugcuauuaucggcccgggccugcaagccaaagcuaccagagaagcccagaagcgcacagcugccgggauuaugaagaaucccaccguggauggaaucacaguuaucgaccucgagccuauuagcuacgaucccaaauucgagaagcagcuuggccaagucaugcugcuggugcucugcgcggggcagcugcuucugaugcggaccacgugggccuucugugaagugcucacacuggcuaccggaccuauccugacccucugggagggcaaccccgggagauuuuggaacacaaccauugccgucucuacagcuaauaucuuccgcggauccuaucuugccggcgccggccuggcguuuagccugauuaaaaacgcucagacgccucggagagggaccggaacaaccggcgaaacacucggggagaaguggaaacgccagcucaauucucuugaccggaaggaguucgaggaguacaagagauccggaauccuggaaguugaccgcaccgaggccaaaagcgcucucaaggauggcucuaaaaucaagcaugccgugagccggggguccucuaaaauuagauggaucguggaacgcggaauggucaagccgaagggcaaagugauugaccugggcugcgggcggggaggcuggagcuacuauauggccacgcugaagaacguuaccgaggugaaaggguacacaaagggaggccccgggcacgaagaaccuauccccauggcuaccuauggauggaaucucgucaaacuucauuccggcguggaugucuuuuacaagccuacagagcaaguggacacccugcugugugauauuggcgaaagcuccucuaaccccacaaucgaggaagggagaacccuccgcguccugaagaugguggagccguggcuuagcuccaaaccugaguucugcauuaaggugcugaaucccuauaugcccacggucaucgaggagcucgaaaaacugcagagaaagcacggaggcaaccugguucgguguccucucucucgcaauagcacacacgagauguacuggguguccggggccucuggaaacaucgugagcuccgucaauaccaccagcaaaaugcuucugaacagauuuacaacgcggcauagaaagcccaccuaugaaaaagacguggaucugggcgcggggacacggucuguuuccaccgagacagagaagccugacaugaccauuaucggacgcagacuccagcggcugcaggaagaacacaaggaaacauggcauuacgaucaagagaauccguaccgcaccugggccuaucacggcagcuacgaagcucccucuacgggcuccgccagcucuauggugaacggggucgugaaacuucugaccaagccuugggacguuauucccauggugacacagcucgcuaugaccgauacaaccccuuucggacagcagagagucuuuaaagagaagguggacacgcggacaccccaaccgaaaccuggcacccgcaugguuaugacaaccacggccaauuggcugugggcgcugcucgggaagaagaaaaaccccagacugugcacccgggaggaguucaucuccaaggugcgcagcaaugccgcuauuggagccgucuuucaggaggaacagggcuggacauccgcuagcgaggccgugaacgacucuagauucugggaacuugucgauaaagagcgggcucugcaccaagaggggaagugugaaagcugcguguauaacaugaugggcaaacgcgagaagaagcucggagaauuuggcagagccaaagggucccgggcgaucugguacauguggcugggagcccgcuuccuugaguucgaagcucugggcuuucucaaugaggaccauugguucgggagagagaacucuuggagcggaguugaaggcgaggggcugcaccggcugggcuauauccucgaagagauugauaagaaagacggagaucugauguacgccgacgauaccgcuggcugggacacaagaaucaccgaggaugaccuucagaaugaagaacugauuacagaacagauggccccucaucacaagauccucgccaaagcgauuuuuaagcugaccuaucagaacaagguggucaaagugcuucgccccacgccuagaggggcugugauggauaucaucuccagaaaggaccaacgcggaucuggccagguugggacauacggacugaauaccuucaccaacauggaggugcagcucauucggcagauggaagccgagggcgucaucacacaagaugacaugcagaaucccaaagggcugaaggagagaguggaaaaauggcugcgcgagugcggcguugaccggcucaagagaauggccauuagcggagaugacuguguggucaaaccgcuggaugaacgcuuuggcaccucccuucuguuccucaacgacauggggaaggugcggaaggauaucccucagugggagcccucuaaaggauggaagaauuggcaggaaguccccuuuugcagccaucacuuccacaaaauuuuuaugaaggacggcagaucccuggugguuccuugucgcaaccaagaugagcuuaucgggcgggcuagaaucagccagggagccggcuggucucugcgggagacagcuugccucgggaaagccuacgcgcagauguggucccugauguauuuccauagacgcgaccugcggcucgccagcauggcuauuuguucugccgugccgacggaaugguuucccaccuccagaacaaccuggagcauccacgcucaucaccaguggaugacaaccgaggauaugcugaaggucuggaaucgcguguggauugaagacaacccuaauaugaucgauaagacgcccguucacuccugggaggacauuccuuaccuuggcaaaagagaagaccuguggugcggaucucucaucggccugagcucccgggccaccugggcgaagaacauucauacagccaucacccaagugcgcaaucuuaucgggaaagaggaguaugucgauuacaugcccgugaugaagagauauagcgcuccuucugaauccgagggagugcuguga

SEQ ID NO: 20966 - RNA, 9867 nt, Artificial Sequence
  derived and/or modified CDS sequence (opt5) from DENV-4__JQ922560__SS-prME
agcaccaucacacugcucugccugauucccacggugauggccuuccaccuuuccaccagagacggcgagccucugaugaucgucgcuaagcaugaacgggggcgcagacuccuguuuaaaacaaccgagggaauuaacaaguguacacuuaucgccauggaucugggcgaaaugugcgaggacaccguuacauacaaauguccgcuccuggugaauaccgaacccgaggauauugacugcugguguaaccugacgucugcgugggugauguaugggaccugcacacagagcggagagcggcgcagagaaaagcgguccgucgcucucaccccucacucuggcauggggcuggagacacgcgccgaaaccuggaugagcuccgagggagccuggaaacaugcucaaagaguggagucuuggauccuucggaaucccggcuucgcccugcucgcuggcuuuauggccuacaugaucgggcagacgggaauucagcgcacaguuuucuuuauccugaugaugcuuguggcgccuagcuauggcaugagaugugucggggugggaaaccgggauuucguugaaggcguguccgggggagccugggucgaccuggugcucgagcacggcggcugcgugaccacaauggcucaggggaagcccacccuggauuuugaacugauuaagaccacagccaaagaggucgcucuccugcgcacguacuguaucgaagccagcauuucuaauaucaccacagcgaccagaugcccuacacaaggagagccguaucuuaaggaggaacaggaccagcaguacauuugucggcgcgauguuguggacagaggcugggggaacggaugcggccuguucgggaaaggaggcguggucaccugcgccaaguuuuccuguacgggcaaaaucacagggaaucucauccaaauugagaaccuggaauauaccgugguugugaccguccauaauggagauacacacgcugugggcaacgacaccagcaaucacgggguuacagccacgaucaccccccggucuccuuccguggaggucgaacuucccgauuacggagagcugacacucgacugcgagccuagaagcggcauugacuucaacgaaaugauccugaugaagaugaauaagaaaaccuggcuggugcauaagcagugguuucucgaucugccccuuccgugggcugccggggccgacacaucugagguccacuggaaccauaaagaacgcauggugaccuucaagguuccucacgcuaaacggcaggaugugacgguccugggcucccaggagggagcgaugcacagcgcccucaccggcgcuacagaaguguacuccggggacggaaaucugauguuugccggccaucuuaaguguaaaguuagaauggagaagcugcgcauuaaggggaugucuuauaccaugugcagcggaaaauucuccaucgauaaggagauggccgaaacacaacacggcaccacgguggucaaagugaaguacgagggggcuggcgcccccuguaaagugccuaucgaaauucgggacguuaacaaggagaaggucgugggaagagugaucagcucuacacccuucgcggagaacaccaauuccgucacaaacauugaacucgagcccccuuuuggcgauagcuauaucgugauugggguuggagacucugcucugacccugcauugguucaccaaaggcagcuccaucgggaagauguuugaaucuacauaccgcggagccaaacggauggccauccucggcgagacggcuugggauuucgggagcgugggcggacugcuuaccucccugggcaaggccguccaccagguguuugggagcguuuauacaaccauguucggaggcgugucuuggauggucagaauucucaucggguuucuggugcuguggauuggaacaaauucccgcaacaccagcauggcuaugucuugcaucgccguuggcgggauuacgcuuuuccucggcuuuacagugcaugcggacaugggaugugccgucuccuggagcggcaaagaacugaagugcggguccggaaucuucauuaucgauaaugugcacaccuggaccgagcaguacaaguuucaaccggagucucccgcucggcuggccagcgcuauccucaacgcccacaaagacggcgugugugggauuagauccacaacccgccuggaaaaugucauguggaagcagaucacaaacgagcuuaauuauguucugugggaaggaggccaugaccucacggugguggcgggcgaugucaaaggggugcugucuaagggaaaacgggcccuggcuccucccguuaacgaccuuaaguacagcuggaagaccuggggcaaagccaagauuuucacaccugagaccagaaauuccacauuucucaucgaugggcccgacaccagcgaaugcccgaacgagcggcgcgcuuggaauuuccuggagguggaagauuacggauucggcauguuuacgaccaacauuuggaugaaauucagagaggggucuuccgaaaugugugaccaccggcugaugagcgccgccaucaaggaucagaaagcuguccaugcggacaugggauauuggaucgagucuuccaagaaucagacauggcaaauugaaaaagccagccucaucgaggugaagaccugccuguggccuaagacacacacccuuuggucuaacggcguucuggagagccagaugcucauucccaaagcuuacgccggcccuuuuucccagcacaacuauagacagggguacgccacacaaaccgugggacccuggcaucugggcaagcuggaaaucgauuucggggagugcccuggaacgacagucaccauucaggaagacugugaucaccgcggccccagccuucggaccacaaccgcuucugggaaacucgugacgcaguggugcuguagauccugcacaaugccgccucugcgcuuucugggagaggacggcuguugguauggcauggagaucagaccccucagcgaaaaggaggaaaauaugguuaaaucccaggugucugccgggcaaggaaccagcgagacauucuccaugggccugcuuugccugacccucuuugucgaagagugucugcggcgcagagugacacggaagcauaugauccugguggucguuaccacgcuuugcgcgauuauccucgggggacugaccuggauggaucugcuccgcgcucugauuaugcuuggcaacacaaugucuagcagaauggggggacagauccaccuggccauuauggccguguucaagaugucccccggcuacgugcucggcaucuuucugcggaaacugaccucucgcgagacagcucuuauggucaucgggauggccaugaccacggugcugagcauuccucaugaccucauggaauucguugacggaaucucccugggccucauucugcuuaagauggugacacacuuugauaauacccaggucgggacacuggcgcucagccugaccuucaucaaaucuaccaugccgcuggugauggcuuggagaacaauuauggccguucuuuuuguggucacgcugaucccccucugucggaccuccugccugcagaagcaaagccacuggguggagauuacagcccucauccugggagcucaggcccuuccugucuaucugaugacccucaugaaaggcgcuucuaagcgcuccuggccccugaacgaagggaucauggccgugggacugguuagccuucugggcucugcgcuccugaagaaugacgugccucucgccggccccauggucgcugggggacugcuucuggccgcuuacgugauguccggcagcuccgccgaucugagccucgagaaagccgcuacaguucagugggacgaaauggcggauauuaccgggucuagcccuaucauugaggugaagcaagacgaggauggauccuucucuaucagagacgucgaagagacgaacaugauuacacugcuugugaaacuggcccucaucaccgugagcggccuguacccccucgcuaucccgguuaccaugacacugugguauauguggcaggucaagacccagcgguccggggcccuuugggaugugccuucucccgccgcugcccagaaagcgacacugacggaaggaguguacagaauuaugcaacgcggccuguucggcaagacccaggucggggugggaauccauauggagggcguuuuucacacaauguggcaugugacccgggggagcgucauuugucacgaauccggaagacucgagccuucuugggcugacgugcgcaaugauaugaucagcuauggcgggggauggcggcugggcgacaagugggauaaagaggaagacguucaggugcuugccgucgagcccggcaagaacccgaaacaugugcagacaaagccugggcuguucaaaacccucacgggagaaauuggcgccguuacccuggacuuuaagcccgggacauccggaagcccuaucaucaauagaaaaggcaaggugauugggcucuacggcaacggagucgugaccaagucuggcgauuauguguccgcuaucacacaagccgagcgcauuggggagcccgacuacgaagucgaugaggacaucuuccggaaaaagagacugaccauuauggaucuucaccccggagcgggcaaaacaaagcgcauccugccuagcauuguucgggaagcucugaaaagacggcuccgcacgcugauccuugccccgaccagagugguggccgcugagauggaagaggcccugcgggggcuccccauccgcuaucagacaccugcugucaagucugagcacaccggaagagaaauuguggaccugaugugccaugccaccuuuacaacgcggcuccuguccagcaccagaguucccaauuacaaccuuaucgugauggaugaggcgcacuucacagacccuuccucugucgccgcucgcggcuacauuagcacccggguggaaaugggggaggccgcugccaucuuuaugacagccacccccccuggcacgacagauccguucccccaguccaauagcccuauugaagacaucgagagagagauccccgaacgcucuuggaacaccggauuugauuggauuaccgacuaucagggcaagacaguuugguucgugccuuccaucaaagcugggaaugacauugcgaacugccugcggaagagcggaaaaaaggucgugcaacugucuagaaaaaccuuugauacagaguaccccaagaccaagcucacggacugggauuucgucgugacaaccgacaucagcgaaaugggcgccaacuuccgcgcugggcggguuauugauccgagacgcugucugaaaccugugaucaucacagacggacccgagagagugauucuugccggccccaucccugucacccccgccuccgcugcccagcggcgcgggagaauuggccggaauccugcgcaggaagaugaccaauauguuuuuucuggagauccgcugcgcaacgacgaggaucaugcucacuggacggaggccaagaugcuccuggacaauaucuacacccccgaaggcauuaucccuacacuguucgggcccgagagagaaaaaacccaggccauugauggagaguuucggcucagaggcgagcagcgcaagacauucguggaacuuaugcggagaggggaccugccuguguggcugagcuauaaagucgcuuccgccggaaucucuuacaaggaccgcgaguggugcuuuaccggcgaacggaacaaucagauccucgaggaaaacauggagguggagauuuggacaagagaaggcgagaagaaaaagcugcggcccaaauggcuugaugcgcgcguuuaugccgacccgguggcucugaaggauuucaaagaauuugccagcgggagaaaguccaucacccucgacauucugacggagaucgcuagccugccuacauaccucucuucccgggccaagcuugcucuggauaauauugucaugcugcacaccaccgaacgcggaggcaaagccuaccaacaugcgcucaacgagcugcccgagagccuugaaacacugaugcucaucgcccugcugggggcuaugaccgccggaaucuuccucuuuuucaugcagggcaaggggaugggaaaacuuuccaugggccugauugcuaucgccguggccucuggccugcucugggucgcugagauucagccucaguggaucgcggccagcauuauccuggaauuuuuccuuauggcucugcucauccccgagccugaaaagcaaagaacaccccaggacaaucagcugauuuaugugauccugacgauucucaccaucauugggcuuguugccgccaacgagaugggacugaucgagaaaacaaagaccgauuuuggcuucuaccaggaaaaaacagagaccacgauucuggacguggaucuccggccggcuuccgccuggacccuguaugcggucgccacaaccauccuuacaccuaugcugcgccacaccaucgaaaauacgucugcuaaccucagccuggccgcuauugccaaucaagcggccgugcugauggggcucggaaagggcuggccccuucauagaauggaccuggggguuccccugcucgcuaugggauguuacucccaggugaacccuacaacccugacagccagccuugucaugcugcucgugcacuaugcuaucauuggcccgggccugcaggccaaggcuacccgggaggcccagaaacgcaccgcggccgggaucaugaagaaucccacaguggauggaauuacgguuaucgaccuggagccuaucucuuacgaucccaaauucgaaaagcaacucggccaggucaugcuucuggugcugugcgcugggcagcuccugcuuaugagaaccacaugggccuuuugugaggugcugacccucgcuacaggaccuauucugacccugugggaaggcaaccccgggcgguucuggaacacgacaaucgccgucuccaccgccaauauuuuuagaggaagcuaucucgcgggcgcuggccuugccuucucucugaucaaaaacacccaaacaccucgccgggggaccggaacaacgggcgagacccugggggaaaaguggaagagacagcucaauucccuggaccgcaaagaguuugaggaauacaagcggagcggaauucuugagguugacagaacagaagcuaaaucugcccugaaggauggcagcaaaaucaaguacgccgugucccgcgggaccucuaagauccgguggauuguggagagaggaauggucaaaccgaagggcaaagugguugaccucggcugcgggcgcggaggcuggagcuauuacauggcuacacugaagaacgugaccgaagucaaaggguauacgaagggaggccccgggcaugaggagccuauccccauggccaccuacggauggaaucuggugaagcuccacuccggcguugauguguucuauaaaccuacagaacaggucgacacccuucugugugauauuggcgagagcuccucuaaccccacaaucgaagaggggcggacccugagagugcucaagaugguggaaccguggcugagcuccaaaccugaguuuugcauuaagguccuuaaucccuacaugcccacaguuaucgaggaacuggagaaacuccagcgcaagcacggaggcucucuggugcgguguccucugagcagaaacuccacccaugaaauguauugggugucuggggucagccgcaauauuguguccagcguuaacacgacaucuaaaaugcuccuuaauagauucaccacccgguaccgcaagcccacauacgagaaggacgcggaucugggagccggcacgagauccgugagcaccgagacagaaaaaccugacauggcuaucaucgggcggagacugcaacggcuccaggaggaacacaaggagaccuggcauuaugaucaggaaaacccguaccgcacaugggccuaucacggaucuuacgaggcucccuccaccggcagcgccucuuccauggucaauggcgugguuaaacugcuuacaaagccuugggacgugguccccauggugacccagcuggcgaugacggauaccacaccuuuugggcaacagagaguuuucaaagagaagguggacacccggacaccccagccgaagccuggaacccgcaugauuaugacgacaaccgccaacuggcucugggcucugcugggcaaaaagaaaaaucccagacucugcacacgggaagaguuuaucagcaagguccgcuccaacgccgcuauuggggccgugagccaggaagagcaaggauggaccucugcuagcgaagccgucaaugacuccagauucugggagcugguggauaaagagcgggcgcuucaccaggaaggcaagugugagucuugcguuuauaacaugauggggaagcgcgaaaaaaagcugggcgaguuuggaagagccaaaggcagccgggcuaucugguacauguggcucggggcccgcuuccuggaauucgaggcucuuggauuucugaacgaggaccauugguucggcagagaaaauuccuggucugggguggagggagaaggccuccaccggcugggguauauucuggaggauaucgacaagaaagauggcgaccucaucuacgccgaugacacggccggaugggauacccgcauuacagaggacgaucugcuuaacgaagagcugaucaccgaacagauggcgccucaucacaagauucucgcuaaggccaucuuuaaacugacauaccaaaauaaggucgugaaagugcuuagacccaccccuaagggcgccguuauggacauuaucagccggaaagaucagagaggguccggacaggugggcacauaugggcugaacaccuucacgaauauggagguccagcucauccgccaaauggaagcugagggagugauuacacgggacgacaugcauaaccccaagggccugaaagagagaguugaaaaguggcugaaggagugcgggguggaucgccucaaacggauggccaucucuggcgacgauugugucgugaagccgcuggacgaaagauuuagcaccucccuucuguuccucaaugauaugggaaaaguccgcaaggacauuccucagugggagcccagcaaaggcuggaagaacuggcaggaagugcccuuuugcucucaccacuuccauaagaucuuuaugaaagaugggcggucccugguugugccuuguagaaaucaggacgagcuuauuggacgcgcucggaucagccaaggcgccggguggucucugagagagaccgcgugccucggaaaggccuacgcucagauguggucccugauguauuuccaccgccgggaucugagacucgccagcauggcuaucuguuccgccgucccgacagaaugguuucccaccucucggacaacguggagcauucaugcgcaccaccaguggaugaccacagaggacaugcugaaaguguggaacagaguuuggaucgaagauaauccuaacaugaccgacaagacacccgugcauuccugggaggacauuccuuaccuuggcaaacgcgaagaucuguggugcgggagccucaucggccugucuucccgggccaccugggcuaagaauauucacacggccaucacccaggucagaaaccuuauuggaaucgaggaguauguggacuacaugcccgugaugaagcgcuauagcgcuccuuucgaaucugagggcguucuguga

SEQ ID NO: 20967 - RNA, 9867 nt, Artificial Sequence
  derived and/or modified CDS sequence (opt5) from DENV-4__JQ922558__SS-prME
agcacccugacacuccugugccuuauccccacggugauggccuuccaccuguccaccagagacggcgagccucucaugauugucgcuaagcaugaacgggggcgcccgcugcuuuuuaaaacaaccgagggaaucaacaaguguacacugauugccauggaucucggcgaaaugugcgaggacaccguuacauacaaauguccccugcuggugaauaccgaaccugaggauaucgacugcugguguaaccucacgucuaccugggugauguaugggacaugcacccagagcggagagagacggcgcgaaaagagauccgucgcgcugacaccccacucuggcauggggcuugagacccgggcugaaacguggaugagcuccgagggagccuggaaacaugcccaacgcguggagucuuggauucugagaaauccuggcuucgcucuccuggccggcuuuauggcuuacaugaucgggcagacaggaauccagcggaccguuuucuuugugcuuaugaugcuggucgcccccagcuauggcaugcgcuguguggggguuggaaacagagauuucguggaaggcgucuccgggggagcguggguggaccucgugcuggagcacggcggcugcgucacaaccauggcccaggggaagccuacccuggauuuugaacucauuaagacaacggcuaaagagguugcccugcuucggaccuacuguaucgaagcuagcauuucuaauaucacaaccgccacacgcugcccgacccaaggagagcccuaucugaaggaggaacaggaccagcaguacauuuguagacgggaugugguggaccgcggcugggggaacggaugcggccucuucgggaaaggaggcgucgugacgugcgcgaaguuucugugucuuggcaaaaucacagggaaucugguucaaauugagaaccucgaauauaccguggucgugaccguucauaauggagauacacacgccgugggcaacgacaucuccaaucacggggucaccgcuacaaucacgccuagaagccccucuguggaggucaagcugccugauuacggagaacugacccucgacugcgagccccgguccggcauugacuucaacgagaugauccugaugaagaugaaaaagaaaacauggcuugugcauaagcaguggguucuggaucucccgcugccuugggccgcuggggccgacaccagcaaagugcaguggaauuacaaggaaagaauggucacauuuaaagugccccacgccaagcgccaggauguuaccgugcuuggcucucaagagggagcuaugcauuccgcgcugacgggcgccaccgaagucgacagcggggauggaaaccacauguucgcuggccaccucaaguguaaagugcggauggagaagcugagaauuaaagggauguccuauacaaugugcucuggaaaguuuagcaucgacaaagaaauggccgagacccagcauggcacaaccgugguuaaggucaaguacgagggggccggcgcuccuuguaaagugcccauugaaauccgcgaugugaauaaggagaaagucgugggacggaucauuuccagcacgcccuucgccgaacacacaaacucuguuaccaacaucgagcuggagccuccguucggcgacuccuauauugugaucggggucggagauagcgcgcucacacugcauugguuuagaaagggcucuagcauugggaaaauguucgaauccaccuaccgcggagcuaagcggauggccauccuuggcgagaccgccugggacuuugggucugugggcggacuguucacaagccucggcaaggcuguucaccagguguuuggguccgucuauacgaccauguucggaggcgugagcuggaugguuagaauccugauugggcugcuugugcucuggaucggaacaaauucucgcaacaccuccauggccaugacaugcauugcuaucggcgggauuacccuguuucugggcuucacgguccaugccgauaugggaugugcggugagcuggucuggcaaagaacucaagugcggguccggaaucuuuguggucgacaauguucacacauggaccgagcaauacaaauuccagcccgaaagcccugcccggcuggcuuccgccauucuuaacgcucacaaggacggcgugugugggaucagaucuaccacacgccuggagaaugugauguggaaacagaucaccaacgagcucaauuauguccugugggaaggaggccaugaucugacagugguugccggcgacgugaaggggguccuuacgaagggaaaacgggcgcucacccccccugugaacgaucugaaguacagcuggaaaacauggggcaaggccaaaauuuuuacccccgaggcuagaaauuccacauuccugaucgacgggccggauaccucugaaugcccuaacgagcggcgcgccuggaauuuucucgaaguugaggacuacggauucggcauguucacgaccaacauuuggaugaaguuuagagaggggagcuccgaagugugugaucaccggcugaugagcgcugccaucaaagaccagaaggccguccaugcugauaugggauauuggauugagucuuccaagaaucaacccuggcagaucggcaacgcgagccuuaucgaagugaaaacaugccuguggccuaagacccacacacucuggucuaauggcguucuggagucccagaugcugauucccaaagccuacgcugggccuuucagccagcacaacuauagacaaggauacgccacccagacaaucggccccuggcaucuugggaagcucgaaauugacuuuggagagugcccgggcaccacggugacaauccaggaggauuguaaccaccgcgggccuucucugcggaccaccacagccagcggaaaacuggucacccaguggugcuguagauccugcacgaugcccccccuccgcuuccugggcgaagacggcuguugguaugggauggagauuagaccucuuagcgaaaaggaggagaauauggugaagucucaaguguccgcuggacagggcacaagcgaaaccuuuuccauggggcugcucugccugacacuguucgucgaggaaugucuucggcgcagaguuacccggaaacauaugauccucgugguggucacaacccugugcgccaucauucugggaggccucacguggauggaucugcuucgcgcgcugaucaugcucggggacaccaugucuggaagaaugggcggccagauucaccugacaaucauggcuguguuuaagaugagcccgggguacguucugggaguguuccuucggaaacugaccucccgcgagacagcccucauugucaucggcauggccaugaccacggugcugucuaucccccaugaccucauggaauuuauugaugggaucagccugggacuuauucugcucaagaugguugcucacuucgacaacacacaggugggcacccuggcccugucccuuacauuuaucagaucuaccaugccucuggucauggcguggcggaccauuauggcugugcucuucgucgugacacugaucccccucugucgcacgagcugccugcaaaaacagucccacuggguugagauuaccgcccuuauccugggggcccaggcucucccuguguaucugaugacacugaugaagggagccagcaagagaucuuggccccuuaaugagggcaucauggcugucggccuggugucccuccuggggagcgcccuccugaaaaacgauguuccucuugcgggacccaugguggccggcgggcugcugcucgcugccuacgucaugucuggauccagcgcugaccugucucuugaaaaggccgccaaugugcauugggaugagauggcugacauuaccggcuccagcccgaucauugaagugaaacaagaugaggacggguccuuuagcauccgggauguugaagagacaaacaugauuacccugcucgucaagcuggcgcucaucacggugucuggacuguacccucuugccauccccgugacaaugacccugugguauauguggcaggucaaaacccagagaagcggcgcucugugggacgugccuucccccgccgccgcucagaaggccacacucaccgagggcguuuaccgcauuaugcaacgggggcuguucggaaagacacaggugggcgucgggauccacauggaaggaguguuccauacgauguggcacguuaccagaggcucugugauuugucaugagacagggcgccuugaaccgagcugggcggauguccggaaugacaugaucuccuauggaggcggcuggagacugggggauaaaugggacaaggaggaagacgugcagguucucgcuauugagccuggaaaaaaccccaagcacgugcagaccaaaccuggccuguuuaagacacucaccggggagaucggagccgucacgcuggauuucaaacccggcaccucugggagccccaucauuaauaagaagggcaaagugaucggacuuuacggcaacgggguggucacaaaguccggagacuauguuucugccauuacccaagcugaacgcaucggcgauccugacuacgagguggaugaagacauuuuucggaaaaagagacugacaaucauggaucugcacccgggggccggaaaaaccaagcgcauucuccccagcaucgugcgggaggcgcugaagagacggcuucgcacacugauccucgcuccuacgagagucguggccgccgagauggaagaggcucugcggggccuccccauucgcuaucagaccccugccguuaaauccgaacauacagggagagagaucguggaccugaugugccacgcuaccuucaccgccaauccccuuagcucuacacgggucccuaacuacaaucugauugugauggaugaagcgcaucugcaggaccucuccaucguugccgcuagaggcuacauuagcacgcgcguggagaugggagaggccgcugccaucuuuaugaccgccacaccgcccggcgcuaccgauccuuucccccagucuaacuccccuaucgaagacauugagcgggaaauccccgagagaagcuggaauacaggguuugacuggauuaccgauuaucaaggaaagacggucugguucgugccguccaucaaagcgggcaacgacauugccaacugccugcgcaagucugggaaaaaggucauccagcuuagccggaagacauuugauaccgaauacccuaaaaccaagcugacagacugggauuucgugguuaccacagacaucuccgagaugggagcuaauuuuagagcccgccgggugauugaucccagacgcugucucaaacccgugauccugaccgacggcccugagagagucauucuggccgggcccaucccuguuacgccggcuagcgccgcgcagcggcgcggcagaauuggacggaaccccgcucaagaagaugaccaguauguguucucuggcgauccucucaagaaugacgaggaucacgcccacuggacagaagccaaaaugcuucuggacaacaucuacacccccgaggggauuaucccuacacuguucggacccgaacgcgagaagauccaggcuauugacggcgaguuuagacuccggggggaacagagaaagaccuucguggagcugaugcgccggggagaucuuccggucuggcuguccuauaaaguggccagcgcgggcaucucuuacaaggacagagaauggugcuuuacgggcgagcgcaauaaccaaauucucgaggaaaauauggagguugaaaucuggacccgggagggggaaaaaaagaaacugagaccuaaguggcuggaugcccggguguaugcugaccccauggcccucaaggauuucaaagaguuugcuagcggacgcaaguccauuacacuugacauccugaccgagaucgccucucugccuacauaccucagcuccagagcuaaacuggcccuugauaacauugucaugcugcauaccacagaacggggcgggcgcgcguaccagcacgcccucaaugagcugcccgaaucucuggagacccucaugcuuguggcucugcugggagccaugacggcuggcaucuuccucuuuuucaugcaggggaagggaauuggcaaacugagcaugggccuuauggccaucgccgucgcuuccgggcugcucuggguggcggaaauucagccucaauggaucgccgcuagcaucauucuggaguuuuucucuauggcccugcucauccccgagccggaaaagcagagaacaccucaggacaaccagcuuauuuauguuauccugaccauucugaccaucauuggacucaucgccgcuaaugagaugggccugaucgaaaaaacaaagaccgauuuuggguucuaccaagugaagacagagacgaccauucuugacgucgaucugcggcccgccuccgcguggacacucuaugccguggcuaccacaauccugacccccaugcugcgccauacgauugaaaacaccagcgccaaucucucccuugcugccaucgcgaaccaggccgcuguucugaugggacugggcaaaggguggccucuccacagaauggaccugggagugccgcuucuggccaugggcuguuacucucaggucaaucccacaacccucacagcuagccuggugaugcuguccgugcauuaugccauuaucggcccugggcuccaggcuaaggccacccgggaggcgcaaaaacgcucugccgcuggaaucaugaagaaccccacgguugauggcauuacagucaucgaccuugagccuauuagcuacgaccccaaauuugaaaagcagcuggggcaggugaugcugcucgcccugugcgcuggacaacuucugcucaugagaaccacaugggccuucugugaggugcugacccuggccaccggcccuauccucacacuuugggaagggaacccgggacgguucuggaauacgaccauucccgucuccacagcgaacaucuuuagaggcagcuaucuggcuggcgccgggcuggcuuucucucucaucaagaaugcccagaccccucgccggggaacaggcaccacgggggagacacugggagagaaauggaagagacagcuuaacucccuggaucgcaaagaauuugaggaauacaagcggagcggcauuuucgagguugacagacacgaaaucaaauacacccucaaggaugggucuaagauuaaucacgccauguccaccggaagcaucaaaauucgcggcaucgacgagcggggcauggugaagcccaaagggaagguggucgaucagggaugcggcagagggggauggucucauuauacagcuaccgccaaaaaggugacagagguuaagggcuacacgaaagggggaccuggccacgaagagcccauuccgauggcgaccuauggcuggaaccuggugaagcugcauagcggggucgacguguuuuacaaaccuacagaacaaguugauacccuccuuugugacaucggagaguccucuagcaaucccacaaucgaagagggccgcacccugcgggugcugaagauggucgagcccuggcucuccagcaaaccugaauucugcauuaaggugcugaaccccuauaugccuacggugaucgaggaacuugagaaacugcagagaaagcacgggggaucccucguccgcuguccgcugucucggaauagcacccacgaaauguacuggguuuccggcgugucugggaacauugugagcuccgucaauacaaccucuaagaugcugcucaacagauuuacaacccgccauagaaaacccacauaugagaaggauguggaccuuggagccggcacccggagcguuuccaucgagacggaaaaaccugauaugacaauuaucggccgcagacugcagcggcugagagaggaacacaaggagaccuggcauuacgaccaggagaaucccuaccggaccugggcuuaucacgggagcuacgaagccccuucuacaggauccgcuagcucuauggugaacggcgucgugaaacuccugacgaagcccugggacguuaucccgauggugacccaacuugccaugacagauaccacaccuuucgggcagcagcgcgaguuuaaggaaaaagucuauaccuccacaccccauccuaagcccuggaccagaauggugaugacgaccacagcgaauuggcugugggcccucggaggcaaaaagaaaagcccucggcugugcaccugggaggaauucauuucuaagguucgcuccaacgcugccaucggggcuguguuucaggaggagcaaggcuggacaagcgccuccgaagcugucaaugacagcagauucugggagcugguggauaaggaacgggcccuccaccaggagggaaaaugugaaucuugcgucuacaacaugaugggcaagcgcgagaaaaagcugggggaguuuggaagagcgaaaggcagccgggccauuugguauauguggcuuggggcucgcuuccuggaauucgaggcccucggauuucugaacgaagaccacugguucggcagagagaauuccuggucugggguggaaggcgagggacuucaucggcugggcuacauccucgaggauauugacaagaaggauggggaccugaucuaugcugaugacaccgccggaugggauacgcgcaucacagaagacgaucugcucaacgaggaacugauuaccgagcagauggccccccaccauagaauccuugcgaaagcuauuuuuaagcugacauaccacagcaaaguuaugaaggugcuccggccgaccccuaaaggcgccgucauggacaucauuucccgcaaggaccaaagagggucuggacaggugggcacguacgggcugaauaccuucacaaacauggaggugcagcuuauccggcagauggaagccgagggcguuaucacccaagaugacaugcagaaucccaaaggacugaaggaaagaguggagaaguggcucaaagaaugcggcgucgaucgccugaagcggauggcuauuagcggggacgauugugugguuaaaccccuggacgagagauuuuccacaucucuccuguuccuuaacgauaugggaaaggugcgcaaagacaucccucagugggagccgagcaagggcuggaagaauuggcaggaaguccccuuuugcucccaccauuuccacaaaauuuuuaugaaggaugggcggagccugguggucccuuguagaaaccaagacgagcucaucggacgcgcccggauuucucagggcgcuggguggucccugagagaaaccgccugccuuggcaaagcguaugcccagauguggagccugauguacuuccaucgccgggaucucagacuggcuucuauggccaucuguuccgcugugcccacagagugguuuccuaccagccgcacgacaugguccauucacgcccaucaccaguggaugaccaccgaagacaugcugaagguuuggaaucggguguggaucgaggacaaccccaauaugacagauaaaaccccuguccacucuugggaggacgugcccuaucucggaaagagagaagaucuguggugcggcagccuuaucgggcuguccagccgggcgacaugggccaagaacauucauacggcuaucacccaaguuagaaaucucauuggaaaagaggaauacguggacuauaugccggucaugaagcgcuacucugccccuaucgaguccgaaggcgugcuguga

SEQ ID NO: 20968 - RNA, 9867 nt, Artificial Sequence
  derived and/or modified CDS sequence (opt5) from DENV-4__JQ922559__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucugcgugggugauguaugggaccugcacacagagcggagagagacggcgcgaaaagagauccgucgcucucaccccccacucuggcauggggcuggagacacgggccgaaaccuggaugagcuccgagggagccuggaaacaugcucaacgcguggagucuuggauccuuagaaauccuggcuucgcccugcucgcuggcuuuauggccuacaugaucgggcagacgggaauucagcggacaguuuucuuuauccugaugaugcuuguggcgcccagcuauggcaugcgcugugucggggugggaaacagagauuucguugaaggcguguccgggggagccugggucgaccuggugcucgagcacggcggcugcgugaccacaauggcucaggggaagccuacccuggauuuugaacugauuaagaccacagccaaagaggucgcucuccugcggacguacuguaucgaagccagcauuucuaauaucaccacagcgacccgcugcccgacacaaggagagcccuaucuuaaggaggaacaggaccagcaguacauuuguagacgggauguuguggaccgcggcugggggaacggaugcggccuguucgggaaaggaggcguggucaccugcgccaaguuucucuguuccggcaaaaucacggggaaucuggugcaaaucgagaaccuugaauauacaguuguggucaccgugcauaauggagauacccacgcuguuggcaacgacauuagcauccacggggugacagccaccauuacaccuagaucucccuccgucgaggugaagcugccugauuacggagaacucacgcuggacugcgagccccggagcggcaucgacuucaaugagaugauucugaugaagaugaaaaagaaaaccuggcucguccauaagcagugguuucuggaucuuccgcugccuuggacagcuggggccgacaccucugaagugcaguggaacuacaaagagagaaugguuacauucaaggugccccacgccaaacgccaggaugucaccgugcucggcucccaagaaggagcuaugcauagcgcgcugacgggcgccaccgagguugacuccggggauggaaaucacauguuugcuggccaccuuaaguguaaggugcggauggaaaaacugagaaucaaggggaugucuuauacaaugugcagcggaaaauucuccaucgacaaggagauggccgagacccagcauggcacaaccgucgugaaagugaaguacgaaggggccggcgcuccuuguaagguucccauugagauccgcgaugucaacaaagaaaagguggugggacggauuaucagcucuacgcccuucgccgagaauacauauuccgucaccaacauugagcucgaaccuccguuuggcgacagcuacaucaucauuggggugggagauucugcgcugacacugcacugguucagaaaaggcagcuccaucgggaagauguuugagucuaccuaucgcggagcuaaacggauggccauucucggcgaaaccgccugggacuucgggagcguuggcggacugcuuacaucccugggcaaggcugugcaucaggucuuugggagcguguacacgaccauguucggaggcguuucuuggauggugagaauccucauugggcugcugguccuuuggaucggaacaaacucccgcaauaccagcauggccaugucuugcauugcugugggcgggaucacacucuuucugggcuucaccguucacgccgauaugggaugugcgguguccuggagcggcaaggagcugaaaugcggguccggaaucuuugucauugacaacgugcauacguggacagaacaauauaaguuccagcccgagucuccugcccggcucgcuagcgccauccugaaugcucacaaagacggcgugugugggauuagauccaccacccgccuugagaacgucauguggaagcagaucacaaaugaacugaacuacguucucugggagggaggccacgaucugaccauuguggccggcgacgugaaagggguccugucuaagggaaagcgggcgcuugcccccccugugaaugaucucaaauacagcuggaagacauggggcaaagcuaagaucuuuacgcccgaaaccagaaacuccacauuccugaucgacgggccggauaccagcgagugcccuaaugaacggcgcgccuggaacuuucuggagguugaggacuauggauucggcauguucacaaccaauauuuggaugaaauuuagagaagggucuuccgaggugugugaucaucggcucaugagcgcugccaucaaggaccagaaagccguccacgcugauaugggauacuggauugaaucuuccaagaaccaaacguggcagaucgagaaggcgagccugauugaagugaaaaccugccuuuggcccaagacacauacccuguggucuaauggcguucucgagagccagaugcugaucccuaaagccuaugcuggccccuucucccagcacaacuacagacaaggguaugccacacagaccgugggaccuuggcaccugggcaagcuugagaucgacuuuggggaaugccccggaacaaccgucacgauucaggaggauugugaccaucgcggcccgagccuccggacaaccaccgccucugggaaacuggugacacaguggugcuguagauccugcaccaugccuccccugcgcuuccucggagaagauggcuguugguacggcauggagaucagaccccugagcgagcgggaagagaauaugguuaagucccaagugucugcugggcagggaacgagcgaaacauuuuccaugggccuucugugccucacccuguucgucgaggaaugucugcgcagacgggugacacgcaagcacaugauucuuguggucguuaccacacucugcgccaucauucuggggggacugaccuggauggaccuccugagagcgcuuaucaugcugggcgacacgaugucuagccggauggggggacagauccaucucgcuauuauggccguguuuaaaauguccccuggcuaugugcugggcaucuuccugcgcaagcuuaccucuagagagacagcccugauggucauugggauggcuaugaccacagugcucagcaucccgcacgaucugauggaguuuauugacggaaucucccucggccugauucuucugaaaaugguuacccauuucgauaacacgcagauggggacacucgcccugagccugaccuuuaucaagucuacaaugccccuugugauggcguggcggaccaucauggcuguccuguucgugguuacccucauuccucugugucgcacauccugccuccaaaaacagagccacuggguggaaaucacggcccugauucuuggagcccaggcucugcccgucuaccucaugacccugaugaagggcgccucuaagagauccuggccucugaacgaggggaucauggcugugggacuugucagccugcucggcucugcccugcucaaaaaugacgugccccuggcgggcccuaugguugccgggggacuucugcuggcugccuacgugauguccggcagcuccgcugaucucagccuggaaaaggccgccaacguccaaugggacgagauggcugauauuacagggucuagccccaucaucgaagugaaacaggacgaggauggauccuuuucuauucgggacguugaggaaaccaauaugaucacacuucuggugaagcucgcgcugauuaccgucagcggccucuauccgcuggccaucccugugacgaugacacuuugguacauguggcaggugaaaacccagagauccggggcucugugggauguucccucuccugccgccgcucaaaaggccacccugacagagggagucuaucgcauuaugcagcggggccucuucggcaagacccaggugggggugggaauccacauggaaggcgucuuccauacaauguggcacgugacgagagggagcguuaucugucaugaguccggacgccuggaacccucuugggcggacgugcggaacgauaugauuagcuacggcgggggauggagacuuggcgacaaaugggacaaggaggaggauguccaggugcuggcuaucgaaccgggcaaaaauccuaagcacguucaaaccaaacccgggcucuuuaagacacugaccggagagauuggcgccgugacacucgacuucaaaccugggaccuccggaagccccaucauuaaccgcaagggcaaggucaucgggcuguauggcaauggagugguuacgaaaucuggcgauuacguguccgccauuacccaggcugaacggaucggggagcccgacuaugaggucgaugaagacaucuuuagaaagaaacgccuuacaauuauggaucugcauccuggagccggcaagaccaaacggauccugccgagcauugugagagaggcgcucaagcggcgccugagaacacuuauccuggcucccacccggguggucgccgccgaaauggaggaagcucuccgcgggcugccuauuagauaccagacacccgccguucucucugagcacacgggacgggagaucguggaccugaugugccacgcuaccuucacaaccagacuucuguccagcacccgcgugccuaacuacaaucugaucgucauggaugaagcccauuuuacagaccccuccucuguggcggcccggggcuauauuagcacgagaguugagaugggggaagcugccgcuaucuucaugaccgccacaccuccgggcaccacagaucccuuuccucaguccaacagccccauugaggacaucgaacgcgagauuccugagcggucuuggaauaccggauucgacuggaucacggauuaccaaggcaagacagugugguuuguccccuccaucaaagccgggaacgacauugcuaauugccucagaaagagcggaaaaaaggugauccagcugucucgcaaaaccuucgauaccgaauauccgaagacaaagcuuaccgacugggauuuuguugugacaaccgacauuagcgucaugggcgcgaacuuccgggccgggagagugaucgauccucgcagaugucugaaacccgucauuaucacggacggacccgagcgggugauucucgcuggcccuauccccguuacaccugccuccgccgcucagcgcagagggcggaucggccgcaauccggcccaagaagaugaccaguacguguucucuggagauccccugagaaacgacgaggaucacgcgcauuggaccgaagcuaagaugcugcucgacaacauuuauacaccugagggcaucauucccacccuuuuugggccugagcgggaaaaaacgcaggccaucgacggagaguucagacugcgcggcgaacagcggaagaccuuuguggagcugaugagacgcggggaucuccccgucuggcugagcuacaaaguugccuccgcuggaauuucuuauaaggaccgggaguggugcuucacaggcgaaagaaauaaccaaauccuugaggaaaauauggagguggaaaucuggacccgggagggcgagaagaaaaagcugcgcccgaaauggcucgaugccagaguguacgcggacccuauggcccugaaggauuuuaaagaauucgcuagcgggcggaaguccauuacacuggacauccucaccgagauugccagccuucccacauaccugucuucccgcgcuaagcuggcccucgauaacaucgucaugcugcacaccacggaaagaggaggcaaagcuuaucagcacgcccuuaaugagcugccugaaagccucgagacacugaugcugguggcgcuccuuggggccaugaccgcuggaauuuuucuguucuuuaugcagggcaaggggaucggagagcuguccaugggccucaucgccauugcuggcgccucugggcugcuuuggggaaccaaaacacccccucccuggggcgccgcuagcaacauccuggaauucuuucucaugguucugcugauuccggagccugaaaagcagcggaccccccaagacaaucagcucaucuacgugauucuuacaauccugacgauuaucgggcuggucgcggccaacgagaugggacucaucgaaaaaaccaagacagauuucggcuuuuaucaggugaaaaccgagacaaccauucuggacgucgaucuucgccccgcuuccgccuggacgcuguacgccguggcuaccacaauccucaccccuaugcugagacauacaauugagaauaccucugccaaccugagccucgcggccaucgcuaaucaggccgcuguucuuauggggcugggaaagggcuggccgcugcaccggauggaccucggcgugccccugcuugccaugggguguuauucccaagucaacccuacgacacugauugcgagccucgugaugcugcugguucauuacgccaucaucggacccggccuccaggcuaaggccacccgcgaagcucagaaaagaacagccgcugggauuaugaagaauccuaccguggauggaaucaccgucauugaccuugagcccaucucuuaugacccuaaauucgaaaagcagcugggccaagugaugcugcucgugcugugcgccgggcagcuucugcucaugcggacaacgugggcguucugugagguucugacccuggccacaggaccgauucucacccuuugggagggcaaccccggcagauuuuggaauacaaccaucgcugucuccacggccaacaucuuccgcgggagcuaccuggcuggagccggccuggccuuuucucucauuaaaaacgcgcagacaccucggagagggaccggagugaccggcgaaacacugggggagaaguggaagcgccaacuuaauucccuggaucggaaagaauucgaggaauacaagagaagcggaauccucgagguggaccgcaccgaggcuaaaucugcccugaaggauggcagcaaaauuaagcaggcugucucccggggcacaucuaagaucagauggauuguugaacgcgggauggugaaacccaagggaaaaguggucgaccugggcugcgggcggggaggcuggagcuauuacauggccacgcucaagaacgugaccgagguuaaaggguauacaaagggaggcccuggccacgaagagcccaucccgauggccaccuacggguggaaucuugugaagcugcauuccagagucgauguguuuuauaaaccuacagaacagguugacacccugcucugugauauuggagagagcuccucuaaccccacgaucgaggaaggccgcacccugcgggugcuuaagauggucgagcccuggcugagcuccaaaccugaauucugcaucaaggugcucaaucccuacaugccuacagugauugaggaacuggagaaacugcagagaaagcacgggggaucucucguccgcuguccgcuuagcagaaacuccacccacgagauguauuggguuucuggcgugagcgggaauaucguguccagcgucaacacaaccucuaaaaugcugcugaaucgguuuacaaccaagcaucgcaagcccacguacgaaaaagacgcugaucucggagccggcacaagauccgugagcaccgagaccgaaaagccugacaugacaauuaucggccggagacugcaacggcuucaggaggagcaccaggaaacguggcauuacgaucaggagaaccccuaucgcaccugggcguaccacgggggauaugaagccccuucuacaggcuccgcuagcucuaugguuaaugggguggucaaacugcucaccaagcccugggacgugauuccgaugguuacacaacuggccaugaccgacacaaccccuuucggacagcagagaguguuuaaagagaaggucgauacgcggaccccccagccuaagcccggcacacgcauggugaugaccacaaccgcuaacuggcugugggcccuccuggggaaaaagaaaaauccuagacuuugcacgcgggaagaguucaucuccaagguucgcagcaacgcggccaucggcgcugugucccaagaggaacagggauggacaagcucuuuugaggccgucaaugacagcagauucugggaacugguggauaaagagcgggcucuccaccaggaaggcaagugugaguccugcgucuacaacaugauggggaagcgcgagaaaaagcugggagaauuuggcagagccaaagggucucgggcuauuugguauauguggcuuggagcccgcuuccuggaguucgaagcgcucggcuuucugaaugaggaccauugguucgggagagaaaacagcugguccggcguggagggagagggccugcaccggcucggguacauccuggaagaucuugacaagcgcgauagaucucugguuuuugccgacgauaccgcuggaugggacacaaaaauucccgaggaugaccuccugaaggaaaagccgaucccuggccccauggccccccaucaacggauuccugcuagagccaucuucaaacuuaccuaucagaacaagguggucaaagugcugcgccucaagcugaaaggggccgugauggauaucauuagccggaaggagcagagaggauccggccagguugggacguacggccugaauaccuuuacaaacauggaggugcaacucauccgccagauggaagcggagggagucauuacccgggacgacaugcacaauccgaaaggccugaaggaaagaguggagaaguggcuuaaagaaugcgggguugaucgccuggagcggauggcuaucucuggagacgauuguguggucaagccccucgacgagagauucagcacaucccugcuuuuucugaacgauaugggcaaagugcgcaaggacauuccucagugggaacccagcaaaggguggaagaauuggcaggaggucccuuucugcucucaucacuuucacaagaucuucaugaaagauggacggucccucgugguucccuguagaaaccaagacgaacugaucggccgcgcccggauuagccagggggccggcuggucucugagagagaccgcuugccucggaaaggccuacgcucagauguggucccugauguauuuucaucggagagaucuucgccuggccagcauggcgaucuguuccgccgugccuacagaaugguuccccaccucucggacgacauggagcauucacgcucaucaccaguggaugaccaccgaggacaugcucaaagucuggaauagaguguggaucgaggauaacccgaauaugacagacaagaccccuguucacuccugggaagacauucccuaccugggcaaacgcgaggaucuuuggugcgggagccugaucggacucucuuccagagccacaugggcuaagaacauucauacggccaucacccaagugcggaaucugaucggcauugaaggguaugucgacuacuuucugcucaucaagugguauagcgcgccuuucgagucugaaggagugcuguga

SEQ ID NO: 20969 - RNA, 9867 nt, Artificial Sequence
  derived and/or modified CDS sequence (opt5) from DENV-4__KF955510__SS-prME
agcaccaucacccugcucugccugauucccacggugauggccuuccaccuuuccacccgggacggagaaccucugaugaucgucgcuaagcacgaacgggggcgcccgcuccuguuuaagacgaccgagggaauuaacaaguguacacuuaucgccauggaucugggcgaaaugugcgaggacaccguuacauacaaguguccccuccuggugaauaccgaaccugaggauauugacugcugguguaaccugacgucugcgugggugauguaugggaccugcacacagagcggagagagacggcgcgaaaagagauccgucgcucucacaccccacucuggcauggggcuggagacacggaccgaaacguggaugagcuccgagggagccuggaaacaugcccaacgcguggagucuuggauccuuagaaagccuggcuucgcucugagcgccggcuuuauggcuuacaugaucgggcagacaggcauucagcggaccguuuucuuuauccucaugaugcugguggcccccuccuauggcaugcgcugugucggggugggaaauagagauuucguugaaggcgugagcgggggagccugggucgaccuugugcuggagcacggcggcugcgugacaaccauggcccaggggaagccuacccucgauuuugaacugauuaaaacaacggcuaaggaggucgcccugcuccggaccuacuguaucgaggcuucuauuuccaacaucacaaccgccacacgcugcccgacccaaggagagcccuaucugaaagaggaacaggaccagcaguacauuuguagacgggauaugguugaccgcggcugggggaauggaugcggccuuuucgggaagggaggcguggugacgugcgcgaaauuuagcuguucuggcaagaucacagggaaccugguccaaaucgagaaucucgaauauaccgugguugugaccguccauaacggagauacacacgccgugggcaaugacaccuccaaccacggggagacagcuacgauuaccccuagaagccccucuguugaagugcggcugccugauuacggagagcuuacacuggacugcgagcccagauccggcaucgacuucaaugaaaugauucucaugaagaugaaaaccaagacauggcugguccauaaacagugguuucuggaucucccgcugccuuggaccgccggggcugacacgagcgaggugcacuggaaccauaaggaacgcauggucaccuucaaagugccccacgccaagcggcaggauguuacagugcuuggcucccaggagggagccaugcacucugcucuggcgggcgccaccgaagucgacagcggggauggaaaucauauguuugcuggccaccucaaauguaaggugagaauggagaagcugcgcaucaaagggauguccuacacaaugugcagcggaaaguucucuauugacaaagagauggccgaaacccaacauggcacgacaguugugaaggucaaauaugaggggaccggcgccccuuguaaggugcccaucgaaauccgggaugugaacaaggagaaaguugucggaagaauuaucuccagcacacccuucgcugagaauaccaacucugugaccaacauugaacuugagccuccguuuggcgacagcuacaucgugauuggggccggagauuccgcgcugacacuccacugguuccgcaagggcucuagcaucgggaaaauguuugaauccacguaucggggagcuaagagaauggccauccugggcgagaccgccugggacuucgggagcgucggcggacugcucacaucucugggcaaagcugugcaucagguuuuuggguccguguacaccacaauguucggaggcgucagcuggauggugcgcauucuuaucgggcugcucguucuguggauuggaaccaauucucggaacacguccauggccaugagcugcaucguggucggcgggauuacacuguuucuuggcuucaccgugcacgcugauaugggauguguuguguccuggucuggcaaggaacucaagugcgggagcggaaucuuugucauugacaaugugcacaccuggacagagcaguauaaauuccaacccgaguccccugccagacuggcgucugccauccugaacgcucauaaggacggcgugugugggauccgcagcaccacacggcucgaaaaugucauguggaaacagauuacgaacgagcugaauuacguucuuugggaaggaggccacgaucugaccgugguggccggcgacgucaagggggugcucuccaaaggaaagagagcucuggcgcccccuguuaacgaucugaaguauagcuggaaaacauggggcaaggcgaaaaucuuuacccccgagacaagaaauucuaccuuccuuguggacgggccggauacguccgaaugcccuaacgagcgcagagccuggaauuuucucgaggucgaagacuacggauucggcauguucaccacaaacauuuggaugaaguuucgggaggggagcucugaagugugugaucauagacugauguccgcugccaucaaagaccagaaggcuguucacgccgauaugggauacuggauugagagcucuaaaaaucagaccuggcaaaucgaaaaggccagccugaucgaggugaagacaugccucuggcccaaaacccacacacugugguccaacggcguccuugagagccagaugcugauuccuaaggcuuaugcgggccccaucucucagcauaauuaccgccagggguaugccacccaaacggugggaccuuggcaccucggcaaacuggaaauugacuucggggagugccccggaacaaccguuaccauccaggaagauugugaccaucggggcccgucccugagaacaaccacggcuagcgggaaacuugugacacaguggugcugucgcuccugcaccaugccuccccucagauuucugggagaggauggcuguugguacggcauggagauucggccccugaacgaaaaagaggaaaacauggucaagucucaggugagcgccgggcaaggaacauccgagaccuucucuaugggccuccugugccuuacacuguuuguggaagagugucuccgcagacgggucacccgcaagcacaugauccugguuguggugacgacccugugcgccaucauucuugggggacucacauggauggaccugcugagagcucucaucaugcugggcgacaccaugagcgggcggaugggaggccagauucaucuugccaucauggcgauguucaaaauguccccuggcuauguccuggggauuuuucuccgcaagcugacaucuagagagaccgcucugauggugaucggaauggccaugacgacaguucuuagcaucccgcacgaucugauggaguucauugacggcaucucccucgggcugauucuccugaaaauggugacccacuuugauaauacacaggucggaacccuugcccugagccucaccuucaucaagucuacaaugccccuggugauggcuuggcggacgauuauggccguucuguuuguggucacccuuaucccucugugucgcacauccugccuccagaaacaaagccauuggguggagauuaccgcgcugauccucggcgcucaggcccugcccgucuaccuuaugacacugaugaagggggccucuaagagauccuggccucucaacgaaggaaucauggcugugggccugguuagccugcuuggcucugcccugcucaaaaaugacgugccccuggcugggccuauggucgccggaggccuccugcuugcggccuaugugauguccgggagcuccgcugaucugagccuggagaaggccgcuaacguucagugggacgaaauggccgauauuaccggaucuagccccaucauugaggugaaacaagacgaggauggcuccuucucuauccgggacgucgaagagacgaauaugauuacacuccuggugaaacuugcccugaucaccgugagcgggcucuacccgcuggcuaucccuguuaccaugacacucugguacauguggcaggucaaaacccagagauccggagcgcugugggaugugcccucuccugccgcugcccagaaggccacacuuacggaaggcgcuuaucgcauuaugcaacggggccuguuugggaagacccaggugggagucggcauccacauggaggggguguuccauacaauguggcacguuaccagaggaagcgugauuugucaugaauccggccgccuggagcccucuugggccgacguccggaacgauaugaucagcuacgggggaggcuggagacucggcgacaaaugggacaaggaggaagaugugcagguucuggcgauugagccggggaaaaauccuaagcacgugcagacaaaacccggacuuuucaagacccugacgggcgaaaucggggcugucacccucgacuuuaaaccuggaacauccggcagccccaucauuaaccgcaaggggaaggugaucggccuguauggaaauggcguugugaccaaaucuggggauuacgucuccgccauuacacaagccgagcggaucggagagcccgacuaugaaguggaugaggacauuuucagaaagaaacgccucaccaucauggaucugcacccuggcgcugggaagacaaaacggauucuuccgagcaucgugagagaagcccugaagcggcgccugagaacgcucauccuggcgcccacccgggucguugcugccgagauggaagaggcccuucgcggacugccuauuagauaccagacacccgcugugaagucugagcauaccggccgggaaaucguggaccucaugugccacgccaccuuuacaacgagacugcucuccagcacccgcgucccuaacuauaaucugauugugauggaugaggcucauuucacagaccccuccucuguugccgcgcggggguacaucagcaccagaguggaaaugggcgaggccgcugccauuuuuaugacagcuaccccuccgggaacgacagaucccuucccucaguccaacagccccaucgaagacaucgagcgcgagauuccugaacggucuuggaauaccggcuuugacuggaucaccgauuaccaggggaaaacagucugguucgugcccuccauuaaggccggaaacgacaucgccaauugccuuagaaaaagcggcaagaaaguuauucaacugucucgcaagaccuuugauacagaguauccgaagaccaaacugacggacugggauuucguggucacaaccgacaucagcgaaaugggggcuaacuuucgggcgggaagagugaucgauccucgcagaugucucaagcccgucauucugacagacggccccgagcgggugauccuugccgggccuauucccguuaccccugcuuccgccgcccagcgcagaggccggaucggacgcaacccggcucaggaagaugaccaauacguguucucuggcgauccccugagaaaugacgaggaucacgcccacuggacggaggcgaaaaugcuccuggacaacauuuauaccccugaagggaucauucccacacuguucggaccugagcgggaaaagacccaggcuaucgacggcgaguuuagacuccgcggggagcagcggaaaacauucguggaacuuaugagacgcggagaucugcccgucuggcugagcuacaagguugccuccgccggcaucucuuauaaggaccgggaguggugcuuuaccggcgaaagaaauaaccagauucucgaggaaaauauggagguggagaucuggacacgggaaggggagaaaaagaaacugcgcccgaaguggcuugaugcuagaguguacgccgacccuauggcgcugaaagauuucaaggaauuugccagcggacggaaguccauuacccucgacauccugacggagauugcuagccugcccacauaucucucuucccgcgccaaacuugcucuggauaacaucgucaugcugcauaccaccgaaagaggcgggaaggccuaccaacacgcucucaaugagcugccugagagccuugaaacacugaugcucguggcccugcugggagcgaugaccgccggcaucuuccucuuuuucaugcaggggaaaggaaugggcaaacuuuccaugggccugauugcuaucgccguugcuucugggcugcucuggguggccgagauucagccccaguggaucgccgcuagcauuauccuggaauuuuuccuuaugguccugcucgugccugagcccgaaaaacaacggacaccgcaggacaaccagcugaucuacgucauucugacgauccucaccauuaucgcgcuuguggccgcuaaugagaugggacugauugagaagacaaaaaccgauuuuggcuucuaucaggccaagacagaaaccacgauccuggacguugaucuccgcccugccuccgcuuggacccuguacgccguggcgacaaccauucuuacacccaugcugagacauaccaucgagaacacgucugccaaucucagccuggcugccaucgcuaaccaagccgcgguccugauggggcucggaaagggcuggccccuucaccggauggaccugggggugccucugcucgccaugggauguuauucccagguuaauccgacaacccugacagcuagccuugugaugcugcucguccauuacgccauuaucggccccggccugcaggcuaaagccacccgcgaagcucagaagagaaccgccgcggggauuaugaaaaacccuacaguggauggaaucacggugauugaccuggagcccaucucuuaugacccuaaguuugagaaacaacucggccagguuaugcuucugguccugugcgccgggcagcuccugcuuaugcggaccacaugggcuuucugugaagugcugacccucgccacaggacccauccugacccugugggagggcaauccugggagauucuggaacacgacaauugcuguguccaccgccaacaucuuucgcggaagcuaccucgccggcgcgggccuugcuuucucucugauuaagaaugcccaaaccccgcggagagggacaggaaccacaggcgaaacgcugggggagaaguggaaacgccagcucaacucccuggaucggaagggauuugaagaguauaaaagaagcggcauccuugaggucgaccgcaccgaagcuaagucugcccugaaagaugggagcaagauuaaguacgccguuucccggggaacaucuaaaaucagauggaucguggagcgcggcauggugaagcccaaaggcaaggucguggaccucgggugcggacggggcggguggagcuacuauauggcuacccugaaaaauguuacagaagugaagggauacaccaagggcgggccuggacacgaggaacccauuccuauggccacguauggcuggaaccuggucaaacuccacuccggcguggauguuuucuacaagcccaccgaacagguggacacacuucugugugauaucggggagagcuccucuaauccgaccauugaagagggaagaacacugcgcguccucaaaaugguggaaccuuggcugagcuccaagcccgaguuuugcaucaaagugcuuaaccccuauaugccuaccgucauugaagaacuggagaagcuccagcggaaacauggcgggucucugguuagauguccccugagccgcaauuccacacacgaaauguacugggugucuggagugagcggcaacaucgucuccagcgugaauaccacgucuaagaugcuccuuaacagauucacaacccggcaucgcaagccuaccuaugagaaagacgcggaucugggggccggaacaagauccguuagcacggaaaccgagaagccggacaugacaauuaucggccggagacugcaacggcuccaggaggaacacaaagagaccuggcacuacgaucaugaaaaucccuaccgcacaugggcuuaucacggcucuuacgaggccccuuccaccgggagcgcuucuuccauggugaacggagucgugaagcugcuuacaaaacccugggacguugugccuauggucacccagcuggccaugacggacaccacacccuuuggccagcaaagaguguucaaggaaaagguugauacccggacaccgcagccuaaacccgggacccgcguggucaugacgacaaccgcgaauuggcucugggcccugcugggaagaaagaaaaacccucggcucugcacacgcgaggaguuuaucagcaaggugagauccaaugcugccauuggcgcugucuuccaggaagaacagggguggaccagcgccucugaagcugugaacgacagccgguuuugggagcugguugauaaagaacgcgcccuucaucaagagggcaagugugaguccugcguguauaauaugaugggaaagagagagaagaagcugggcgaguucgggcgggcgaaaggaucucgcgccaucugguacauguggcucggcgcuagauuucuggaguucgaggcccuuggguuccugaacgaagaccacugguuuggacgggagaacagcugguccggcgucgagggggaaggccuccaucgccugggauauauucuggaggauaucgacaagaaagauggcgaccucauuuacgcugaugacacggccgggugggauaccagaaucacagaagacgaucugcuuaaugaggagcugaucaccgaacagauggcgccccaucacaagauucucgccaaggcuaucuucaaacugacauaucagaacaagguggugaaaguucuucggccuacccccaagggagccgugauggacauuaucucuagaaaagaccaacgcggcagcgggcaggucggaacauacggccugaauaccuuuacgaacauggaggugcagcucauucggcagauggaagccgaggggguuaucacaagagaugacaugcauaauccgaagggccugaaagaacgcguggagaaguggcugaaggagugcggagucgaucggcucaaaagaauggcuaucuccggcgacgauuguguggucaagccucuggacgaacgcuucucuaccagccuucuguuucucaacgauauggggaaagugcggaaggacauuccccaaugggagcccuccaaaggauggaagaauuggcaggaaguuccuuucugcagccaccauuuucacaagaucuucaugaaagauggcagaucucugguggucccgugucgcaaccaggacgagcuuauugggcgggccagaaucucccagggagcuggcuggagccugcgcgaaaccgccugccucgggaaggcguacgcccaaauguggucucugauguauuuucaccggagagaucugcggcucgcuuccauggccauuuguagcgcugugcccacagagugguucccuaccuccagaacaacguggucuauccaugcccaccaucaguggaugaccacagaggacaugcugaaaguuuggaaucgcguguggaucgaagacaaccccaauaugauugauaagaccccuguccacagcugggaggacauccccuaccuuggcaaacgggaagaucuguggugcggaucccucauuggccugagcucuagagcgacaugggccaagaacauccauaccgcuauuacacaggugcgcaaucuuaucgggaaggaggaauauguggacuacaugccuguuaugaaaagauauuccgcccacuuugagagcgagggaguccuguga

SEQ ID NO: 20970 - RNA, 9867 nt, Artificial Sequence
  derived and/or modified CDS sequence (opt5) from DENV-4__GQ868594__SS-prME
agcaccaugacccugcucugccugauccccacggugauggcuuuccaccuuuccaccagagacggagaaccucugaugauugucgcuaagcaugaacgggggagaccgcuccuguuuaaaacgaccgaaggaaucaacaaguguacacuuauugccauggaucugggcgaaaugugcgaagacaccguuacauacgaauguccccuccuggugaauaccgagccugaggauaucgacugcugguguaaccugacgucugcgugggugauguaugggaccugcacacagagcggagaaagacggcgcgagaaaagauccgucgcucucacaccccacucuggcauggggcuggaaacacgggccgagaccuggaugagcuccgagggagccuggaagcaugcucaacgcguggaaucuuggauucuuagaaauccuggcuucgcccugcucgcuggcuuuauggccuacaugaucgggcagacgggaauccagcggacaguuuucuuugugcugaugaugcuugucgcgcccagcuauggcaugcgcuguguggggguuggaaacagagauuucguggagggcgucuccgggggagccuggguggaccuggugcucgaacacggcggcugcgucaccacaauggcucaggggaaaccuacccuggauuuugagcugauuaagaccacagccaaggaaguugcucuccugcggacguacuguaucgaggccagcauuucuaauaucaccacagcgacccgcugccccacacaaggagagcccuaucuuaaagaagaacaggaccagcaguacauuuguagacgggaugugguggaccgcggcugggggaacggaugcggccuguucgggaagggaggcgucgugaccugcgccaaauuuuccuguagcggcaagaucacggggaaucucguucaaauugaaaaccuggaguauacaguggucgugaccguucauaauggagauacccacgcugugggcaacgacaucccuaaucacggggucacagccaccaucacacccagaucuccuuccguggaagucaaacuucccgauuacggagagcugacgcucgacugcgagccgcggagcggcauugacuucaacgaaaugauccugaugaagaugaagaaaaagaccuggcuggugcauaaacagugguuucucgaucugccucuucccugggcugccggggccgacacaucugagguucacuggaauuacaaggaaagaauggugaccuucaaagucccucaugcuaagcgccaggaugugauuguucugggcucccaggagggagcgaugcacagcgcccucacaggcgcuaccgaaguggacuccggggauggaaaccacauguuugccggccaucugaaauguaagguccggauggagaaacuuagaaucaaagggaugucuuauacgaugugcagcggaaaguucuccauugacaaagagauggccgaaacccaacacggcacaaccguggugaagguuaaauacgagggggcuggcgcccccuguaagguccccaucgaaauccgcgaugugaauaaggagaaaguggucggacggauuaucagcucuacaccuuucgcggaguauaccaacuccgugacgaacauugaacuggagccgcccuuuggcgacagcuacaucguuauuggggugggagauucugcucucacacugcauugguucagaaagggcagcuccaucgggaaaaugcuggaaucuaccuaucgcggagccaagcggauggccauccucggcgagacagcuugggacuuugggagcgucggcggacugcuuaccucccugggcaaagccgugcaccagguuuucgggagcguguacaccacaauguuuggaggcgucucuuggauggugcgcauucucaucggguuccugguucuguggauuggaacaaauucccgcaacaccagcauggcuaugacaugcaucgccgugggcgggauuacccuuuuucucggcuucacaguccaugcggauaccggaugugccgugucuugguccggcaaggaacugaagugcgggagcggaaucuuugugauugacaauguccacacguggacagagcaguauaaauuccaaccugagucccccgcucggcuggccucugcuauccucaacgcccacaaggacggcguuugugggaucagaagcaccacccgccuggaaaauauuauguggaaacagaucacaaacgagcuuaauuacgugcugugggaaggaggccaugaucucaccguggucgcgggcgacgugaaggggguucuguccaaaggaaagcgggcccuggcuccucccgugaacgaucuuaaguacucuuggaaaacauggggcaaggccaaaauuuuuacgccggaggcuaagaauagcaccuuccucaucgacgggccugauacauccgaaugccccaacgagagacgggccuggaauuuucuggaggucgaagacuauggauucggcauguucaccacaaacauuuggaugaaauuucgcgaggggagcucugaagugugugaucacagacugauguccgccgcuaucaaggaccagaaagcgguucaugccgauaugggauacuggaucgagagcucuaagaaucagaccuggcaaauugaaaaggcuucccucaucgaggugaaaacgugccuguggccuaagacccacacacuuuggagcaacggcguccuggagucucagaugcucauucccaaagccuaugccggcccuuucagccagcacaauuaccggcagggguaugcuacccaaacagugggacccuggcaucugggcaagcuggaaaucgacuuuggggagugcccgggaaccacaguuaccauucaggaagauugugaccacagaggcccuucccuucgcacgacaaccgccagcgggaaacucgugacccaguggugcugucggucuugcacaaugccgccccugagauuccugggagaggauggcuguugguacggcauggagauccgcccucucuccgaaaaggaggaaaacauggucaagagccagguguccgcggggcaaggaaccucugagacguuuagcaugggccugcuuugccugacacucuucguggaagagugucugagacggcgcgucaccagaaaacauaugauccugguuguggugacaacccuuugcgcuauuauccucgggggacugacauggauggaccugcuccgggcccugauuaugcuuggcgacaccauguccgggcgcaugggaggccagauccaccuggccauuauggcugucuuuaagaugucuccgggcuaugugcucgggaucuuccugagaaaacugacgagccgggagaccgcccuuaugguuaucggaauggcgaugacaaccgugcuguccauuccccaugaucucauggaauuuaucgacggcauuucucuggggcucauccugcuuaagauggucacacacuucgauaacacccaggugggaacgcuggcucucagccugacauuuauucgcuccaccaugccucugguuauggccuggagaacaaucauggccgugcuuuucgucgugacccugauuccccucugucggaccagcugccugcagaaacaaucucacugggucgagaucacagcucucauccugggcgcccaggcccuuccuguguaccugaugacgcucaugaagggggccuccaagcgcagcuggccccugaaugaaggaauuauggcgguuggccuggugucucuucugggcuccgcccuccugaaaaacgacgucccucucgcugggcccaugguggccggaggccugcuucuggcugccuacguuaugagcgggucuuccgccgaucugagccucgagaaggcugcgaaugugcagugggacgaaauggccgauaucaccggauccagcccgauuaucgaggucaaacaagacgaggauggcucuuuuagcauuagagacaucgaagagacaaacaugaucacccugcuugugaagcuggcucucauuacaguguccgggcuguauccucucgccauccccguuaccaugacgcugugguacauguggcaggucaaaacacagcggucuggagcccuuugggaugugccuagccccgcugccgcgcagaaggcuacccugaccgaaggcguguauagaauuaugcaacgcggccuguucgggaagacacaggucggagugggcauccauauggaggggguuuuccacaccauguggcaugugacacggggauccgucauuugucacgaaacgggcagacucgagccgucuugggccgacgugcgcaaugauaugaucagcuacgggggaggcuggcggcugggcgacaaaugggacaaggaggaagauguucaggugcuugccaucgagccugggaaaaaccccaagcauguccagaccaaaccuggacuguuuaagacacucaccggcgaaauuggggcugugacacuggacuucaaacccggaaccuccggcucucccaucauuaauagaaaggggaagguuaucggccucuauggaaacggcguggucacgaaaagcggggauuacguguccgccauuacccaagcggagcgcacaggagagccugacuaugaaguggaugaggacaucuuucggaagaaaagacugaccauuauggaucuucacccgggcgcugggaagacaaaacgcauccugcccagcaucguccgggaagcccugaagagacggcuccgcacccugauucuugccccuacaagaguuguggcugccgagauggaagaggcucugcggggacuccccauccgcuaccagacgccugccgugaagucugagcacaccggcagagaaauugucgaccugaugugccaugcgacauucaccacccggcuccuguccagcacaagagugcccaauuacaaccuuaucguuauggaugaggcccacuuuacggacccuucuuccguggcugcccgcggguauauuagcacccgggucgaaaugggcgaggcugccgccaucuucaugacagcuaccccgcccggagcgacagauccuuuuccccaguccaauucuccuaucgaagacauugagagagagauccccgaacgcagcuggaacaccggcuucgacuggauuacggauuaccaggggaaaacagugugguuuguuccguccaucaaggccggaaaugacauugcuaacugccugcggaaaagcggcaagaaagugauccaacugucuagaaagaccuucgauaccgaguauccuaagacaaaacucaccgacugggauuuugucgugacaaccgacaucuccgaaaugggggccaauuuccgcgccggacgggucauugaucccagacgcugucugaagcccgugaucagcacggacggcccugagagaguuauucuugcugggcccaucccugugacaccggccucugcggcucagcggcgcggcagaauuggacggaaccccgcccaggaagaugaccaauacguguucagcggcgauccucugaaaaacgacgaggaucaugcccacuggaccgaggcuaagaugcuccuggacaauaucuauacacccgaagggauuaucccuacccuguuuggacccgagcgcgagaagaaccaggccaucgacggcgaguucagacucagaggggagcagcggaagacguuugucgaacuuaugcgccggggagaucugccgguuuggcuguccuacaagguggcgucugccggcauuagcuauaaagacagagaguggugcuucaccggcgaacgcaauaaccagauccucgaggaaaauauggagguggagauuuggacacgggaaggggagaagaaaaagcugagaccuaaauggcuugaugcucgggucuacgccgaccccauggcucugaaggauuuuaaggaguucgccuccggacgcaaaucuaucacccucgacauucugacagagaucgcuagccugccuaccuaccucuccagcagagccaaacuugcgcuggauaacaucgugaugcugcacacaaccgaacggggcgggaaagccuaucaacaugcucucaaugagcugcccgagucucuugaaacgcugaugcucguugcccugcugggagcuaugacagccggcauuuuucucuucuuuaugcaggggaagggaaucggcaaacuuuccaugggccugauugccaucgcuguggcgagcgggcugcucugggucgccgagauucagccucaguggaucgcugccuccaucauucuggaguucuuucuuauggugcugcucauccccgagccggaaaagcaacgcaccccucaggacaaccagcugauuuacgucauccugaccauucucacaaucauuggacuuaucgccgcuaaugagaugggccugaucgagaaaaccaagacagauuucggguuuuaucaggugaagacggaaaccacaauucuggacguugaucucagacccgccucugcguggacccuguacgccguggcuacaaccauccuuacgcccaugcugcggcacaccauugagaacacaagcgccaaucucucccuggcugccaucgcgaaccaagccgcuguccugaugggacucggcaaaggguggccucuucaucgcauggaccugggagugccgcugcucgccaugggcuguuauucucagguuaaucccaccacacugauugcuagccuugugaugcugcucguccacuacgccaucaucggcccugggcugcaggcuaaggccaccagagaagcgcagaaacggacggccgcuggaauuaugaagaaccccacaguggauggcaucaccgugauugaccuggagccuaucuccuaugaccccaaauucgagaagcaacucgggcagguuaugcuucugguccugugcgccggacagcuccugcuuaugcgcacaaccugggcuuucugugaagugcugacccucgccacaggcccugugcugacgcugugggaggggaauccgggaagauuuuggaacaccacaauugccgucagcaccgcgaacaucuuccggggcucuuaccucgcuggcgccgggcuugcuuuuucccugaucaagaaugcccaaacacccagacgcggaaccggcacgacaggggaaacccugggagagaaauggaagcggcagcucaacagccuggauagaaaagaguucgaggaguacaagcgcucuggcauucuugaaguugaccggaccgaggccaaauccgcucugaaggaugggagcaagaucaaacaugccgugucuagaggaagcuccaagauucgcuggaucguggaacggggcauggucaaaccuaagggcaaagugguugaccucgggugcggaagaggcggguggucuuauuacauggcgacacugaagaaugugaccgaggucaagggauauacaaaaggcgggcccggacacgaagaaccuauucccauggccacguacggcuggaaccuggugaagcuccacagcggcguugauguguuuuauaaaccgaccgagcaggucgacacacuucugugugauaucggggaauccagcuccaauccuaccauugaggaaggacgcacacugcgggugcucaagaugguggagcccuggcugucuagcaaacccgaguucugcaucaagguccuuaacccuuacaugcccaccguuaucgaggagcuggaaaaacuccagagaaagcauggcgggucccuggugcgcuguccucugucucggaauagcacgcacgagauguauuggguguccggagucucuggcaacauugugagcuccguuaauaccacaagcaagaugcuccuuaacagauuuaccacacgccauagaaaaccgaccuacgaaaaggacguggaucugggggcuggaacacggucugucuccaccgagacggagaaacccgacaugacaaucauuggccgcagacugcaacggcuccaggaagaacacaaggaaaccuggcacuacgaucaggagaauccuuauagaaccugggccuaccauggcagcuaugaagcucccucuacaggguccgccagcucuauggugaacggaguugugaaacugcuuacgaagccuugggacgucauccccauggugacccagcuggcgaugacagacaccacaccguucggccaacagcggguuuuuaaggagaaaguggauacccgcacaccucagcccaagccugggaccagaauggucaugacgaccacagccaauuggcucugggcucugcugggcaagaagaaaaacccccggcucugcacccgcgaggaguucauuuccaaggugagaagcaaugccgcuaucggcgccgucuuucaggaggaacaaggguggacauccgcuagcgaggccgugaacgacucucgguucugggaacugguugauaaggagcgcgcgcuucaccaggagggcaaaugugaaagcugcguguacaauaugaugggaaagagagagaaaaagcugggcgaauuugggcgggccaaaggaucccgcgcuaucugguauauguggcucggcgccagauuccuggaguucgaagcucuuggguuucugaacgaggaccauugguucggacgggagaacucuuggagcggcgucgaaggggagggccuccaccgccugggauacauucuggaagauaucgacaagaaggauggcgaccucauuuaugccgaugacaccgccgggugggauacgagaaucacagaggacgaucugcuuaaugaggaacugauuaccgagcagauggcgccucaucacaaaauccucgcuaaggccaucuuuaaacugacauaccaaaacaagguggugaaaguucuucggcccaccccgaagggagccgugauggacauuaucucccgcaaagaccagagaggcucugggcaggucggaacguacggccugaauaccuucacaaacauggaagugcagcucauucggcaaauggaggcugaagggguuaucacccaggaugacaugcacaauccuaagggccugaaggagagaguggagaaauggcugaaggaaugcggagucgaucgccucaaacggauggccauuagcggcgacgauuguguggucaagccccuggacgagagauuuuccacaucucuucuguuccucaacgauauggggaaagugcgcaaggacaucccccagugggaaccuagcaagggauggaaaaauuggcaggagguuccguuuugcucccaucacuuccauaagaucuuuaugaaagauggccggagccuggugguccccuguagaaaccaagacgaacuuauugggcgcgcucggaucucucagggagccggcuggucccugagagagaccgcgugccucgggaaggccuaugcucagauguggagccugauguacuuccaccgccgggaucugagacucgccucuauggcuauuuguuccgccgugccuacagagugguuucccaccagccgcacgacaugguccauccacgcgcaucaccaguggaugaccaccgaagacaugcugaaaguuuggaaucggguguggauugaggacaacccuaauaugacagauaagacccccguccauucuugggaagacaucccuuaucuuggcaagagagaggaucuguggugcggaagccucauuggccuguccagccgggccacaugggcuaaaaacauccacacggccaucacccaagugagaaaucuuauugggaaggaagaguacguggacuauaugcccguuaugaaacgcuacucugcuccguucgaguccgaaggaguccuguga

SEQ ID NO: 20971 - RNA, 9867 nt, Artificial Sequence
  derived and/or modified CDS sequence (opt5) from DENV-4__FJ024424__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacgaccacaaucaccccuagaucccccagcguggaggucaagcuuccugauuacggagaacugacacucgacugcgagccccggucuggcaucgacuucaacgagaugauucugaugaagaugaaaaagaaaaccuggcuggugcauaagcagugguuucucgaucugccgcuuccuuggacggcuggggccgacaccuccgaaguucacuggaauuacaaagagagaauggugacauucaaggucccccaugcuaaacgccaggaugugaccguucugggcagccaggaaggagccaugcacuccgcccucgcuggcgcgacagagguggacucuggggauggaaaccacauguuugccggccaucugaaguguaagguccggauggaaaaacuuagaaucaaggggaugagcuauaccaugugcuccggaaaauucagcauugacaaggagauggcugagacgcaacacggcacaaccguggugaaaguuaaguacgaaggggccggcgccccuuguaagguccccaucgagauucgcgaugugaauaaagaaaagguggucggacgggugaucucuuccacaccccuggcugagaacaccaacagcguuaccaauaucgagcucgaaccuccguucggcgacucuuauauugugaucggggucggaaacagcgcccugacacugcauugguuuagaaaaggcuccucuauugggaagauguucgagagcacguaccgcggagcgaaacggauggcuauccucggcgaaaccgccugggauuuuggguccgugggcggacuguucacaagccuuggcaaggccguucaccagguguuugggucugucuauaccacaauguucggaggcguguccuggaugauuagaauccugaucggguuucucguucuguggauuggaaccaauagccgcaacacgucuauggcuaugacaugcaucgccgugggcgggauuacccuguuccuuggcuuuaccguccaggcugacaugggaugugugguguccuggagcggcaaggagcucaaaugcggguccggaaucuucgucguugauaaugugcauacauggaccgaacaauacaaguuucagcccgagucuccugcccggcuggcgagcgccauucugaacgcucacaaagacggcgugugugggaucagauccacaacgcgccucgagaaugucauguggaagcagauuaccaacgaacugaauuaugugcuuugggagggaggccacgaccugacaguuguggccggcgaugucaaaggggugcucaccaagggaaagcgggcucugacacccccuguuucugaccugaaauacagcuggaagaccuggggcaaagccaagaucuucacgcccgaagcgagaaacuccaccuuucuuaucgaugggccggacacaagcgagugcccuaaugaacggcgcgccuggaacucucucgagguggaggauuacggauucggcauguucaccacaaauauuuggaugaaauuuagagaaggguccagcgaggucugugaccaucggcugaugucugcugccaucaaggaucagaaagcugugcacgccgacaugggauauuggauugaauccagcaagaaccaaaccuggcagaucgagaaggccucucugauugaaguuaaaacaugccucuggcccaagacccauacgcuguggagcaauggcgugcuugagucccagaugcugaucccuaaaagcuacgcuggccccuucucucagcacaacuauagacaaggguacgcgacacagaccgucggaccuuggcaccucggcaagcuggagaucgauuuuggggaaugccccggaaccacagugaccauucaggaggacugugaucaucgcggcccgucccugcggacgacaaccgccagcgggaaacuugugacacaguggugcuguagauccugcaccaugccuccccuccgcuuccugggagaagacggcuguugguauggcauggagaucagaccccugucugagaaggaagagaacauggucaagagccaaguugcugccgggcagggaacauccgaaaccuuuucuaugggccuccugugccuuacgcuguucguggaggaaugucuccggcgcagagugacccggaaacacaugauucuggccgucgugaucacacugugcgcuauuauccuugggggacucaccuggauggaucugcugcgcgcccucaucaugcugggcgacacaaugagcgggagaauuggaggccagacccaucuugcgaucauggcuguuuuuaagauguccccuggcuacgugcugggggucuuccuccggaaacugacgucucgcgagacagcccugauggugauuggaauggccaugaccacaacccuuagcaucccgcacgaccugauggagcucauugauggcaucucccuggggcucauccugcuuaagauuguuacccaguuugacaauacacaagugggaacgcuggcucucagccugaccuucaucagaucuacaaugucccuggucauggccuggcggaccauuauggcggugcuuuuugucgugacacugaucccccucugucgcaccagcugccugcagaaacagucucauuggguugaaauuacggcucucauccugggcgcccaagcccuuccuguguaucugaugacacucaugaagggggcuuccagacggagcuggccccugaacgagggaauuauggccgucggccuggugucucuucugggcuccgcucuccugaagaaugauguuccucucgccgggcccaugguggcgggaggccugcuucuggccgcuuacgucaugagcggguccagcgccgaccugucucucgaaaaagcugccaacgugcagugggaugagauggccgacaucaccggaagcuccccuaucauugaagugaagcaggaugaggacggcucuuucagcaucagagauguugaggaaaccaauaugauuacacugcuugucaaacuggcucucaucaccguguccgggcuguacccccucgcgauuccggugacaaugacgcugugguauauguggcaggucaagacccaacgcucuggagcccuuugggacgugccuagccccgcugccacacagaaagccgcucuguccgagggcguuuaccggaucaugcagagaggccuguuugggaagacccaggugggagucggcauccacauggaagggguguuccacacaauguggcauguuacccgcggaucugugauuugucacgagacgggccggcucgaaccuagcugggccgaugucagaaacgacaugaucuccuaugggggaggcuggcgccugggcgauaagugggacaaagaggaggacgugcaaguucuugcgauugaacccgggaagaauccgaaacaugugcagaccaagccuggacuguucaaaacacucaccggcgagaucggggcugucacacuggauuuuaagcccggaaccagcggcucuccuauuaucaaccggaaagggaaggugaucggccucuacggaaauggcguggucacaaaguccggggacuauguuagcgccauuacgcaggccgaaagaaucggagagcccgauuacgagguggacgaagauauuuuccgcaaaaagcggcugaccaucauggaccuucaccccggcgcugggaaaacaaagagaauucugccuucuaucgugcgggaggcccugaaacgcagacuccggacccugauucuugcgccgacccgcgucguggcugccgaaauggaggaagcccugagaggacuccccauccgguaucagacaccugcuguuaaguccgagcauacgggcagagagaucguggaucugaugugccacgccaccuuuacaacccgccuccugagcuccacacggguccccaacuacaaucuuauugugauggacgaagcucacuucaccgauccuucuagcguugccgcgagaggguacaucuccacgcgcguggagaugggcgaagccgcugccauuuuuaugacagcuacccccccuggagccaccgacccguucccccaaagcaacucuccuaucgaggauauugaacgggagauccccgagagauccuggaauacaggcuuugacuggaucaccgacuaucaggggaagacagucugguucgugccuagcauuaaagccggaaacgauaucgcuaauugccugcgcaagucuggcaaaaaggucauucagcugagccggaaaaccuuugacacggaauaccccaagacaaagcucaccgauugggacuucgugguuacaaccgauaucuccgagaugggggcgaacuuuagagccggacgcgugauugacccgagacggugucugaaaccugugauccuuacggauggccccgaacgcgucauccuggcugggcccauuccuguuacccccgccucugccgcucaaagacggggccgcaucggaagaaacccuacacaggaggacgaucaguauguguucagcggcgacccgcucaagaaugaugaagaccaugcccacuggaccgaggcgaaaaugcugcuggauaacauuuacacacccgaggggaucauuccuacccucuucggacccgaacgggagaagacacaggcuaucgacggcgaauuuagacuucgcggggagcaacggaaaaccuucguggagcugaugagacgcggagaccugccugucuggcucuccuauaagguggccucugccggcauuagcuacaaggaucgggaauggugcuuuacgggcgagagaaauaaccagauccuggaagagaauauggaaguugagaucuggacacgggagggggaaaaaaagaaacuucgccccagauggcuggacgcucggguguaugccgauccgauggcgcucaaggacuucaaagaguuugccuccggacgcaagagcauuacccuggauauccugaccgaaauugcuucucucccuacauaccuuuccagcagagccaagcuggcucuggacaacaucgucaugcuccauaccacagagcggggcgggcgcgccuaccagcacgcucugaaugaacuucccgagucccuggagacgcucaugcugguggcccugcucggagcgaugaccgccggcauuuuccuuuuuuucaugcaggggaaaggaaucggcaagcugucuaugggccugaucacaauugcugucgccagcgggcuccuguggguggcugaaauccaaccucaguggauugccgccuccaucauucuugaguuuuuccugaugguucuccugauccccgaaccugagaaacagagaaccccccaggauaaccaacugaucuaugugauucucacaauccuuaccauuaucggacugauugcugcgaaugaaaugggccugaucgagaagacgaaaaccgacuuuggguucuaccaggucaagacagagaccacaauucucgauguggaccugcggccggccucugcuuggacccuuuaugccguugccacgacaauccugaccccuaugcuccgccacacaaucgaaaacaccagcgcuaaucugucccuggccgcgauugccaaccaggcugccgugcucaugggacuuggcaaaggguggccccugcauagaauggaucugggagucccccuccuggcuaugggcuguuacagccaggugaauccuaccacacuuacggccucucuggugaugcuccugguucacuaugcgaucauuggcccggggcugcaagccaaggcuacccgggaggcccagaagagaacagcugccggaaucaugaaaaaccccaccgucgacggcauuacagugaucgaucucgaaccuaucuccuacgaccccaaguuugagaaacagcuugggcaagugaugcugcugguccucugcgcuggacagcugcuucugaugcgcaccacgugggccuucugugagguucucacacuggcgaccggcccuauucugacccucugggaagggaaucccggacgguucuggaacacaaccaucgccgugagcacagcuaacauuuuuagaggcucuuaucuugccggcgcugggcuggccuucucccugaucaagaaugcccagacgccucgccggggaaccggcacaaccggggagacacucggagaaaaauggaagagacagcugaacagccuugaccgcaaggaguuugaagaguacaaacggucuggcauucuggagguggauagaaccgaagcgaagagcgcucucaaagacggguccaagaucaaacaugccgucucucgcggaagcuccaagauccgguggauuguggagagaggcaugguuaagccgaaaggcaagguggucgaucuggggugcggacgcggcggguggagcuacuauauggcuacgcugaaaaaugugaccgaaguuaagggauacacaaaaggcgggcccggacacgaggaaccuauccccauggccaccuauggcuggaaccucgugaagcuucauuccggcgucgacguguucuacaagccuacagagcaaguggauacccugcugugugacauuggggagucuagcuccaaucccacaaucgaagagggacggacccucagaguccugaaaaugguugaaccguggcuuucuagcaagccugaguuuugcauuaaagugcugaaccccuauaugcccacggugaucgaagagcucgagaagcugcagcgcaaacacggcgggaaucuggucagauguccucucucccggaacucuacacacgaaauguacugggugagcggagccuccggcaauauuguuagcucugugaacaccaccuccaagaugcuucugaaucgcuucacaacgagacaucggaaacccaccuaugagaaggaugucgaccugggggcuggaacaagaagcgugucuaccgaaacagagaagccugauaugaccaucaucggccggcgccuccagagacugcaggaggaacacaaagagacauggcauuacgaccaagaaaacccguaccggaccugggccuaucacggcuccuacgaggcgcccagcacggggucugccuccagcaugguuaauggaguggucaagcuucugaccaaaccuugggauaugauucccauggugacacagcucgcuaugaccgacacaaccccuuuuggccagcagcgcguuuucaaggaaaaaguggacacgagaacaccccaaccgaagccugggacccggauggucaugacaaccacggccaacuggcugugggcucugcucggaaagaaaaagaauccccgccugugcaccagagaggaguuuaucuccaaagugcggagcaacgccgcgauuggcgccgucuuccaggaagagcagggguggacaucugcuagcgaagccgugaaugauucccgcuuuugggagcuuguugacaaggaaagagcucugcaccaagagggcaaaugugagucuugcguguauaacaugaugggaaagcgggaaaagaaacucggcgaguucgggcgcgccaagggaagcagagcuaucugguacauguggcugggcgcccgguuucuugaauucgaggcgcugggguuccucaacgaagaucauugguuuggacgcgagaauuccuggucuggcgucgagggggaaggccugcacagacugggauauauucucgaggaaaucgacaaaaaggauggcgaccugauguacgccgaugacaccgcugggugggauacacggaucaccgaggacgaucuucagaacgaggaacugauuacagagcagauggccccucaucacaaaauccucgcuaaggccauuuucaagcugaccuaucagaauaaaguggugaagguucuuagacccacgccucgcggagccgugauggacaucauuagccggaaagaucaaagaggcuccgggcaggucggaacauacggccugaacaccuuuaccaauauggaagugcagcucauccgccagauggaggcggaagggguuaucacacaagacgacaugcagaaccccaagggccugaaagagcggguggagaaguggcugagagaaugcggagucgaucgccucaaacggauggcuauuucuggcgacgauuguguggucaagccgcuggacgagagauucgggaccagccuucuguuucucaaugauaugggaaaggugcgcaaagacaucccucagugggaacccuccaagggcuggaaaaacuggcaggagguucccuucugcagccaucacuuucacaagauuuucaugaaagaugggcggucucugguggucccuuguagaaaucaagacgaacuuaucggacgcgcccggauuucccagggcgccggguggagccugagagagacagcuugccucggcaaggccuacgcucagauguggucucugauguauuuucaucggagagaucugcgccucgccuccauggcgaucuguagcgccgugccgacggagugguuccccaccucccggacaaccuggucuauccacgcucaucaccaguggaugacaaccgaagacaugcugaagguuuggaacagaguguggauugaggauaauccuaacaugaucgacaaaacgcccguccacagcugggaagacauuccuuaccuuggaaagcgcgaggaucuguggugcggcucccucaucgggcugagcucuagagccaccugggcuaaaaauauucauacagccaucacccaagugcggaaccuuauuggaaaggaagaguauguggacuacaugcccguuaugaaacgcuauuccgcgccuagcgagucugaaggcguccuguga

SEQ ID NO: 20972 - RNA, 9867 nt, Artificial Sequence
  derived and/or modified CDS sequence (opt5) from DENV-4__EU854295__SS-prME
agcaccaucacccugcuuugccugauucccacggugauggcuuuccaucuuuccacccgggacggagagccucugaugaucgucgcuaagcaugaacgggggcgcccgcuccuguuuaagacaaccgaggggauuaacaaguguacccuuaucgccauggaucugggcgaaaugugcgaggacaccguuacauacaaguguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaagcaugcccaacgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaccaucacaccuagaucccccagcguggaggucaaacuuccugauuacggagaacugacccucgacugcgagccccggucuggcaucgacuucaacgagaugauucugaugaagaugaaaaagaaaacauggcuggugcauaagcagugguuucucgaucugccgcuuccuuggaccgccggggcugacacguccgaaguucacuggaauuacaaagagagaauggugaccuucaaggucccccaugccaaacgccaggaugugacaguucugggcagccaggaaggagccaugcacuccgcucucgcgggcgccaccgagguggacucuggggauggaaaccacauguuugcuggccaucugaaguguaagguccggauggaaaaacuuagaaucaaggggaugagcuauacaaugugcuccggaaaauucagcauugacaaggagauggccgagacccaacacggcacgacaguggugaaaguuaaguacgaaggggccggcgcuccuuguaagguccccaucgagauucgcgaugugaauaaagaaaagguggucggacgggugaucucuuccacaccccuggccgagaacacaaacagcguuaccaauaucgagcucgaaccuccguucggcgacucuuauauugugaucggggucggaaacagcgcgcugacccugcauugguuuagaaaaggcuccucuauugggaagauguucgagagcacauaccgcggagcuaaacggauggccauccucggcgaaacggccugggauuuuggguccgugggcggacuguucaccagccuuggcaaggcuguucaccagguguuugggucugucuauacaaccauguucggaggcguguccuggaugauuagaauccugaucggguuucucguucuguggauuggaacaaauagccgcaacaccucuauggccaugacgugcaucgcugugggcgggauuacacuguuccuuggcuuuaccguccaggccgacaugggaugugugguguccuggagcggccgggagcucaagugcggguccggaaucuucgucguugauaaugugcauaccuggacagaacaauacaaauuucagcccgagucuccugcgagacuggccagcgcuauucugaacgcccacaaggacggcgugugugggauccgcuccaccacacggcucgagaaugucauguggaaacagauuacgaacgaacugaauuaugugcuuugggagggaggccacgaccugaccguuguggcuggcgaugucaagggggugcucacaaaaggaaagagagcccugacacccccuguuucugaccugaaguacagcuggaaaacauggggcaaggcgaaaaucuucacccccgaagcccggaacuccacguuucuuaucgaugggccggacaccagcgagugcccuaaugaacgcagagcuuggaacucucucgagguggaggauuacggauucggcauguucacaaccaauauuuggaugaaguuucgggaaggguccagcgaggucugugaccauagacugaugucugccgcuaucaaagaucagaaggccgugcacgccgacaugggauauuggauugaauccagcaaaaaccaaacauggcagaucgagaaggcuucucugauugaaguuaagaccugccucuggcccaaaacacauacccuguggagcaauggcgugcuugagucccagaugcugaucccuaagagcuacgcgggccccuucucucagcacaacuaucgccaaggguacgccacgcagacagucggaccuuggcaccucggcaaacuggagaucgauuuuggggaaugccccggaaccaccgugacaauucaggaggacugugaucaucggggcccgucccugagaaccacgacagcuagcgggaaacuugugacccaguggugcugucgcuccugcacaaugccuccccucagauuccugggagaagacggcuguugguauggcauggagauccggccccugucugagaaagaagagaacauggucaagagccaaguugccgccgggccuggaaccuccgaaacauuuucuaugggccuccugugccuuacccuguucguggaggaaugucuccgcagacgggugacgcgcaagcacaugauucuggcugucgugaucacccugugcgccauuauccuugggggacucacauggauggaucugcugagagcgcucaucaugcugggcgacaccaugagcgggcggauuggaggccagacacaucuugcuaucauggccguuuuuaaaauguccccgggcuacgugcugggggucuuccuccgcaagcugaccucuagagagacggcccugauggugauuggaauggcuaugacaaccacacuuagcaucccccacgaccugauggagcucauugauggcaucucccuggggcucauccugcuuaaaauuguuacccaguuugacaauacccaggugggaacacuggcccucagccugacguucauccggucuaccaugucccuggucauggcguggcgcacaauuauggcugugcuuuuugucgugacccugaucccucucuguagaacaagcugccugcaaaagcagucucauuggguugaaauuaccgcccucauccugggcgcccaggcccuucccguguaucugaugacgcucaugaaaggggccucccggagaagcuggccucugaacgagggaauuauggcugucggccuggugucucuucugggcuccgcccuccugaagaaugauguuccccucgcggggccuaugguggccggaggccugcuucuggcugccuacgucaugagcggguccagcgcugaccugucucucgaaaaggccgccaacgugcaaugggaugagauggcugacaucacaggaagcucccccaucauugaagugaaacaggaugaggacggcucuuucagcauccgcgauguugaggaaaccaauaugauuacccugcuugucaagcuggcgcucaucacaguguccgggcuguacccgcucgccauuccugugaccaugacacugugguauauguggcaggucaaaacgcagcggucuggagcucuuugggacgugcccagcccugccgccacccaaaaggcugcccuguccgagggcguuuacagaaucaugcagcgcggccuguuugggaaaacacaggugggagucggcauccacauggaagggguguuccacaccauguggcauguuacacggggaucugugauuugucacgagaccggcagacucgaacccagcugggcggauguccgcaacgacaugaucuccuaugggggaggcuggcggcugggcgauaagugggacaaggaggaggacgugcagguucuugcuauugaaccggggaaaaauccuaagcaugugcaaacgaaacccggacuguucaagacccucacaggcgagaucggggccgucacccuggauuuuaaaccuggaacaagcggcucucccauuaucaacagaaaggggaaagugaucggccucuacggaaauggcguggucaccaaguccggggacuauguuagcgccauuacacaggcugaacgcaucggagagcccgauuacgagguggacgaagauauuuuccggaagaaaagacugacgaucauggaccuucacccuggcgccgggaagaccaaacggauucugccgucuaucgugcgcgaggcgcugaagagacggcuccgcacacugauucuugcucccaccagagucguggccgccgaaauggaggaagcucugcggggacucccuaucagauaucagacccccgccguuaaauccgagcauacaggccgcgagaucguggaucugaugugccacgcuacguuuaccacacggcuccugagcuccaccagagucccuaacuacaaucuuauugugauggacgaagcccacuucacagaucccucuagcguugcggcccgcggguacaucuccacccggguggagaugggcgaagcugccgcuauuuuuaugacggccacaccuccgggagccaccgaccccuucccucagagcaacucucccaucgaggauauugaaagagagaucccugagcgcuccuggaauaccggcuuugacuggaucacagacuaucaagggaagaccgucugguucgugcccagcauuaaggcuggaaacgauaucgcgaauugccugcggaaaucuggcaagaaagucauucagcugagcagaaagacauuugacaccgaauacccgaaaacgaagcucacagauugggacuucgugguuaccacagauaucuccgagaugggggccaacuuucgcgcuggaagagugauugacccucggcgcugucugaagcccgugauccuuaccgauggccccgaaagagucauccuggccgggccuauucccguuacgccugccucugcugcccagcggcgcggcagaaucggacggaacccggcgcaagaggacgaucaguauguguucagcggcgacccccucaaaaaugaugaagaccaugcucacuggaccgaggccaagaugcugcuggauaacauuuacacaccugaggggaucauucccacccucuucggaccugaaagagagaaaacacaggccaucgacggcgaauuucgccuuagaggggaacagagaaagaccuucguggagcugaugcgccggggagaccugcccgucuggcucuccuauaaaguggcuucugccggcauuagcuacaaggauagagaauggugcuuuacaggcgagcggaauaaccaaauccuggaagagaauauggaaguugagaucuggacccgcgagggggaaaagaagaaacuuagaccgcgguggcuggacgcgcgcguguaugccgauccuauggcucucaaagacuucaaagaguuugccuccggaagaaaaagcauuacgcuggauauccugacagaaauugcuucucuccccaccuaccuuuccagccgggccaagcuggcucuggacaacaucgucaugcuccauaccacagagcgcggcgggagagccuaccagcacgcgcugaaugaacuuccugagucccuggagacccucaugcugguggcccugcucggagcuaugacagccggcauuuuccucuuuuucaugcaggggaagggaaucggcaaacugucuaugggccugaucacgauugcugucgccagcgggcuccuguggguggccgaaauccagccccaauggauugcugcguccaucauucuugaguuuuuccugaugguucuccugaucccugaacccgagaagcagcggaccccgcaggauaaccagcugaucuaugugauucucacaauccuuaccauuaucggacugauugccgcuaaugaaaugggccugaucgagaaaacaaagaccgacuuuggguucuaccaagucaaaacggagaccacaauucucgauguggaccugcgcccugccucugccuggacccuuuaugcuguugccacaaccauccugacgcccaugcucagacacacaaucgaaaacaccagcgcgaaucugucccuggccgcuauugccaaccaggcugccgugcucaugggacuuggcaagggguggccccugcaucggauggaucugggagucccucuccuggcgaugggcuguuacagccaggugaauccgacaacccuuaccgccucucuggugaugcuccugguucacuaugcuaucauuggccccgggcugcaggccaaagcuacaagagaggcccaaaagcgcacggcugccggaaucaugaagaacccuaccgucgacggcauuacagugaucgaucucgaacccaucuccuacgacccuaaauuugagaagcagcuuggacaggugaugcugcugguccucugcgcgggacaacugcuucugaugcggaccacaugggccuucugugagguucucacccuggcuacgggccccauucugacacucugggaagggaauccuggaagauucuggaacaccaccaucgccgugagcacagcuaacauuuuucgcggcucuuaucuugccggcgccgggcuggcguucucccugaucaaaaaugcucagaccccgcggagaggaacaggcacgaccggggagacacucggagaaaaguggaaacgccagcugaacagccuugaccggaaggaguuugaagaguacaagagaucuggcauucuggagguggaucgcaccgaagccaaaagcgcucucaaggacggguccaaaaucaagcaugccgucucucggggaagcuccaaaaucagauggauuguggagcgcggcaugguuaagcccaagggcaaaguggucgaucuggggugcggacggggcggguggagcuacuauauggccacacugaagaaugugaccgaaguuaaaggauacacgaagggcgggccuggacacgaggaacccaucccuauggcuaccuauggcuggaaccucgugaaacuucauuccggcgucgacguguucuacaagcccacagaacagguggauacccugcugugugacauuggggagucuagcuccaauccgacaaucgaagagggaagaacccuccgcguccugaagaugguugaaccuuggcuuucuagcaaacccgaguuuugcauuaaggugcugaaccccuauaugccuacagugaucgaggagcucgagaaacugcaaagaaagcacggcgggaaucugguccgguguccccucucccgcaacucuacccacgaaauguacugggugagcggagccuccggcaauauuguuagcucugugaacacgacauccaaaaugcuucugaauagauucaccacccggcauagaaagccuacauaugagaaagaugucgaccugggggcgggaacgcggagcgugucuaccgaaacagagaagccggauaugaccaucaucggccgcagacuccagcggcugcaggaggaacacaaggagacauggcauuacgaccaggaaaaccccuaccgcaccugggccuaucacggcuccuacgaggcuccuagcacagggucugccuccagcaugguuaauggaguggucaaacuucugaccaagcccugggaugugauuccuaugguuacgcaacucgcuaugaccgacacaacccccuuuggccagcagagaguguucaaagaaaaggucgacacacggaccccgcagccuaaacccgggacgcgcguggucaugacaaccacagccaacuggcugugggcgcugcucggaaagaagaaaaauccuagacugugcacccgggaggaguuuaucuccaaggugcgcagcaacgccgcuauuggcgccguuuuccaagaggagcagggguggacgucugcuagcgaagccgugaaugauuccagauuuugggagcuugucgacaaagaacgggcucugcaccaggagggcaagugugagucuugcguguauaacaugaugggaaaacgcgaaaagaagcucggcgaguucgggagagccaaaggaagccgggcgaucugguacauguggcugggcgcccgcuuucuugaguucgaggcucugggguuccucaacgaagaucauugguuuggaagagaaaauuccuggucuggcguggagggggaaggccugcaccggcugggauauauucucgaggaaaucgacaagaaagauggcgaccugauguacgccgaugacaccgcugggugggauacaagaaucaccgaggacgaucuucaaaacgaggaacugauuacagagcagauggcgccccaccacaagauccucgccaaagccauuuucaagcugaccuaucagaauaagguugugaaaguccuucgcccuacaccccggggagcugugauggacaucauuagcagaaaggaucagcgcggcuccgggcaaguuggaaccuacggccugaacacguuuacaaauauggaagugcagcucauccggcagauggaggccgaaggggucaucacccaggacgacaugcaaaacccgaaaggccugaaggagagaguggagaaauggcugcgcgaaugcggagucgaucggcucaagagaauggccauuucuggcgacgauugugugguuaaaccucuggacgagcgcuucgggaccagccuucuguuucucaaugauaugggaaaggugcggaaggacaucccccagugggaacccuccaaaggcuggaagaacuggcaggaggucccuuucugcagccaucacuuucacaaaauuuucaugaaggaugggagaucucuggugguuccgugucgcaaucaggacgaacuuaucggacgggcuagaauuucccaaggcgccggguggagccugcgggagacagcuugccucggcaaagccuacgcgcagauguggucucugauguauuuucauagacgcgaucugcggcucgccuccauggcuaucuguagcgccgugcccaccgagugguucccuacauccagaacgaccuggucuauccacgcucaucaccaguggaugacaaccgaagacaugcugaaggucuggaaccgcguguggauugaggauaaucccaacaugaucgacaagacaccugugcacagcugggaagacauucccuaccuuggaaaaagagaggaucuguggugcggcucccucaucgggcugagcucucgggccaccugggcgaagaauauucauacggccaucacccagguucgcaaccuuauuggaaaagaagaguaugucgacuacaugccugugaugaagagauauuccgcucccagcgagucugaaggcgugcuguga

SEQ ID NO: 20973 - RNA, 9867 nt, Artificial Sequence
  derived and/or modified CDS sequence (opt5) from DENV-4__EU854296__SS-prME
agcaccaucacccugcuuugccugauucccacggugauggccuuccaccuuuccaccagagacggagagccucugaugaucguggcuaagcaugaacgggggcgcccgcuccuguuuaagaccaccgaggggauuaacaaguguacccuuaucgccauggaucugggagaaaugugcgaggacaccguuacauacaaguguccccuccuggugaauaccgaaccugaggauauugacugcugguguaaccugacgucuaccugggugauguaugggacaugcacccagagcggagagagacggcgcgaaaagagauccgucgcgcucacaccccacucuggaauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaccaucacaccuagaucccccagcguggaggucaaacuuccugauuacggagaacugacccucgacugcgagccccggucuggcaucgacuucaacgagaugauucugaugaagaugaaaaagaaaacauggcuggugcauaagcagugguuucucgaucugccgcuuccuuggaccgccggggcugacacguccgaaguucacuggaauuacaaagagagaauggugaccuucaaggucccccaugccaaacgccaggaugugacaguucugggcagccaggaaggagccaugcacuccgcucucgcgggcgccaccgagguggacucuggggauggaaaccacauguuugcuggccaucugaaguguaagguccggauggaaaaacuuagaaucaaggggaugagcuauacaaugugcuccggaaaauucagcauugacaaggagauggccgagacccaacacggcacgacaguggugaaaguuaaguacgaaggggccggcgcuccuuguaagguccccaucgagauucgcgaugugaauaaagaaaagguggucggacgggugaucucuuccacaccccuggccgagaacacaaacagcguuaccaauaucgagcucgaaccuccguucggcgacucuuauauugugaucggggucggaaacagcgcgcugacccugcauugguuuagaaaaggcuccucuauugggaagauguucgagagcacauaccgcggagcuaaacggauggccauccucggcgaaacggccugggauuuuggguccgugggcggacuguucaccagccuuggcaaggcuguucaccagguguuugggucugucuauacaaccauguucggaggcguguccuggaugauuagaauccugaucggguuucucguucuguggauuggaacaaauagccgcaacaccucuauggccaugacgugcaucgcugugggcgggauuacacuguuccuuggcuuuaccguccaggccgacaugggaugugugguguccuggagcggccgggagcucaagugcggguccggaaucuucgucguugauaaugugcauaccuggacagaacaauacaaauuucagcccgagucuccugcgagacuggccagcgcuauucugaacgcccacaaggacggcgugugugggauccgcuccaccacacggcucgagaaugucauguggaaacagauuacgaacgaacugaauuaugugcuuugggagggaggccacgaccugaccguuguggcuggcgaugccaaggggguccucacaaaaggaaagagagcgcugacacccccugugucugaccugaaguacagcuggaaaacauggggcaaggccaaaaucuucacccccgaagcucggaacuccacguuucuuaucgaugggccggacaccagcgagugcccuaaugaacgcagagccuggaacucucucgagguugaggauuacggauucggcauguucacaaccaauauuuggaugaaguuucgggaaggguccagcgaggugugugaccauagacugaugucugcugccaucaaagaucagaaggccguccacgcugacaugggauauuggauugaauccagcaaaaaccaaacauggcagaucgagaaggcgucucugauugaagugaagaccugccucuggcccaaaacacauacccuguggagcaauggcguucuugagucccagaugcugaucccuaagagcuacgccggccccuucucucagcacaacuaucgccaaggguacgcuacgcagacagugggaccuuggcaccucggcaaacuggagaucgauuuuggggaaugccccggaaccaccgucacaauucaggaggacugugaucaucggggcccgucccugagaaccacgacagccagcgggaaacuugugacccaguggugcugucgcuccugcacaaugccuccccucagauuccugggagaagacggcuguugguauggcauggagauccggccccugucugagaaagaagagaacauggucaagagccaagucaccgccgggcagggaacauccgaaaccuuuucuaugggccuccugugccuuacgcuguucguugaggaaugucuccgcagacgggugacccgcaagcacaugauucuggcuguggucaucacacugugcgccauuauccuugggggacucaccuggauggaucugcugagagcgcucaucaugcugggcgacacaaugagcgggcggauuggaggccagacccaucuugcuaucauggccguguuuaaaauguccccuggcuacguucuggggguguuccuccgcaagcugacgucuagagagacagcccugauggucauuggaauggcuaugaccacaacccuuagcaucccgcacgaccugauggagcucauugauggcaucucccuggggcucauccugcuuaaaauugugacccaguuugacaauacacaaguuggaacgcuggcccucagccugaccuucauccggucuacaaugucccuggugauggcguggcgcaccauuauggcuguccuuuuuguggucacacugaucccccucuguagaaccagcugccugcagaagcagucucauuggguggaaauuacggcccucauccugggcgcccaagcccuuccuguuuaucugaugacacucaugaaaggggccucccggagaagcuggccccugaacgagggaauuauggcugugggccuggucucucuucugggcuccgcccuccugaagaaugaugugccucucgcggggcccaugguugccggaggccugcuucuggcugccuacgugaugagcggguccagcgcugaccugucucucgaaaaggccgccaacguccagugggaugagauggcugacaucaccggaagcuccccuaucauugaagugaaacaggaugaggacggcucuuucagcauccgcgauguggaggaaaccaauaugauuacacugcuuguuaagcuggcgcucaucaccgucuccgggcuguacccccucgccauuccggugacaaugacgcugugguauauguggcaagugaaaacccaacggucuggagcucuuugggacgucccuagccccgccgccacacagaaggcugcccuguccgagggcguguacagaaucaugcagcgcggccuguuugggaaaacccagguuggagugggcauccacauggaaggggucuuccacacaauguggcaugugacccggggaucuguuauuugucacgagacgggcagacucgaaccuagcugggcggaugugcgcaacgacaugaucuccuaugggggaggcuggcggcugggcgauaagugggacaaggaggaggacguccaagugcuugcuauugaacccgggaaaaauccgaagcauguucagaccaaaccuggacuguucaagacacucaccggcgagaucggggccgugacacuggauuuuaaacccggaaccagcggcucuccuauuaucaacagaaaggggaaagucaucggccucuacggaaauggcguggugacaaaguccggggacuaugucagcgccauuacgcaggcugaacgcaucggagagcccgauuacgagguugacgaagauauuuuccggaagaaaagacugaccaucauggaccuucaccccggcgccgggaagacaaaacggauucugccuucuaucgugcgcgaggcgcugaagagacggcuccgcacccugauucuugcuccgaccagaguggucgccgccgaaauggaggaagcucugcggggacuccccaucagauaucagaccccugcugugaaauccgagcauacgggccgcgagaucguugaucugaugugccacgcuaccuuuacaacccggcuccugagcuccacaagagugcccaacuacaaucuuauugucauggacgaagcccacuucaccgauccuucuagcguggcggcccgcggguacaucuccacgcggguugagaugggcgaagcugccgcuauuuuuaugacagccacacccccuggagccaccgacccguucccccaaagcaacucuccuaucgaggauauugaaagagagauccccgagcgcuccuggaauacaggcuuugacuggaucaccgacuaucaggggaagacagugugguucgucccuagcauuaaggcuggaaacgauaucgcgaauugccugcggaaaucuggcaagaaagugauucagcugagcagaaagaccuuugacacggaauaccccaaaacaaagcucaccgauugggacuucgucgugacaaccgauaucuccgagaugggggccaacuuucgcgcuggaagaguuauugacccgcggcgcugucugaagccugugauccuuacggauggccccgaaagagugauccuggccgggcccauuccugucacccccgccucugcugcccaacggcgcggcagaaucggacggaacccugcgcaggaggacgaucaguauguuuucagcggcgacccgcucaaaaaugaugaagaccaugcucacuggacagaggccaagaugcugcuggauaacauuuacacccccgaggggaucauuccuacacucuucggacccgaaagagagaaaacccaggccaucgacggcgaauuucgccuuagaggggaacaacggaagacauucguggagcugaugcgccggggagaccugccuguguggcucuccuauaaagucgcuucugccggcauuagcuacaaggauagagaauggugcuuuaccggcgagcggaauaaccagauccuggaagagaauauggaaguggagaucuggacgcgcgagggggaaaagaagaaacuuagaccccgguggcuggacgcgcgcguuuaugccgauccgauggcucucaaagacuucaaagaguuugccuccggaagaaaaagcauuacacuggauauccugaccgaaauugcuucucucccuaccuaccuuuccagccgggccaagcuggcucuggacaacaucgugaugcuccauacaaccgagcgcggcgggagagccuaccagcacgcgcugaaugaacuucccgagucccuggagacacucaugcuggucgcccugcucggagcuaugacggccggcauuuuccucuuuuucaugcaggggaagggaaucggcaaacugucuaugggccugaucaccauugcuguggccagcgggcuccugugggucgccgaaauccaaccucaguggauugcugcguccaucauucuugaguuuuuccugauggugcuccugauccccgaaccugagaagcagcggacaccccaggauaaccaacugaucuauguuauucucaccauccuuacaauuaucggacugauugccgcuaaugaaaugggccugaucgagaaaaccaagacggacuuuggguucuaccaggccaaaaccgagacaaccauucucgauguggaccugcgcccggccucugcuuggacacuuuaugccgucgcgaccacgauccugacaccuaugcucagacacaccaucgaaaacacaagcgccaaucugucccuggcugccauugcuaaccaggccgcggugcucaugggacuuggcaagggguggccccugcaucggauggaucugggaguuccccuccuggccaugggcuguuacagccaggugaauccuaccacccuuacagcuucucuggucaugcuccuggugcacuaugccaucauuggcccggggcugcaagcuaaagccacgagagaggcucagaagcgcaccgccgcgggaaucaugaagaaccccacaguggacggcauuaccguuaucgaucucgaaccuaucuccuacgaccccaaauuugagaagcagcuugggcaagucaugcugcuggugcucugcgccggacagcugcuucugaugcggacaaccugggcuuucugugaggugcucacgcuggccacaggcccuauucugacccucugggaagggaaucccggaagauucuggaacaccacaaucgcugucagcaccgccaacauuuuucgcggcucuuaucuugccggcgcggggcuggcuuucucccugaucaaaaaugcccagacaccucggagaggaacgggcaccauuggggagacacucggagaaaaguggaaacgccagcugaacagccuugaccggaaggaguuugaagaguacaagagaucuggcauccuggagguugaucgcaccgaagcuaaaagcgcccucaaggacggguccaaaaucaagcaugccgugucucggggaagcuccaaaauuagauggaucguggagcgcggcauggucaagccgaagggcaaagugguugaucuggggugcggacggggcggguggagcuacuauauggcuacacugaagaaugugaccgaagucaaaggauacacgaagggcgggcccggacacgaggaaccuauucccauggccaccuauggcuggaaccucgugaaacuucauuccggcguugacguguucuacagaccuacagagcaagucgauacccugcugugugacaucggggagucuagcuccaaucccacaauugaagagggacgcacccucagagugcugaagaugguggaaccguggcuuucuagcaagccugaguuuugcaucaaaguccugaaccccuauaugcccacaguuauugaggaacucgagaagcugcagcggaaacacggcgggaaucuggugcgcuguccucucuccagaaacucuacccacgaaauguacugggugagcggagcguccggcaauaucgucagcucugugaacacgacauccaagaugcuucugaaucgguucaccaccagacaucggaaacccacauaugagaaggauguugaccugggggccggaacgcgcagcgugucuaccgaaacagagaaaccugauaugaccaucauuggcagacggcuccagcgccugcaggaggaacacaaggagacauggcauuacgaccaagaaaacccguacagaaccugggcuuaucacggcuccuacgaggcccccagcacagggucugcuuccagcauggucaauggagugguuaaacuucugaccaaaccuugggaugugauccccauggucacgcagcucgccaugaccgacacaaccccuuuuggccagcagcggguguucaaggaaaaaguugacacacgcacaccccagccgaagccugggacgagaauggugaugacaaccacagcgaacuggcugugggcccugcucggcaagaagaagaauccccggcugugcacccgcgaggaguuuauuuccaaagucagaagcaacgcugccaucggcgcuguguuccaggaggaacagggguggacgucugccagcgaagcugucaaugauucccgguuuugggagcuuguggacaaggaacgcgcccugcaccaagagggcaaaugugagucuugcguuuauaacaugaugggaaagagagagaagaagcucggcgaguucgggcgggcgaagggaagccgcgccauuugguacauguggcugggcgcuagauuucuugaguucgaggcccugggguuccucaacgaagaucauugguuuggacgggaaaauuccuggucuggcguggagggggaaggccugcacagacugggauauauccucgaggaaaucgacaaaaaggauggcgaccugauguacgcugaugacaccgccgggugggauacacgcauuaccgaggacgaucuucagaacgaggaacugaucacagagcagauggccccucaucacaaaauucucgcgaaggcuaucuucaaacugaccuaucagaauaaggucgugaaggugcuucggcccacaccuagaggagccguuauggacauuaucagccgcaaagaucaacggggcuccggacaggugggaaccuacggccugaacacguuuacaaauauggaaguccagcucaucagacagauggaggccgaaggggugauuacccaagacgacaugcagaaccccaagggccugaaagagcgcguugagaaguggcugcgggaaugcggaguggauagacucaaacgcauggcuaucucuggcgacgauugugucgugaagccgcuggacgagcgguucgggaccagccuucuguuucucaaugauaugggaaaagucagaaaggacauuccucagugggaacccuccaagggcuggaaaaacuggcaggaggugcccuucugcagccaucacuuucacaagaucuucaugaaagaugggcgcucucugguugugccuugucggaaucaagacgaacuuauuggcagagcccggaucucccagggcgcuggguggagccugagagagacagccugccucggcaaggcguacgcccagauguggucucugauguauuuucaucgccgggaucugagacucgcuuccauggccaucuguagcgcugucccgaccgagugguuccccacaucccgcacgaccuggucuauucacgcccaucaccaguggaugacaaccgaagacaugcugaaaguguggaacagaguuuggaucgaggauaauccuaacaugauugacaagacacccgugcacagcugggaagacaucccuuaccuuggaaagcgggaggaucuguggugcggcucccucauugggcugagcucucgcgcgaccugggccaaaaauauccauacggcuauuacccaagucagaaaccuuaucggaaaggaagaguauguggacuacaugcccgugaugaaacgguauuccgccccuagcgagucugaaggcguucuguga

SEQ ID NO: 20974 - RNA, 9867 nt, Artificial Sequence
  derived and/or modified CDS sequence (opt5) from DENV-4__GQ199878__SS-prME
agcaccaucacccugcuuugccugauucccacggugauggcuuuccaccuuuccacccgggacggagagccucugaugaucgucgcuaagcaugaacgggggcgcccgcuccuguuuaagaccaccgaggggauuaacaaguguacccuuaucgccauggaucugggcgaaaugugcgaggacaccguuaccuacaaguguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaagcaugcccaacgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaccaucacaccuagaucccccagcguggaggucaaacuuccugauuacggagaacugacccucgacugcgagccccggucuggcaucgacuucaacgagaugauucugaugaagaugaaaaagaaaacauggcuggugcauaagcagugguuucucgaucugccgcuuccuuggaccgccggggcugacacguccgaaguucacuggaauuacaaagagagaauggugaccuucaaggucccccaugccaaacgccaggaugugacaguucugggcagccaggaaggagccaugcacuccgcucucgcgggcgccaccgagguggacucuggggauggaaaccacauguuugcuggccaucugaaguguaagguccggauggaaaaacuuagaaucaaggggaugagcuauacaaugugcuccggaaaauucagcauugacaaggagauggccgagacccaacacggcacgacaguggugaaaguuaaguacgaaggggccggcgcuccuuguaagguccccaucgagauucgcgaugugaauaaagaaaagguggucggacgggugaucucuuccacaccccuggccgagaacacaaacagcguuaccaauaucgagcucgaaccuccguucggcgacucuuauauugugaucggggucggaaacagcgcgcugacccugcauugguuuagaaaaggcuccucuauugggaagauguucgagagcacauaccgcggagcuaaacggauggccauccucggcgaaacggccugggauuuuggguccgugggcggacuguucaccagccuuggcaaggcuguucaccagguguuugggucugucuauacaaccauguucggaggcguguccuggaugauuagaauccugaucggguuucucguucuguggauuggaacaaauagccgcaacaccucuauggccaugacgugcaucgcugugggcgggauuacacuguuccuuggcuuuaccguccaggccgacaugggaugugugguguccuggagcggccgggagcucaagugcggguccggaaucuucgucguugauaaugugcauaccuggacagaacaauacaaauuucagcccgagucuccugcgagacuggccagcgcuauucugaacgcccacaaggacggcgugugugggauccgcuccaccacacggcucgagaaugucauguggaaacagauuacgaacgaacugaauuaugugcuuugggagggaggccacgaccugaccguuguggcuggcgaugucaagggggugcucacaaaaggaaagagagcccugacacccccuguuucugaccugaaguacagcuggaaaacauggggcaaggcgaaaaucuucacccccgaagcccggaacuccacguuucuuaucgaugggccggacaccagcgagugcccuaaugaacgcagagcuuggaacucucucgagguggaggauuacggauucggcauguucacaaccaauauuuggaugaaguuucgggaaggguccagcgaggucugugaccauagacugaugucugccgcuaucaaagaucagaaggccgugcacgccgacaugggauauuggauugaauccagcaaaaaccaaacauggcagaucgagaaggcuucucugauugaaguuaagaccugccucuggcccaaaacacauacccuguggagcaauggcgugcuugagucccagaugcugaucccuaagagcuacgcgggccccuucucucagcacaacuaucgccaaggguacgccacgcagacagucggaccuuggcaccucggcaaacuggagaucgauuuuggggaaugccccggaaccaccgugacaauucaggaggacugugaucaucggggcccgucccugagaaccacgacagcuagcgggaaacuugugacccaguggugcugucgcuccugcacaaugccuccccucagauuccugggagaagacggcuguugguauggcauggagauccggccccugucugagaaagaagagaacauggucaagagccaaguugccgccgggcagggaaccuccgaaacauuuucuaugggccuccugugccuuacccuguucguggaggaaugucuccgcagacgggugacgcgcaagcacaugauucuggcugucgugaucacccugugcgccauuauccuugggggacucacauggauggaucugcugagagcgcucaucaugcugggcgacaccaugagcgggcggauuggaggccagacacaucuugcuaucauggccguuuuuaaaauguccccuggcuacgugcugggggucuuccuccgcaagcugaccucuagagagacggcccugauggugauuggaauggcuaugacaaccacacuuagcaucccgcacgaccugauggagcucauugauggcaucucccuggggcucauccugcuuaaaauuguuacccaguuugacaauacccaagugggaacacuggcccucagccugacguucauccggucuaccaugucccuggucauggcguggcgcacaauuauggcugugcuuuuugucgugacccugaucccccucuguagaacaagcugccugcagaagcagucucauuggguugaaauuaccgcccucauccugggcgcccaagcccuuccuguguaucugaugacgcucaugaaaggggccucccggagaagcuggccccugaacgagggaauuauggcugucggccuggugucucuucugggcuccgcccuccugaagaaugauguuccucucgcggggcccaugguggccggaggccugcuucuggcugccuacgucaugagcggguccagcgcugaccugucucucgaaaaggccgccaacgugcagugggaugagauggcugacaucacaggaagcuccccuaucauugaagugaaacaggaugaggacggcucuuucagcauccgcgauguugaggaaaccaauaugauuacccugcuugucaagcuggcgcucaucacaguguccgggcuguacccccucgccauuccggugaccaugacacugugguauauguggcaggucaaaacgcaacggucuggagcucuuugggacgugccuagccccgccgccacccagaaggcugcccuguccgagggcguuuacagaaucaugcagcgcggccuguuugggaaaacacaggugggagucggcauccacauggaagggguguuccacaccauguggcauguuacacggggaucugugauuugucacgagaccggcagacucgaaccuagcugggcggauguccgcaacgacaugaucuccuaugggggaggcuggcggcugggcgauaagugggacaaggaggaggacgugcaaguucuugcuauugaacccgggaaaaauccgaagcaugugcagacgaaaccuggacuguucaagacccucacaggcgagaucggggccgucacccuggauuuuaaacccggaacaagcggcucuccuauuaucaacagaaaggggaaagugaucggccucuacggaaauggcguggucaccaaguccggggacuauguuagcgccauuacacaggcugaacgcaucggagagcccgauuacgagguggacgaagauauuuuccggaagaaaagacugacgaucauggaccuucaccccggcgccgggaagaccaaacggauucugccuucuaucgugcgcgaggcgcugaagagacggcuccgcacacugauucuugcuccgaccagagucguggccgccgaaauggaggaagcucugcggggacuccccaucagauaucagaccccugccguuaaauccgagcauacaggccgcgagaucguggaucugaugugccacgcuacguuuaccacacggcuccugagcuccaccagaguccccaacuacaaucuuauugugauggacgaagcccacuucacagauccuucuagcguugcggcccgcggguacaucuccacccggguggagaugggcgaagcugccgcuauuuuuaugacggccacacccccuggagccaccgacccguucccccaaagcaacucuccuaucgaggauauugaaagagagauccccgagcgcuccuggaauaccggcuuugacuggaucacagacuaucaggggaagaccgucugguucgugccuagcauuaaggcuggaaacgauaucgcgaauugccugcggaaaucuggcaagaaagucauucagcugagcagaaagacauuugacaccgaauaccccaaaacgaagcucacagauugggacuucgugguuaccacagauaucuccgagaugggggccaacuuucgcgcuggaagagugauugacccgcggcgcugucugaagccugugauccuuaccgauggccccgaaagagucauccuggccgggcccauuccuguuacgcccgccucugcugcccaacggcgcggcagaaucggacggaacccugcgcaggaggacgaucaguauguguucagcggcgacccgcucaaaaaugaugaagaccaugcucacuggaccgaggccaagaugcugcuggauaacauuuacacacccgaggggaucauuccuacccucuucggacccgaaagagagaaaacacaggccaucgacggcgaauuucgccuuagaggggaacaaagaaagaccuucguggagcugaugcgccggggagaccugccugucuggcucuccuauaaaguggcuucugccggcauuagcuacaaggauagagaauggugcuuuacaggcgagcggaauaaccagauccuggaagagaauauggaaguugagaucuggacccgcgagggggaaaagaagaaacuuagaccccgguggcuggacgcgcgcguguaugccgauccgauggcucucaaagacuucaaagaguuugccuccggaagaaaaagcauuacgcuggauauccugacagaaauugcuucucucccuaccuaccuuuccagccgggccaagcuggcucuggacaacaucgucaugcuccauaccacagagcgcggcgggagagccuaccagcacgcgcugaaugaacuucccgagucccuggagacccucaugcugguggcccugcucggagcuaugacagccggcauuuuccucuuuuucaugcaggggaagggaaucggcaaacugucuaugggccugaucacgauugcugucgccagcgggcuccuguggguggccgaaauccaaccucaguggauugcugcguccaucauucuugaguuuuuccugaugguucuccugauccccgaaccugagaagcagcggacaccccaggauaaccaacugaucuaugugauucucacaauccuuaccauuaucggacugauugccgcuaaugaaaugggccugaucgagaaaacaaagaccgacuuuggguucuaccaggucaaaacggagaccacaauucucgauguggaccugcgcccggccucugccuggacccuuuaugcuguugccacaaccauccugacgccuaugcucagacacacaaucgaaaacaccagcgcgaaucugucccuggccgcuauugccaaccaggcugccgugcucaugggacuuggcaagggguggccccugcaucggauggaucugggagucccccuccuggcgaugggcuguuacagccaggugaauccuacaacccuuaccgccucucuggugaugcuccugguucacuaugcuaucauuggcccggggcugcaagccaaagcuacaagagaggcccagaagcgcacggcugccggaaucaugaagaaccccaccgucgacggcauuacagugaucgaucucgaaccuaucuccuacgaccccaaauuugagaagcagcuugggcaagugaugcugcugguccucugcgcgggacagcugcuucugaugcggaccacaugggccuucugugagguucucacccuggcuacgggcccuauucugacacucugggaagggaaucccggaagauucuggaacaccaccaucgccgugagcacagcuaacauuuuucgcggcucuuaucuugccggcgccgggcuggcguucucccugaucaaaaaugcucagaccccucggagaggaacaggcacgaccggggagacacucggagaaaaguggaaacgccagcugaacagccuugaccggaaggaguuugaagaguacaagagaucuggcauucuggagguggaucgcaccgaagccaaaagcgcucucaaggacggguccaaaaucaagcaugccgucucucggggaagcuccaaaaucagauggauuguggagcgcggcaugguuaagccgaagggcaaaguggucgaucuggggugcggacggggcggguggagcuacuauauggccacacugaagaaugugaccgaaguuaaaggauacacgaagggcgggcccggacacgaggaaccuauccccauggcuaccuauggcuggaaccucgugaaacuucauuccggcgucgacguguucuacaagccuacagagcaaguggauacccugcugugugacauuggggagucuagcuccaaucccacaaucgaagagggaagaacccuccgcguccugaagaugguugaaccguggcuuucuagcaaaccugaguuuugcauuaaggugcugaaccccuauaugcccacagugaucgaggaacucgagaaacugcagagaaagcacggcgggaaucugguccgguguccucucucccgcaacucuacccacgaaauguacugggugagcggagccuccggcaauauuguuagcucugugaacacgacauccaaaaugcuucugaauagauucaccacccggcauagaaagcccacauaugagaaagaugucgaccugggggcgggaacgcggagcgugucuaccgaaacagagaagccugauaugaccaucaucggccgcagacuccagcggcugcaggaggaacacaaggagacauggcauuacgaccaagaaaacccguaccgcaccugggccuaucacggcuccuacgaggcucccagcacagggucugccuccagcaugguuaauggaguggucaaacuucugaccaagccuugggaugugauucccaugguuacgcagcucgcuaugaccgacacaaccccuuuuggccagcagagaguguucaaagaaaaggucgacacacggacaccccaaccgaaaccugggacgcgcauggugaugacaaccacagccaacuggcugugggcgcugcucggaaagaagaaaaaucccagacugugcacccgggaggaguuuaucuccaagguccgcagcaacgccgcuauuggcgccguguuccaggaggagcagggguggacgucugcuagcgaagccguuaaugauuccagauuuugggagcuuguggacaaagaacgggcucugcaccaagagggcaagugugagucuugcgucuauaacaugaugggaaaacgcgaaaagaagcucggcgaguucgggagagccaaaggaagccgggcgaucugguacauguggcugggcgcccgcuuucuugaguucgaggcucugggguuccucaacgaagaucauugguuuggaagagaaaauuccuggucuggcguggagggggaaggccugcaccggcugggauauauucucgaggaaaucgacaagaaagauggcgaccugauguacgccgaugacaccgcugggugggauacaagaaucaccgaggacgaucuucagaacgaggaacugauuacagagcagauggccccucaucacaagauccucgccaaagcgauuuucaagcugaccuaucagaauaaggugguuaaagugcuucgccccacaccucggggagcugucauggacaucauuagcagaaaggaucaacgcggcuccggacaggugggaaccuacggccugaacacguuuacaaauauggaaguucagcucauccggcagauggaggccgaaggggugaucacccaagacgacaugcagaaccccaaaggccugaaggagagagucgagaaauggcugcgcgaaugcggaguggaucggcucaagagaauggccauuucuggcgacgauugugucgugaaaccgcuggacgagcgcuucgggaccagccuucuguuucucaaugauaugggaaagguucggaaggacaucccucagugggaacccuccaaaggcuggaagaacuggcaggaggugcccuucugcagccaucacuuucacaaaauuuucaugaaggaugggagaucucuggucgugccuugucgcaaucaagacgaacuuaucggacgggcuagaauuucccagggcgccggguggagccugcgggagacagcuugccucggcaaagccuacgcgcagauguggucucugauguauuuucauagacgcgaucugcggcucgccuccauggcuaucuguagcgccguuccgaccgagugguuccccacauccagaacgaccuggucuauccacgcucaucaccaguggaugacaaccgaagacaugcugaagguguggaaccgcgucuggauugaggauaauccuaacaugaucgacaagacacccgugcacagcugggaagacauuccuuaccuuggaaaaagagaggaucuguggugcggcucccucaucgggcugagcucucgggccaccugggcgaagaauauucauacggccaucacccaagugcgcaaccuuauuggaaaagaagaguauguugacuacaugcccgucaugaagagauauuccgcuccuagcgagucugaaggcgugcuguga

SEQ ID NO: 20975 - RNA, 9867 nt, Artificial Sequence
  derived and/or modified CDS sequence (opt5) from DENV-4__GQ199879__SS-prME
agcaccaucacccugcuuugccugauucccacggugauggccuuccaccuuuccaccagagacggagagccucugaugaucgucgcuaagcaugaacgggggagaccgcuccuguuuaagaccaccgaggggauuaacaaguguacccuuaucgccauggaucugggcgaaaugugcgaggacaccguuacauacaaguguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccagcgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaccaucacaccuagaucccccagcguggaggucaaacuuccugauuacggagaacugacccucgacugcgagccccggucuggcaucgacuucaacgagaugauucugaugaagaugaaaaagaaaacauggcuggugcauaagcagugguuucucgaucugccgcuuccuuggaccgccggggcugacacguccgaaguucacuggaauuacaaagagagaauggugaccuucaaggucccccaugccaaacgccaggaugugacaguucugggcagccaggaaggagccaugcacuccgcucucgcgggcgccaccgagguggacucuggggauggaaaccacauguuugcuggccaucugaaguguaagguccggauggaaaaacuuagaaucaaggggaugagcuauacaaugugcuccggaaaauucagcauugacaaggagauggccgagacccaacacggcacgacaguggugaaaguuaaguacgaaggggccggcgcuccuuguaagguccccaucgagauucgcgaugugaauaaagaaaagguggucggacgggugaucucuuccacaccccuggccgagaacacaaacagcguuaccaauaucgagcucgaaccuccguucggcgacucuuauauugugaucggggucggaaacagcgcgcugacccugcauugguuuagaaaaggcuccucuauugggaagauguucgagagcacauaccgcggagcuaaacggauggccauccucggcgaaacggccugggauuuuggguccgugggcggacuguucaccagccuuggcaaggcuguucaccagguguuugggucugucuauacaaccauguucggaggcguguccuggaugguucgcauucugaucggguuucucgugcuguggaucggaacaaauagccgcaacaccucuauggccaugacgugcauugcugucggcgggaucacacuguuccuuggcuuuaccgugcaggccgacaugggauguguggucuccuggagcggccgggagcucaagugcggguccggaauuuucguuguggauaaugugcauaccuggacagaacaauacaaauuucagcccgagucuccugcgagacuggccagcgcuauccugaacgcccacaaggacggcgucugugggauucgcuccaccacacggcucgagaaugugauguggaaacagaucacgaacgaacugaauuauguucuuugggagggaggccacgaccugaccguggucgcuggcgaugugaaggggguucucacaaaaggaaagagagcccugacacccccugugucugaccugaaguacagcuggaaaacauggggcaaggcgaaaauuuucacccccgaagcccggaacuccacguuucuuaucgaugggccggacaccagcgagugcccuaaugaacgcagagcuuggaacucucucgaggucgaggauuacggauucggcauguucacaaccaauaucuggaugaaguuucgggaaggguccagcgaggugugugaccauagacugaugucugccgcuauuaaagaucagaaggccguucacgccgacaugggauauuggaucgaauccagcaaaaaccaaacauggcagauugagaaggcuucucugaucgaagugaagaccugccucuggcccaaaacacauacccuguggagcaauggcguccuugagucccagaugcugauuccuaagagcuacgcgggccccuucucucagcacaacuaucgccaaggguacgccacgcagacagugggaccuuggcaccucggcaaacuggagaucgauuuuggggaaugccccggaaccaccgugacaauccaggaggacugugaucaucggggcccgucccugagaaccacgacagcuagcgggaaacuugucacccaguggugcugucgcuccugcacaaugccuccccucagauuccugggagaagacggcuguugguauggcauggagauucggccccugaacgagaaagaagagaauaugguuaagucucaagugaccgccgggcagggaacaagcgaaaccuuuuccaugggccuccugugccuuacgcuguucguggaggaaugucuccgcagacgggucacccgcaagcacaugauccuggugguugugauuacacugugcgccaucauucuugggggacucaccuggauggaucugcugagagcucucaucaugcugggcgacacaaugucugggcggaucggaggccagauucaucuugccaucauggcggucuuuaaaaugagcccuggcuacgugcuggggguuuuccuccgcaagcugaccuccagagagacggcucugauggugauuggaauggccaugacaaccguccuuucuaucccgcacgaccugauggagcucauugauggcaucagccuggggcucauccugcuuaaaauugugacacaguuugacaacacccaagucggaacccuggcccucucccugacauucauccggagcacgaugccccuggugauggcuuggcgcaccauuauggccguucuuuuuguggucacacugaucccucucuguagaaccucuugccugcagaagcagucccauuggguggaaauuacagcgcucauccugggcgcucaagcccuucccguuuaucugaugacccucaugaaaggggccagccggagaucuuggccucugaaugagggaauuauggcugugggccuggucucccuucugggcagcgcccuccugaagaacgaugugccccucgcugggccuaugguggccggaggccugcuucuggcggccuacguuaugucuggguccagcgcugaccugucccucgaaaaggccgcuaauguccagugggaugagauggccgacaucacgggaagcucucccaucauugaagugaaacaggaugaggacggcagcuucuccauccgcgauguggaggaaacaaacaugauuacccugcuugucaagcuggcccucaucaccgugucugggcuguacccgcucgcuauuccuguuacaaugacccugugguauauguggcaagugaaaacacaacggagcggagcgcuuugggacguccccuccccugccgcuacgcagaaggccgcccugucugagggcguguacagaaucaugcagcgcggccuguuugggaaaacccagguuggagugggcauccacauggaaggggucuuccacacaauguggcaugugacccggggaagcguuauuugucacgagacaggcagacucgaacccuccugggcugaugugcgcaaugacaugaucucuuaugggggaggcuggcggcugggcgauaagugggacaaggaggaggacguccaagugcuugccauugaaccggggaaaaacccuaagcaugugcagaccaaacccggacuguucaagacgcucaccggcgagaucggggcggucacacuggauuuuaaaccuggaaccagcggcucccccauuaucaauagaaaggggaaaguuaucggccucuacggaaacggcguggugacaaagagcggggacuaugucucugcuauuacccaggccgaacgcaucggagagcccgauuacgagguggacgaagauauuuuccggaagaaaagacugacaaucauggaccuucacccuggcgccgggaagacgaaacggauucugccguccaucguucgcgaggcucugaagagacggcuccgcacccugauucuugcccccacaagaguggucgcggcugaaauggaggaagcccugcggggacucccuaucagauaucagacccccgccgugaaaagcgagcauaccggccgcgagaucguugaucugaugugccacgcuacauuuacgacccggcuccugucuuccacaagagugccuaauuacaaccuuauugucauggacgaagcccacuucaccgaucccagcuccguggcugcccgcggguacaucucuacacgggucgagaugggcgaagcggccgcuauuuuuaugaccgccacgccuccgggagcuacagaccccuucccucaaagcaauucccccaucgaggauauugaaagagagaucccugagcgcagcuggaacaccggcuuugacuggaucaccgacuaucaggggaagacagugugguucguucccucuauuaaggccggaaaugauaucgccaacugccugcggaaauccggcaagaaagugauucagcugagcagaaagaccuuugacacagaauacccgaaaaccaagcucacggauugggacuucguggucacaaccgauaucucugagaugggggcuaacuuucgcgcgggaagaguuauugacccucggcgcugucugaagcccgugauccuuacagauggccccgaaagagugauccuggccgggccuauucccgucaccccugcuagcgccgcccaacggcgcggcagaaucggacggaauccggcucaggaggacgaucaguauguguucuccggcgacccccucaaaaacgaugaagaccaugcccacuggacggaggcgaagaugcugcuggauaauauuuacaccccugaggggaucauucccacacucuucggaccugaaagagagaaaacccaggcuaucgacggcgaauuucgccuuagaggggagcaacggaagacauucguugagcugaugcgccggggagaccugcccguguggcucucuuauaaagucgccagcgccggcauuuccuacaaggauagagaauggugcuuuaccggcgagcggaacaaucagauccuggaagagaacauggaaguggagaucuggacacgcgagggggaaaagaagaaacuuagaccgcgguggcuggacgcucgcgucuaugccgauccuauggcgcucaaagacuucaaagaguuugccucuggaagaaaaagcauuacccuggauauccugacggaaauugcuucccuccccacauaccuuagcucucgggccaagcuggcucuggacaauaucgugaugcuccauaccaccgagcgcggcgggagagccuaccagcacgcucugaacgaacuuccugagucccuggagacacucaugcugguugcccugcucggagcgaugaccgccggcauuuuccucuuuuucaugcaggggaagggaaucggcaaacugagcaugggccugaucgcuauugccguggcuuccgggcuccugugggucgccgaaauccaaccccaguggauugccgcuucuaucauucuugaguuuuuccugauggugcuccugaucccugaacccgagaagcagcggacaccgcaggauaaucaacugaucuauguuauucucacgauccuuaccauuaucggacugauugcggccaacgaaaugggccugaucgagaaaacaaagaccgacuuuggguucuaccaggugaaaacagagaccacgauucucgaugucgaccugcgcccugcuagcgccuggacccuuuaugccguggcuacaaccauccugacacccaugcucagacacaccaucgaaaauacguccgccaaccugucucuggcggccauugcuaaucaggccgcugugcucaugggacuuggcaagggguggccccugcaucggauggaucugggaguuccucuccuggccaugggcuguuacagccaggucaacccgacaacccuuacagcgucccuggugaugcuccuggugcacuaugccaucauuggccccgggcugcaagcuaaagccaccagagaggcucagaagcgcaccgccgcuggaaucaugaagaauccuacagucgacggcauuacgguuaucgaucucgaacccaucagcuacgacccuaaauuugagaagcagcuugggcaagugaugcugcuggugcucugcgccggacagcugcuucugaugcggaccacaugggcguucugugagguccucacccuggccacaggccccauucugacccucugggaagggaacccuggaagauucuggaacacgacaaucgcugugucuaccgccaauauuuuucgcggcuccuaucuugcuggcgccgggcuggccuucagccugaucaaaaacgcgcagaccccgcggagaggaacaggcaccacaggggagacgcucggagaaaaguggaaacgccagcucaauucucuugaccggaaggaguuugaagaguacaagagauccggcauucuggagguugaucgcaccgaagcuaaaagcgcccucaaggacgggucuaaaacaaagcaugcugugagccggggauccucuaaaaucagauggaucgucgagcgcggcauggugaagcccaagggcaaaguuguggaucuggggugcggacggggcggguggagcuacuauauggccacccugaagaacgucacagaagugaaaggauacaccaagggcgggccuggacacgaggaacccauuccuauggccacguauggcuggaaucucgugaaacuucauuccggcgucgacguuuucuacaagcccaccgagcaaguggauacacugcugugugacaucggggagagcuccucuaacccgaccauugaagagggaagaacacuccgcgugcugaagauggucgaaccuuggcuuagcuccaaacccgaguuuugcaucaaggugcugaaucccuauaugccuaccguuauugaagaacuggagaaacugcagagaaagcacggcgggaaccuggugcgguguccccucucucgcaauagcacacacgaaauguacugggucuccggagcuucuggcaacaucgugagcuccguuaauaccacgagcaaaaugcuucugaacagauucacaacccggcauagaaagccuaccuaugagaaagauguggaccugggggccggaacacggucugucuccacggaaaccgagaagccggauaugacaauuaucggccgcagacuccagcggcugcaggaggaacacaaggagaccuggcauuacgaccaagaaaaucccuaccgcacaugggcguaucacggcagcuacgaggccccuucuaccggguccgcuagcucuauggugaacggaguugugaaacuucugacaaagcccugggaugucaucccuauggugacccagcucgccaugacggacaccacacccuuuggccagcagagagucuucaaagaaaagguggacacccggacaccgcaaccuaaacccgggacccgcaugauuaugacgacaaccgcuaauuggcugugggcccugcucggaaagaagaaaaacccuagacugugcacacgggaggaguuuaucuccaagguucgcagcaaugcggccauuggcgcuguguuccaggaggaacagggguggaccuccgccagcgaagcugucaacgauucuagauuuugggagcuuguggacaaagaacgggcccugcaccaagagggcaagugugagagcugcguguauaacaugaugggaaaacgcgaaaagaagcucggcgaguucgggagagcuaaaggaucccgggccaucugguacauguggcugggcgcgcgcuuucuugaguucgaggcccugggguuccucaaugaagaucauugguuuggaagagagaacucuuggagcggcguugagggggaaggccugcaccggcugggauauauucucgaggaaaucgacaagaaagauggcgaccugauguacgcugaugacacggccgggugggauaccagaaucacagaggacgaucuucagaaugaggaacugauuaccgagcagauggcuccccaucacaagauccucgccaaagccauuuucaagcugacauaucagaacaagguggucaaagugcuucgcccuacaccccggggagcgguuauggacaucauuuccagaaaggaucaacgcggcucuggacaggugggaacauacggccugaauaccuuuacgaacauggaaguccagcucauccggcagauggaggcugaaggggugaucacacaagacgacaugcagaauccgaaaggccugaaggagagagucgagaaauggcugcgcgaaugcggaguggaucggcucaagagaauggccauuagcggcgacgauuguguugugaaaccucuggacgagcgcuucgggaccucccuucuguuucucaacgauaugggaaagguccggaaggacaucccccagugggaacccucuaaaggcuggaagaauuggcaggaggugccuuucugcagccaucacuuucacaaaauuuucaugaaggaugggagaucccugguugugccgugucgcaaccaagacgaacuuaucggacgggccagaauuagccagggcgcuggguggucucugcgggagaccgccugccucggcaaggcuuacgcccagauguggucccugauguauuuucauagacgcgaucugcggcucgcgagcauggccaucuguucugcuguccccacagagugguucccuaccuccagaacaacguggagcauccacgcccaucaccaguggaugaccacagaagacaugcugaagguguggaaucgcguguggauugaggauaaccccaauaugaccgacaagacaccuauccacuccugggaagacauucccuaccuuggaaaaagagaggaucuguggugcggcucucucaucgggcugagcucccgggcuaccugggccaagaacauucauacggcgaucacccaaguucgcaaucuuauuggaaaagaagaguaugucgacuacaugccugugaugaagagauauagcgcccccucugaguccgaaggcgugcuguga

SEQ ID NO: 20976 - RNA, 9867 nt, Artificial Sequence
  derived and/or modified CDS sequence (opt5) from DENV-4__GQ199880__SS-prME
agcaccaucacccugcuuugccugauucccacggugauggccuuccaccuuuccacccgggacggagagccucugaugaucgucgcuaagcaugaacgggggcgcccgcuccuguuuaagaccaccgagggaauuaacaaguguacccuuaucgccauggaucugggcgaaaugugcgaggacaccguuacauacaaguguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaccaucacaccuagaucccccagcguggaggucaaacuuccugauuacggagaacugacccucgacugcgagccccggucuggcaucgacuucaacgagaugauucugaugaagaugaaaaagaaaacauggcuggugcauaagcagugguuucucgaucugccgcuuccuuggaccgccggggcugacacguccgaaguucacuggaauuacaaagagagaauggugaccuucaaggucccccaugccaaacgccaggaugugacaguucugggcagccaggaaggagccaugcacuccgcucucgcgggcgccaccgagguggacucuggggauggaaaccacauguuugcuggccaucugaaguguaagguccggauggaaaaacuuagaaucaaggggaugagcuauacaaugugcuccggaaaauucagcauugacaaggagauggccgagacccaacacggcacgacaguggugaaaguuaaguacgaaggggccggcgcuccuuguaagguccccaucgagauucgcgaugugaauaaagaaaagguggucggacgggugaucucuuccacaccccuggccgagaacacaaacagcguuaccaauaucgagcucgaaccuccguucggcgacucuuauauugugaucggggucggaaacagcgcgcugacccugcauugguuuagaaaaggcuccucuauugggaagauguucgagagcacauaccgcggagcuaaacggauggccauccucggcgaaacggccugggauuuuggguccgugggcggacuguucaccagccuuggcaaggcuguucaccagguguuugggucugucuauacaaccauguucggaggcguguccuggaugauuagaauccugaucggguuucucguucuguggauuggaacaaauagccgcaacaccucuauggccaugacgugcaucgcugugggcgggauuacacuguuccuuggcuuuaccguccaggccgacaugggaugugugguguccuggagcggccgggagcucaagugcggguccggaaucuucgucguugauaaugugcauaccuggacagaacaauacaaauuucagcccgagucuccugcgagacuggccagcgcuauucugaacgcccacaaggacggcgugugugggauccgcuccaccacacggcucgagaaugucauguggaaacagauuacgaacgaacugaauuaugugcuuugggagggaggccacgaccugaccguuguggcuggcgaugucaagggggugcucacaaaaggaaagagagcccugacacccccuguuucugaccugaaguacagcuggaaaacauggggcaaggcgaaaaucuucacccccgaagcccggaacuccacguuucuuaucgaugggccggacaccagcgagugcccuaaugaacgcagagcuuggaacucucucgagguggaggauuacggauucggcauguucacaaccaauauuuggaugaaguuucgggaaggguccagcgaggucugugaccauagacugaugucugccgcuaucaaagaucagaaggccgugcacgccgacaugggauauuggauugaauccagcaaaaaccaaacauggcagaucgagaaggcuucucugauugaaguuaagaccugccucuggcccaaaacacauacccuguggagcaauggcgugcuugagucccagaugcugaucccuaagagcuacgcgggccccuucucucagcacaacuaucgccaaggguacgccacgcagacagucggaccuuggcaccucggcaaacuggagaucgauuuuggggaaugccccggaaccaccgugacaauucaggaggacugugaucaucggggcccgucccugagaaccacgacagcuagcgggaaacuugugacccaguggugcugucgcuccugcacaaugccuccccucagauuccugggagaagacggcuguugguauggcauggagauccggccccugaacgagaaagaagagaauauggucaagucucaaguuaccgccgggcagggaacaagcgaaaccuuuuccaugggccuccugugccuuacgcuguucguggaggaaugucuccgcagacgggugacccgcaagcacaugauucuggucgugguuaucacacugugcgccauuauccuugggggacucaccuggauggaucugcugagagcucucaucaugcugggcgacacaaugucugggcggauuggaggccagauccaucuugccauuauggcgguguuuaaaaugagcccuggcuacguccuggggguguuccuccgcaagcugaccuccagagagacggcucugaugguuaucggaauggccaugacaaccgugcuuucuauuccgcacgaccugauggagcucaucgauggcaucagccuggggcucauucugcuuaaaaucgucacacaguuugacaacacccaagugggaacccuggcccucucccugacauucauucggagcacgaugccccuggucauggcuuggcgcaccaucauggccgugcuuuuuguugugacacugauuccucucuguagaaccucuugccugcagaagcagucccauugggucgaaaucacagcgcucauucugggcgcucaagcccuucccguguaucugaugacccucaugaaaggggccagccggagaucuuggccucugaaugagggaaucauggcuguuggccuggugucccuucugggcagcgcccuccugaagaacgaugucccccucgcugggccuaugguggccggaggccugcuucuggcggccuacgugaugucuggguccagcgcugaccugucccucgaaaaggccgcuaauguucagugggaugagauggccgacaucacgggaagcucucccauuaucgaagucaaacaggaugaggacggcagcuucuccauucgcgauguggaggaaacaaacaugaucacccugcuugugaagcuggcccucauuaccgucucugggcuguacccgcucgcuaucccugugacaaugacccugugguauauguggcagguuaaaacacaacggagcggagcgcuuugggacgugcccuccccugccgcuacgcagaaggccgcccugucugagggcgucuacagaaucaugcagcgcggccuguuugggaaaacccaggugggaguuggcauucacauggaagggguguuccacacaauguggcaugucacccggggaagcgugaucugucacgagacaggcagacucgaacccuccugggcugauguucgcaaugacaugauuucuuaugggggaggcuggcggcugggcgauaagugggacaaggaggaggacgugcaaguccuugccaucgaaccggggaaaaacccuaagcaugugcagaccaaacccggacuguucaagacgcucaccggcgagauuggggcggugacacuggauuuuaaaccuggaaccagcggcucccccaucaucaauagaaaggggaaagucauuggccucuacggaaacggcguugugacaaagagcggggacuaugugucugcuaucacccaggccgaacgcauuggagagcccgauuacgaggucgacgaagauaucuuccggaagaaaagacugacaauuauggaccuucacccuggcgccgggaagacgaaacggauccugccguccauugugcgcgaggcucugaagagacggcuccgcacccugauccuugcccccacaagaguuguggcggcugaaauggaggaagcccugcggggacucccuaucagauaucagacccccgccgucaaaagcgagcauaccggccgcgagauuguggaucugaugugccacgcuacauuuacgacccggcuccugucuuccacaagaguuccuaauuacaaccuuaucgugauggacgaagcccacuucaccgaucccagcuccgucgcugcccgcggguacauuucuacacggguggagaugggcgaagcggccgcuaucuuuaugaccgccacgccuccgggagcuacagaccccuucccucaaagcaauucccccauugaggauaucgaaagagagaucccugagcgcagcuggaacaccggcuuugacuggauuaccgacuaucaggggaagacagucugguucgugcccucuaucaaggccggaaaugauauugccaacugccugcggaaauccggcaagaaaguuauccagcugagcagaaagaccuuugacacagaauacccgaaaaccaagcucacggauugggacuucguggugacaaccgauauuucugagaugggggcuaacuuucgcgcgggaagagucaucgacccucggcgcugucugaagcccguuauccuuacagauggccccgaaagagugauucuggccgggccuauccccgugaccccugcuagcgccgcccaacggcgcggcagaauuggacggaauccggcucaggaggacgaucaguaugucuucuccggcgacccccucaaaaacgaugaagaccaugcccacuggacggaggcgaagaugcugcuggauaauaucuacaccccugaggggauuauccccacacucuucggaccugaaagagagaaaacccaggcuauugacggcgaauuucgccuuagaggggaacaaagaaagacauucguggagcugaugcgccggggagaccugcccguuuggcucucuuauaaaguggccagcgccggcaucuccuacaaggauagagaauggugcuuuaccggcgagcggaacaaucagauccuggaagagaacauggaagucgagauuuggacacgcgagggggaaaagaagaaacuuagaccgcgguggcuggacgcucgcguguaugccgauccuauggcgcucaaagacuucaaagaguuugccucuggaagaaaaagcaucacccuggauauucugacggaaaucgcuucccuccccacauaccuuagcucucgggccaagcuggcucuggacaauauugucaugcuccauaccaccgagcgcggcgggagagccuaccagcacgcucugaacgaacuuccugagucccuggagacacucaugcugguggcccugcucggagcgaugaccgccggcaucuuccucuuuuucaugcaggggaagggaaucggcaaacugagcaugggccugauugcuaucgccguugcuuccgggcuccuguggguggccgaaauucaaccccaguggaucgccgcuucuauuauccuugaguuuuuccugaugguccuccugaucccugaacccgagaagcagcggacaccgcaggauaaucaacugauuuaugugauccucacgauucuuaccaucauuggacugaucgcggccaacgaaaugggccugauugagaaaacaaagaccgacuuuggguucuaccagguuaaaacagagaccacgauccucgauguggaccugcgcccugcuagcgccuggacccuuuaugccgucgcuacaaccauccugacacccaugcucagacacaccauugaaaauacguccgccaaccugucucuggcggccaucgcuaaucaggccgcugugcucaugggacuuggcaagggguggccccugcaucggauggaucugggagugccucuccuggccaugggcuguuacagccagguuaacccgacaacccuuacagcgucccuggucaugcuccuggugcacuaugccauuaucggccccgggcugcaagcuaaagccaccagagaggcucagaagcgcaccgccgcuggaauuaugaagaauccuacaguggacggcaucacggucaucgaucucgaacccauuagcuacgacccuaaauuugagaagcagcuugggcaaguuaugcugcuggugcucugcgccggacagcugcuucugaugcggaccacaugggcguucugugaggugcucacccuggccacaggccccauccugacccucugggaagggaacccuggaagauucuggaacacgacaauugcugucucuaccgccaauaucuuucgcggcuccuaucuugcuggcgccgggcuggccuucagccugauuaaaaacgcgcagaccccgcggagaggaacaggcaccacaggggagacgcucggagaaaaguggaaacgccagcucaauucucuugaccggaaggaguuugaagaguacaagagauccggcauccuggagguggaucgcaccgaagcuaaaagcgcccucaaggacgggucuaaaacaaagcaugcuguuagccggggauccucuaaaaucagauggauuguggagcgcggcauggucaagcccaagggcaaagugguugaucuggggugcggacggggcggguggagcuacuauauggccacccugaagaacgugacagaagucaaaggauacaccaagggcgggccuggacacgaggaacccaucccuauggccacguauggcuggaaucucgugaaacuucauuccggcguggacgucuucuacaagcccaccgagcaaguugauacacugcugugugacauuggggagagcuccucuaacccgaccaucgaagagggaagaacacuccgcgugcugaagaugguggaaccuuggcuuagcuccaaacccgaguuuugcauuaagguccugaaucccuauaugccuaccgugaucgaagaacuggagaaacugcagagaaagcacggcgggaaccugguucgguguccccucucucgcaauagcacacacgaaauguacuggguguccggagcuucuggcaacauugucagcuccgugaauaccacgagcaaaaugcuucugaacagauucacaacccggcauagaaagccuaccuaugagaaagauguugaccugggggccggaacacggucuguguccacggaaaccgagaagccggauaugacaaucaucggccgcagacuccagcggcugcaggaggaacacaaggagaccuggcauuacgaccaagaaaaucccuaccgcacaugggcguaucacggcagcuacgaggccccuucuaccggguccgcuagcucuauggucaacggagugguuaaacuucugacaaagcccugggaugugauuccuauggucacccagcucgccaugacggacaccacacccuuuggccagcagagaguguucaaagaaaaggucgacacccggacaccgcaaccuaaacccgggacccgcaugaucaugacgacaaccgcuaauuggcugugggcccugcucggaaagaagaaaaacccuagacugugcacacgggaggaguuuauuuccaaggugcgcagcaaugcggccaucggcgcuguuuuccaggaggagcagggguggaccuccgccagcgaagcugugaacgauucuagauuuugggagcuugucgacaaagaacgggcccugcaccaagagggcaagugugagagcugcguguauaacaugaugggaaaacgcgaaaagaagcucggcgaguucgggagagcuaaaggaucccgggccauuugguacauguggcugggcgcgcgcuuucuugaguucgaggcccugggguuccucaaugaagaucauugguuuggaagagagaacucuuggagcggcguggagggggaaggccugcaccggcugggauauauccucgaggaaaucgacaagaaagauggcgaccugauguacgcugaugacacggccgggugggauaccagaauuacagaggacgaucuucagaaugaggaacugaucaccgagcagauggcuccccaucacaagauucucgccaaagccaucuucaagcugacauaucagaacaagguugugaaaguccuucgcccuacaccccggggagcggugauggacauuaucuccagaaaggaucaacgcggcucugggcagguuggaacauacggccugaauaccuuuacgaacauggaagugcagcucauccggcagauggaggcugaaggggucauuacacaagacgacaugcagaauccgaaaggccugaaggagagaguggagaaauggcugcgcgaaugcggagucgaucggcucaagagaauggccaucagcggcgacgauugugugguuaaaccucuggacgagcgcuucgggaccucccuucuguuucucaacgauaugggaaaggugcggaaggacauuccccagugggaacccucuaaaggcuggaagaauuggcaggaggucccuuucugcagccaucacuuucacaaaaucuucaugaaggaugggagaucccuggugguuccgugucgcaaccaagacgaacuuauuggacgggccagaaucagccagggcgcuggguggucucugcgggagaccgccugccucggcaaggcuuacgcccagauguggucccugauguauuuucauagacgcgaucugcggcucgcgagcauggccaucuguucugcugugcccacagagugguucccuaccuccagaacaacguggagcauucacgcccaucaccaguggaugaccacagaagacaugcugaaggucuggaaucgcguguggaucgaggauaaccccaauaugaccgacaagacaccuauucacuccugggaagacauccccuaccuuggaaaaagagaggaucuguggugcggcucucucauugggcugagcucccgggcuaccugggccaagaacauccauacggcgauuacccaagugcgcaaucuuaucggaaaagaagaguauguugacuacaugccugucaugaagagauauagcgcccccucugaguccgaaggcgugcuguga

SEQ ID NO: 20977 - RNA, 9867 nt, Artificial Sequence
  derived and/or modified CDS sequence (opt5) from DENV-4__GQ252675__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaccaucacaccuagaucccccagcguggaggucaagcuuccugauuacggagaacugacccucgacugcgagccccggucuggcaucgacuucaacgagaugauucugaugaagaugaaaaagaaaacauggcuggugcauaagcagugguuucucgaucugccgcuuccuuggaccgccggggcugacacguccgaaguucacuggaauuacaaagagagaauggugaccuucaaggucccccaugccaaacgccaggaugugacaguucugggcagccaggaaggagccaugcacuccgcucucgcgggcgccaccgagguggacucuggggauggaaaccacauguuugcuggccaucugaaguguaagauccggauggaaaaacuuagaauuaaggggaugagcuauacaaugugcuccggaaaauucagcaucgacaaggagauggccgagacccaacacggcacgacagucgugaaagugaaguacgaaggggccggcgcuccuuguaagguucccauugagauccgcgaugucaauaaagaaaagguggugggacgggucaucucuuccaccccccuggccgagaacacaaacagcgugaccaauauugagcucgaaccuccguucggcgacucuuauaucguuauuggggugggaaacagcgcgcugacccugcauugguuuagaaaaggcuccucuaucgggaagauguucgagagcacauaccgcggagcuaaacggauggccauucucggcgaaacggccugggauuuuggguccgucggcggacuguucaccagccuuggcaaggcugugcaccagguuuuugggucuguguauacaaccauguucggaggcgucuccuggaugaucagaauccugauuggguuucucgugcuguggaucggaacaaauagccgcaacaccucuauggccaugacgugcauugcuguuggcgggaucacacuguuccuuggcuuuaccgugcaggccgacaugggaugugucguguccuggagcggccgggagcucaagugcggguccggaauuuucguggucgauaauguucauaccuggacagaacaauacaaauuucagcccgagucuccugcgagacuggccagcgcuauccugaacgcccacaaggacggcgugugugggauucgcuccaccacacggcucgagaaugugauguggaaacagaucacgaacgaacugaauuauguccuuugggagggaggccacgaccugaccgugguugcuggcgaugugaaggggguccucacaaaaggaaagagagcccugacccccccugugucugaccugaaguacagcuggaaaacauggggcaaggcgaaaaucuucacccccgaagcccggaacuccacguuucuuauugaugggccggacaccagcgagugcccuaaugaacgcagagcuuggaacucucucgagguugaggauuacggauucggcauguucacaaccaauaucuggaugaaguuucgggaaggguccagcgaggugugugaccauagacugaugucugccgcuauuaaagaucagaaggccguccacgccgacaugggauauuggaucgaauccagcaaaaaccaaacauggcagauugagaaggcuucucugaucgaagugaagaccugccucuggcccaaaacacauacccuguggagcaauggcguucuugagucccagaugcugaucccuaagagcuacgcgggccccuucucucagcacaacuaucgccaaggguacgccacgcagacagugggaccuuggcaccucggcaaacuggagauugauuuuggggaaugccccggaaccaccgucacaauccaggaggacugugaucaucggggcccgucccugagaaccacgacagcuagcgggaagcuugugacccaguggugcugucgcuccugcacaaugccuccccucagauuccugggagaagacggcuguugguauggcauggagauucggccccugaacgagaaagaagagaauauggugaagucucaagucaccgccgggcagggaacaagcgaaaccuuuuccaugggccuccugugccuuacgcuguucguugaggaaugucuccgcagacgggugacccgcaagcacaugaugcugguggucgugaucacacugugcgccauuauccuugggggacucaccuggauggaucugcugagagcucucaucaugcugggcgacacaaugucugggcggauuggaggccagauccaucuugccauuauggcgguuuuuaaaaugagcccuggcuacgugcugggggucuuccuccgcaagcugaccuccagagagacggcucugauggugaucggaauggccaugacaaccguucuuucuauuccgcacgaccugauggagcucaucgauggcaucagccuggggcucauucugcuuaaaacagugacccaguuugacaacacccaagucggaacacuggcccucucccugacguucauccggagcaccaugccccuggugauggcuuggcgcacaauuauggccguccuuuuugugguuacccugaucccucucuguagaacaucuugccugcagaagcagucccauuggguggaaauuaccgcgcucauccugggcgcucaagcccuucccgucuaucugaugacgcucaugaaaggggccagccggagaucuuggccucugaaugagggaauuauggcugugggccugguuucccuucugggcagcgcccuccugaagaacgaugugccccucgcugggccuauggucgccggaggccugcuucuggcggccuacgugaugucuggguccagcgcugaccugucccucgaaaaggccgcuaaugugcagugggaugagauggccgacaucacaggaagcucucccaucauugaaguuaaacaggaugaggacggcagcuucuccauccgcgaugucgaggaaaccaacaugauuacccugcuugugaagcuggcccucaucacagugucugggcuguacccgcucgcuauuccugucaccaugacacugugguauauguggcaggugaaaacgcaacggagcggagcgcuuugggacguucccuccccugccgcuacccagaaggccgcccugucugagggcguguacagaaucaugcagcgcggccuguuugggaaaacacaggucggagugggcauccacauggaagggguuuuccacaccauguggcaugugacacggggaagcgucauuugucacgagaccggcagacucgaacccuccugggcugaugugcgcaaugacaugaucucuuaugggggaggcuggcggcugggcgauaagugggacaaggaggaggacguucaagugcuugccauugaaccggggaaaaacccuaagcauguccagacgaaacccggacuguucaagacccucacaggcgagaucggggcggugacccuggauuuuaaaccuggaacaagcggcucccccauuaucaauaagaaagggaaggugaucggccucuacggaaacggcgucguuaccaagagcggggacuaugugucugcuauuacacaggccgaaagaaucggagagcccgauuacgagguggacgaagauauuuuccgcaaaaagcggcugacgaucauggaccuucacccuggcgccgggaaaaccaagagaauucugccguccaucguccgggaggcucugaaacgcagacuccggacacugauucuugcccccacccgcgugguugcggcugaaauggaggaagcccugagaggacucccuauccgguaucagacccccgccgugaagagcgagcauacaggcagagagaucgucgaucugaugugccacgcuacguuuaccacacgccuccugucuuccacccgggugccuaauuacaaccuuauuguuauggacgaagcccacuucacagaucccagcuccguggcugccagaggguacaucucuacccgcgucgagaugggcgaagcggccgcuauuuuuaugacggccacaccuccgggagcuaccgaccccuucccucaaagcaauucccccaucgaggauauugaacgggagaucccugagagaagcuggaacaccggcuuugacuggaucacagacuaucaggggaagaccgugugguucguccccucuauuaaagccggaaaugauaucgccaacugccugcgcaaguccggcaaaaaggugauucagcugagccggaaaacauuugacaccgaauacccgaagacgaagcucacagauugggacuucguugugaccacagauaucucugagaugggggcuaacuuuagagcgggacgcgugauugacccuagacggugucugaaacccgucauccuuaccgauggccccgaacgcguuauccuggccgggccuauucccgugacgccugcuagcgccgcccaaagacggggccgcaucggaagaaauccggcucaggaggacgaucaguauguguucuccggcgacccccucaagaacgaugaagaccaugcccacuggaccgaggcgaaaaugcugcuggauaauauuuacacaccugaggggaucauucccacccucuucggaccugaacgggagaagacacaggcuaucgacggcgaauuuagacuucgcggggagcaacggaaaaccuucgucgagcugaugagacgcggagaccugcccguguggcucucuuauaagguugccagcgccggcauuuccuacaaggaucgggaauggugcuuuacaggcgagagaaacaaucagauccuggaagagaacauggaaguggagaucuggacccgggagggggaaaaaaagaaacuucgcccgagauggcuggacgcucgggucuaugccgauccuauggcgcucaaggacuucaaagaguuugccucuggacgcaagagcauuacgcuggauauccugacagaaauugcuucccuccccaccuaccuuagcucuagagccaagcuggcucuggacaauaucgugaugcuccauaccacagagcggggcgggcgcgccuaccagcacgcucugaacgaacuuccugagucccuggagacccucaugcuggucgcccugcucggagcgaugacagccggcauuuuccuuuuuuucaugcaggggaaaggaaucggcaagcugagcaugggccugaucgcuauugccguggcuuccgggcuccuguggguugccgaaauccaaccccaguggauugccgcuucuaucauucuugaguuuuuccugauggugcuccugaucccugaacccgagaaacagagaacgccgcaggauaaucaacugaucuaugucauucucaccauccuuacaauuaucggacugauugcggccaacgaaaugggccugaucgagaagaccaaaacagacuuuggguucuaccaggugaagaccgagacgaccauucucgauguugaccugcggccugcuagcgccuggacacuuuaugccguggcuaccacaauccugacccccaugcuccgccacacgaucgaaaauacauccgccaaccugucucuggcggccauugcuaaucaggccgcuguccucaugggacuuggcaaaggguggccccugcauagaauggaucugggagugccucuccuggccaugggcuguuacagccaggugaacccgaccacacuuaccgcgucccugguuaugcuccugguccacuaugccaucauuggccccgggcugcaagcuaaggccacccgggaggcucagaagagaacagccgcuggaaucaugaaaaauccuacgguggacggcauuaccgugaucgaucucgaacccaucagcuacgacccuaaguuugagaaacagcuugggcaagucaugcugcugguucucugcgccggacagcugcuucugaugcgcacaaccugggcguucugugaggugcucacacuggccaccggccccauucugacgcucugggaagggaacccuggacgguucuggaacacaaccaucgcugugucuaccgccaauauuuuuagaggcuccuaucuugcuggcgccgggcuggccuucagccugaucaagaacgcgcagacaccgcgccggggaaccggcacaacgggggagacccucggagaaaaauggaagagacagcugaauucucuugaccgcaaggaguuugaagaguacaaacgguccggcauucuggaggucgauagaacagaagcuaagagcgcccucaaagacgggucuaagaccaaacaugcugugagccgcggauccucuaagauccgguggaucguugagagaggcauggugaagcccaaaggcaaggucguggaucuggggugcggacgcggcggguggagcuacuauauggccacacugaaaaacguuaccgaagugaagggauacacgaaaggcgggccuggacacgaggaacccauuccuauggccaccuauggcuggaaucucgucaagcuucauuccggcguggacguguucuacaagcccacagagcaagucgauacccugcugugugacaucggggagagcuccucuaacccgacaauugaagagggacggacccucagaguucugaaaaugguggaaccuuggcuuagcuccaagcccgaguuuugcaucaaagugcugaaucccuauaugccuacagucauugaagagcucgagaagcugcagcgcaaacacggcgggaaccuggugagauguccccucucucggaauagcacccacgaaauguacuggguuuccggagcuucuggcaacaucgugagcuccgucaauacgacaagcaagaugcuucugaaccgcuucaccaccagacaucggaaaccuacauaugagaaggauguggaccugggggccggaacgagaucuguuuccaccgaaacagagaagccggauaugaccauuaucggccggcgccuccagagacugcaggaggaacacaaagagacauggcauuacgaccaagaaaaucccuaccggaccugggcguaucacggcagcuacgaggccccuucuacaggguccgcuagcucuauggugaacggagucgugaagcuucugaccaaacccugggauguuaucccuauggugacgcagcucgccaugaccgacacaacccccuuuggccagcagcgcgucuucaaggaaaaaguggacacaagaaccccgcaaccuaagcccgggacgcggaugauuaugacaaccacagcuaauuggcugugggcccugcucggaaagaaaaagaacccucgccugugcaccagagaggaguuuaucuccaaaguccggagcaaugcggccauuggcgcuguguuccaggaagagcagggguggacguccgccagcgaagcuguuaacgauucucgcuuuugggagcuuguggacaaggaaagagcccugcaccaagagggcaaaugugagagcugcgucuauaacaugaugggaaagcgggaaaagaaacucggcgaguucgggcgcgcuaagggauccagagccaucugguacauguggcugggcgcgcgguuucuugaauucgaggcccugggguuccucaaugaagaucauugguuuggacgcgagaacucuuggagcggcguggagggggaaggccugcacagacugggauauauucucgaggaaaucgacaaaaaggauggcgaccugauguacgcugaugacaccgccgggugggauacacggaucaccgaggacgaucuucagaaugaggaacugauuacagagcagauggcuccccaucacaaaauccucgccaaggccauuuucaagcugaccuaucagaacaaagugguuaaggugcuuagaccuacaccccgcggagcggucauggacaucauuucccggaaagaucaaagaggcucugggcaggugggaaccuacggccugaauacguuuacaaacauggaaguucagcucauccgccagauggaggcugaaggggugaucacccaagacgacaugcagaauccgaagggccugaaagagcgggucgagaaguggcugagagaaugcggaguggaucgccucaaacggauggccauuagcggcgacgauugugucgugaagccucuggacgagagauucgggaccucccuucuguuucucaacgauaugggaaagguucgcaaagacaucccccagugggaacccucuaagggcuggaaaaauuggcaggaggugccuuucugcagccaucacuuucacaagauuuucaugaaagaugggcggucccuggucgugccguguagaaaccaagacgaacuuaucggacgcgcccggauuagccagggcgcuggguggucucugagagagacagccugccucggcaaggcuuacgcccagauguggucccugauguauuuucaucggagagaucugcgccucgcgagcauggccaucuguucugcuguucccaccgagugguucccuacaucccggacgaccuggagcauccacgcccaucaccaguggaugacaaccgaagacaugcugaagguguggaauagagucuggauugaggauaaccccaauaugacagacaaaaccccuauccacuccugggaagacauucccuaccuuggaaagcgcgaggaucuguggugcggcucucucaucgggcugagcuccagagcuacgugggccaaaaacauucauaccgcgaucacacaagugcggaaucuuauuggaaaggaagaguauguggacuacaugccuguuaugaaacgcuauagcgcccccucugaguccgaaggcguccuguga

SEQ ID NO: 20978 - RNA, 9867 nt, Artificial Sequence
  derived and/or modified CDS sequence (opt5) from DENV-4__FJ810417__SS-prME
agcacaaucacgcugcuuugccugauucccacggugauggccuuccaccuuuccacccgggacggagagccucugaugaucgucgcuaagcaugaacgggggcgcccgcuccuguuuaagacaaccgagggaauuaacaaguguacacuuaucgccauggaucugggcgaaaugugcgaggacaccguuacauacaaguguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaccaucacaccuagaucccccagcguggaggucaaacuuccugauuacggagaacugacccucgacugcgagccccggucuggcaucgacuucaacgagaugauucugaugaagaugaaaaagaaaacauggcuggugcauaagcagugguuucucgaucugccgcuuccuuggaccgccggggcugacacguccgaaguucacuggaauuacaaagagagaauggugaccuucaaggucccccaugccaaacgccaggaugugacaguucugggcagccaggaaggagccaugcacuccgcucucgcgggcgccaccgagguggacucuggggauggaaaccacauguuugcuggccaucugaaguguaagguccggauggaaaaacuuagaaucaaggggaugagcuauacaaugugcuccggaaaauucagcauugacaaggagauggccgagacccaacacggcacgacaguggugaaaguuaaguacgaaggggccggcgcuccuuguaagguccccaucgagauucgcgaugugaauaaagaaaagguggucggacgggugaucucuuccaucccccuggccgagaacaccaacagcguuacaaauauugagcucgaaccuccguucggcgacucuuauaucgugauuggggucggaaacagcgcgcugacccugcauugguuuagaaaaggcuccucuaucgggaagauguucgagagcaccuaccgcggagcuaaacggauggccauucucggcgaaacagccugggauuuuggguccgugggcggacuguucacgagccuuggcaaggcuguucaccagguguuugggucugucuauaccacaauguucggaggcguguccuggaugaucagaauccugauuggguuucucguucuguggaucggaaccaauagccgcaacacaucuauggccaugaccugcauugcugugggcgggaucacgcuguuccuuggcuuuacaguccaggccgacaugggaugugugguguccuggagcggccgggagcucaagugcggguccggaauuuucgucguugauaaugugcauaccuggaccgaacaauacaaauuucagcccgagucuccugcgagacuggccagcgcuauccugaacgcccacaaggacggcgugugugggauucgcuccacaacccggcucgagaaugucauguggaaacagaucacaaacgaacugaauuaugugcuuugggagggaggccacgaccugacgguuguggcuggcgaugucaagggggugcucaccaaaggaaagagagcccugacacccccuguuucugaccugaaguacagcuggaaaaccuggggcaaggcgaaaaucuucacacccgaagcccggaacuccaccuuucuuauugaugggccggacacgagcgagugcccuaaugaacgcagagcuuggaacucucucgagguggaggauuacggauucggcauguucaccacaaauaucuggaugaaguuucgggaaggguccagcgaggucugugaccauagacugaugucugccgcuauuaaagaucagaaggccgugcacgccgacaugggauauuggaucgaauccagcaaaaaccaaaccuggcagauugagaaggcuucucugaucgaaguuaagacaugccucuggcccaaaacccauacacuguggagcaauggcgugcuugagucccagaugcugaucccuaagagcuacgcgggccccuucucucagcacaacuaucgccaaggguacgccacccagacggucggaccuuggcaccucggcaaacuggagauugauuuuggggaaugccccggaacaaccgugaccauccaggaggacugugaucaucggggcccgucccugagaacaaccacggcuagcgggaaacuugugacacaguggugcugucgcuccugcaccaugccuccccucagauuccugggagaagacggcuguugguauggcauggagauucggccccugaacgagaaagaagagaauauggucaagucucaaguuacagccgggcagggaaccagcgaaacauuuuccaugggccuccugugccuuacccuguucguggaggaaugucuccgcagacgggugacgcgcaagcacaugauccuggucgugguuauuacccugugcgccaucauccuugggggacucacauggauggaucugcugagagcucucauuaugcugggcgacaccaugucugggcggaucggaggccagauucaucuugccaucauggcgguguuuaaaaugagcccuggcuacguccuggggguguuccuccgcaagcugacauccagagagaccgcucugaugguuauuggaauggccaugacgacagugcuuucuaucccgcacgaccugauggagcucaucgauggcauuagccuggggcucauccugcuuaaaauugucacccaguuugacaacacacaagugggaacccuggcccucucccugaccuucauccggagcacaaugccccuggucauggcuuggcgcacgauuauggccgugcuuuuuguugugacccugaucccucucuguagaacaucuugccugcagaagcagucccauugggucgaaauuaccgcgcucauccugggcgcucaagcccuucccguguaucugaugacacucaugaaaggggccagccggagaucuuggccucugaaugagggaaucauggcuguuggccuggugucccuucugggcagcgcccuccugaagaacgaugucccccucgcugggccuaugguggccggaggccugcuucuggcggccuacgugaugucuggguccagcgcugaccugucccucgaaaaggccgcuaauguucagugggaugagauggccgacauuaccggaagcucucccaucauugaagucaaacaggaugaggacggcagcuucuccauccgcgauguggaggaaacgaacaugauuacacugcuugugaagcuggcccucaucaccgucucugggcuguacccgcucgcuaucccugugaccaugacacugugguauauguggcagguuaaaacccaacggagcggagcgcuuugggacgugcccuccccugccgcuacacagaaggccgcccugucugagggcgucuacagaauuaugcagcgcggccuguuugggaaaacacaggugggaguuggcauccacauggaagggguguuccacaccauguggcaugucacacggggaagcgugauuugucacgagaccggcagacucgaacccuccugggcugauguucgcaaugacaugaucucuuaugggggaggcuggcggcugggcgauaagugggacaaggaggaggacgugcaaguccuugccauugaaccggggaaaaacccuaagcaugugcagacaaaacccggacuguucaagacccucacgggcgagaucggggcggugacccuggauuuuaaaccuggaacaagcggcucccccaucauuaauagaaaggggaaagucaucggccucuacggaaacggcguugugaccaagagcggggacuaugugucugcuauuacacaggccgaacgcaucggagagcccgauuacgaggucgacgaagauauuuuccggaagaaaagacugaccaucauggaccuucacccuggcgccgggaagacaaaacggauucugccguccaucgugcgcgaggcucugaagagacggcuccgcacgcugauccuugcccccaccagaguuguggcggcugaaauggaggaagcccugcggggacucccuauuagauaucagacacccgccgucaaaagcgagcauaccggccgcgagaucguggaucugaugugccacgcuaccuuuacaacgcggcuccugucuuccaccagaguuccuaauuacaaccuuauugugauggacgaagcccacuucacagaucccagcuccgucgcugcccgcggguacaucucuacccggguggagaugggcgaagcggccgcuauuuuuaugacagccaccccuccgggagcuacggaccccuucccucaaagcaauucccccaucgaggauaucgaaagagagauuccugagcgcagcuggaacacaggcuuugacuggaucaccgacuaucaggggaagaccgucugguucgugcccucuauuaaggccggaaaugauaucgccaacugccugcggaaauccggcaagaaaguuauucagcugagcagaaagacauuugacaccgaauacccgaaaacaaagcucaccgauugggacuucguggugacgacagauaucucugagaugggggcuaacuuucgcgcgggaagagucaucgacccucggcgcugucugaagcccguuauucuuaccgauggccccgaaagagugauccuggccgggccuauucccgugaccccugcuagcgccgcccaacggcgcggcagaaucggacggaauccggcucaggaggacgaucaguaugucuucuccggcgacccccucaaaaacgaugaagaccaugcccacuggaccgaggcgaagaugcugcuggauaauauuuacacgccugaggggaucauucccacccucuucggaccugaaagagagaaaacacaggcuaucgacggcgaauuucgccuuagaggggaacaaagaaagaccuucguggagcugaugcgccggggagaccugcccguuuggcucucuuauaaaguggccagcgccggcaucuccuacaaggauagagaauggugcuuuacaggcgagcggaacaaucagauucuggaagagaacauggaagucgagaucuggacccgcgagggggaaaagaagaaacuuagaccgcgguggcuggacgcucgcguguaugccgauccuauggcgcucaaagacuucaaagaguuugccucuggaagaaaaagcauuacacuggauauccugaccgaaauugcuucccuccccacguaccuuagcucucgggccaagcuggcucuggacaauaucgucaugcuccauacaaccgagcgcggcgggagagccuaccagcacgcucugaacgaacuuccugagucccuggagacccucaugcugguggcccugcucggagcgaugacagccggcaucuuccucuuuuucaugcaggggaagggaauuggcaaacugagcaugggccugaucgcuauugccguugcuuccgggcuccuguggguggccgaaauccaaccccaguggauugccgcuucuaucauccuugaguuuuuccugaugguccuccugauuccugaacccgagaagcagcggaccccgcaggauaaucaacugaucuaugugauucucacaauccuuacgauuaucggacugauugcggccaacgaaaugggccugaucgagaaaaccaagacagacuuuggguucuaccagguuaaaaccgagacaaccauccucgauguggaccugcgcccugcuagcgccuggacgcuuuaugccgucgcuaccacaauucugacccccaugcucagacacacaaucgaaaauaccuccgccaaccugucucuggcggccauugcuaaucaggccgcugugcucaugggacuuggcaagggguggccccugcaucggauggaucugggagugccucuccuggccaugggcuguuacagccagguuaacccgacgacacuuaccgcgucccuggucaugcuccuggugcacuaugccaucauuggccccgggcugcaagcuaaagccacaagagaggcucagaagcgcaccgccgcuggaaucaugaagaauccuaccguggacggcaucacagucauugaucucgaacccaucagcuacgacccuaaauuugagaagcagcuugggcaaguuaugcugcuggugcucugcgccggacagcugcuucugaugcggacgaccugggcguucugugaggugcucacacuggccaccggccccauucugacacucugggaagggaacccuggaagauucuggaacaccacgaucgcugucucuacagccaauauuuuucgcggcuccuaucuugcuggcgccgggcuggccuucagccugaucaaaaacgcgcagaccccgcggagaggaaccggcacaaccggggagacacucggagaaaaguggaaacgccagcucaauucucuugaccggaaggaguuugaagaguacaagagauccggcauccuggagguggaucgcacggaagcuaaaagcgcccucaaggacgggucuaaaaccaagcaugcuguuagccggggauccucuaaaauuagauggaucguggagcgcggcauggucaagcccaagggcaaagugguugaucuggggugcggacggggcggguggagcuacuauauggccacacugaagaacgugaccgaagucaaaggauacacaaagggcgggccuggacacgaggaacccauuccuauggccaccuauggcuggaaucucgugaaacuucauuccggcguggacgucuucuacaagcccacggagcaaguugauacccugcugugugacaucggggagagcuccucuaacccgacaauugaagagggaagaacccuccgcgugcugaagaugguggaaccuuggcuuagcuccaaacccgaguuuugcaucaagguccugaaucccuauaugccuacagugauugaagaacuggagaaacugcagagaaagcacggcgggaaccugguucgguguccccucucucgcaauagcacccacgaaauguacuggguguccggagcuucuggcaacaucgucagcuccgugaauacaaccagcaaaaugcuucugaacagauucacgacacggcauagaaagccuaccuaugagaaagauguugaccugggggccggaacccggucuguguccacagaaacggagaagccggauaugaccaucauuggccgcagacuccagcggcugcaggaggaacacaaggagacauggcauuacgaccaagaaaaucccuaccgcaccugggcguaucacggcagcuacgaggccccuucuacaggguccgcuagcucuauggucaacggagugguuaaacuucugaccaagcccugggaugugaucccuauggucacacagcucgccaugaccgacacgacccccuuuggccagcagagaguguucaaagaaaaggucgacacacggaccccgcaaccuaaacccgggacacgcaugauuaugaccacgacagcuaauuggcugugggcccugcucggaaagaagaaaaacccuagacugugcacccgggaggaguuuaucuccaaggugcgcagcaaugcggccauuggcgcuguuuuccaggaggagcagggguggacauccgccagcgaagcugugaacgauucuagauuuugggagcuugucgacaaagaacgggcccugcaccaagagggcaagugugagagcugcguguauaacaugaugggaaaacgcgaaaagaagcucggcgaguucgggagagcuaaaggaucccgggccaucugguacauguggcugggcgcgcgcuuucuugaguucgaggcccugggguuccucaaugaagaucauugguuuggaagagagaacucuuggagcggcguggagggggaaggccugcaccggcugggauauauccucgaggaaauugacaagaaagauggcgaccugauguacgcugaugacaccgccgggugggauacgagaaucaccgaggacgaucuucagaaugaggaacugauuacagagcagauggcuccccaucacaagauccucgccaaagccauuuucaagcugaccuaucagaacaagguugugaaaguccuucgcccuacaccccggggagcggugauggacaucaucuccagaaaggaucaacgcggcucugggcagguuggaaccuacggccugaauacauuuaccaacauggaagugcagcucauucggcagauggaggcugaaggggucaucacgcaagacgacaugcagaauccgaaaggccugaaggagagaguggagaaauggcugcgcgaaugcggagucgaucggcucaagagaauggccauuagcggcgacgauugugugguuaaaccucuggacgagcgcuucgggacaucccuucuguuucucaacgauaugggaaaggugcggaaggacaucccccagugggaacccucuaaaggcuggaagaauuggcaggaggucccuuucugcagccaucacuuucacaaaauuuucaugaaggaugggagaucccuggugguuccgugucgcaaccaagacgaacuuaucggacgggccagaaucagccagggcgcuggguggucucugcgggagaccgccugccucggcaaggcuuacgcccagauguggucccugauguauuuucauagacgcgaucugcggcucgcgagcauggccauuuguucugcugugcccaccgagugguucccuacauccagaaccacauggagcauccacgcccaucaccaguggaugacgaccgaagacaugcugaaggucuggaaucgcguguggauugaggauaaccccaauaugacagacaagaccccuauccacuccugggaagacauucccuaccuuggaaaaagagaggaucuguggugcggcucucucaucgggcugagcucccgggcuacaugggccaagaacauucauaccgcgaucacgcaagugcgcaaucuuaucggaaaagaagaguauguugacuacaugccugucaugaagagauauagcgcccccucugaguccgaaggcgugcuguga

SEQ ID NO: 20979 - RNA, 9867 nt, Artificial Sequence
  derived and/or modified CDS sequence (opt5) from DENV-4__FJ850057__SS-prME
agcaccaucacccugcuuugccugauucccacggccauggcuuuccaucuuuccacccgggacggagagccucugaugaucguggccaagcaugaacgggggcgcccgcuccuguuuaagacaaccgaggggauuaacaaguguacccuuaucgcgauggaucugggcgaaaugugcgaggacaccgucacauacaaguguccccuccugguuaauaccgaaccugaggauauugacugcugguguaaccugacgucuaccugggugauguaugggacaugcacccagagcggagagagacggcgcgaaaagagauccguggcucucacaccccacucuggcauggggcuggagacccgggccgaaacguggaugagcuccgagggagccuggaagcaugcucagcgcgucgagucuuggauccuuagaaauccuggcuucgcccugcucgcuggcuuuauggccuacaugaucgggcagacaggcauucagcggaccguguucuuuguucugaugaugcuuguggcgcccagcuauggcaugcgcugugucggggugggaaacagagauuucguugaaggcguguccgggggagccugggucgaccuggugcucgagcacggcggcugcgugacaaccauggcucaggggaagccuacccuggauuuugaacugacaaagacgaccgccaaagaggucgcucuccugcggacauacuguaucgaagccagcauuucuaauaucaccacagcgacccgcugcccgacgcaaggagagcccuaucuuaaggaggaacaggaccagcaguacauuuguagacgggauguuguggaccgcggcugggggaacggaugcggccuguucgggaaaggaggcguggucacaugcgccaaguuuuccuguagcggcaaaaucaccgggaaucucgugcaaauugagaaccuggaauauaccguuguggucacagugcauaauggagauacccacgcuguuggcaacgacacaucuaaucacggggugacggccaccaucacaccuagaucccccagcgucgaggugaaacuuccugauuacggagaacugacccucgacugcgagccccggucuggcaucgacuucaacgagaugauucugaugaagaugaaaaagaaaacauggcugguccauaagcagugguuucucgaucugccgcuuccuuggaccgcuggggccgacacguccgaagugcacuggaauuacaaagagagaaugguuaccuucaaggugccccaugccaaacgccaggaugucacagugcugggcagccaggaaggagcuaugcacuccgcgcucgccggcgcuaccgagguugacucuggggauggaaaccacauguuugccggccaucugaaguguaaggugcggauggaaaaacuuagaaucaaggggaugagcuauacaaugugcuccggaaaauucagcauugacaaggagauggccgagacccaacacggcacgacagucgugaaagugaaguacgaaggggcuggcgccccuuguaagguucccaucgagauucgcgaugucaauaaagaaaagguggugggacgggucaucucuuccacaccccuggcggagaacacaaacagcgugaccaauaucgagcucgaaccuccguucggcgacucuuauauuguuaucggggugggaaacagcgcucugacccugcauugguuuagaaaaggcuccucuauugggaagauguucgagagcacauaccgcggagccaaacggauggccauccucggcgaaacggcuugggauuuuggguccgucggcggacuguucaccagccuuggcaaggccgugcaccagguuuuugggucuguguauacaaccauguucggaggcgucuccuggaugauuagaauccugaucggguuucucgugcuguggauuggaacaaauagccgcaacaccucuauggcuaugacgugcaucgccguuggcgggauuacacuguuccuuggcuuuaccgugcaggcggacaugggaugugucguguccuggagcggccgggagcucaagugcggguccggaaucuucguggucgauaauguucauaccuggacagaacaauacaaauuucagcccgagucuccugccagacuggcuagcgccauucugaacgcucacaaggacggcgugugugggauccgcuccaccacacggcucgagaaugugauguggaaacagauuacgaacgaacugaauuauguccuuugggagggaggccacgaccugaccgugguugccggcgaugugaaggggguccucacaaaaggaaagagagcgcugacacccccugugucugaccugaaguacagcuggaaaacauggggcaaggccaaaaucuucacccccgaagcucggaacuccacguuucuuaucgaugggccggacaccagcgagugcccuaaugaacgcagagccuggaacucucucgagguugaggauuacggauucggcauguucacaaccaauauuuggaugaaguuucgggaaggguccagcgaggugugugaccauagacugaugucugcugccaucaaagaucagaaggccguccacgcugacaugggauauuggauugaauccagcaaaaaccaaacauggcagaucgagaaggcgucucugauugaagugaagaccugccucuggcccaaaacacauacccuguggagcaauggcguucuugagucccagaugcugaucccuaagagcuacgccggccccuucucucagcacaacuaucgccaaggguacgcuacgcagacagugggaccuuggcaccucggcaaacuggagaucgauuuuggggaaugccccggaaccaccgucacaauucaggaggacugugaucaucggggcccgucccugagaaccacgacagccagcgggaaacuugugacccaguggugcugucgcuccugcacaaugccuccccucagauuccugggagaagacggcuguugguauggcauggagauccggccccugaacgagaaagaagagaauauggugaagucucaagucaccgccgggcagggaacaagcgaaaccuuuuccaugggccuccugugccuuacgcuguucguugaggaaugucuccgcagacgggugacccgcaagcacaugauucugguggucgugaucacacugugcgcuauuauccuugggggacucaccuggauggaucugcugagagcccucaucaugcugggcgacacaaugucugggcggauuggaggccagauccaucuugcgauuauggcuguuuuuaaaaugagcccuggcuacgugcugggggucuuccuccgcaagcugaccuccagagagacggcccugauggugaucggaauggccaugacaaccguucuuucuauuccgcacgaccugauggagcucaucgauggcaucagccuggggcucauucugcuuaaaaucgugacacaguuugacaacacccaagucggaacccuggcucucucccugacauucauucggagcacgaugccccuggugauggccuggcgcaccaucauggcgguccuuuuugugguuacacugauuccucucuguagaaccucuugccugcagaagcagucccauuggguggaaaucacagcucucauucugggcgcccaagcccuucccgucuaucugaugacccucaugaaaggggcuagccggagaucuuggccucugaaugagggaaucauggccgugggccugguuucccuucugggcagcgcucuccugaagaacgaugugccccucgccgggccuauggucgcgggaggccugcuucuggccgcuuacgugaugucuggguccagcgccgaccugucccucgaaaaggcugccaaugugcagugggaugagauggccgacaucacgggaagcucucccauuaucgaaguuaaacaggaugaggacggcagcuucuccauucgcgaugucgaggaaacaaacaugaucacccugcuugugaagcuggcucucauuaccgugucugggcuguacccgcucgcgaucccugucacaaugacccugugguauauguggcaagugaaaacacaacggagcggagcccuuugggacguucccuccccugcugccacgcagaaggccgcucugucugagggcguguacagaaucaugcagcgcggccuguuugggaaaacccaggucggagugggcauucacauggaagggguuuuccacacaauguggcaugugacccggggaagcgucaucugucacgagacaggcagacucgaacccuccugggccgaugugcgcaaugacaugauuucuuaugggggaggcuggcggcugggcgauaagugggacaaggaggaggacguucaagugcuugcgaucgaaccggggaaaaacccuaagcauguccagaccaaacccggacuguucaagacgcucaccggcgagauuggggcugugacacuggauuuuaaaccuggaaccagcggcucccccaucaucaauagaaaggggaaagugauuggccucuacggaaacggcgucguuacaaagagcggggacuaugugucugccaucacccaggccgaacgcauuggagagcccgauuacgagguggacgaagauaucuuccggaagaaaagacugacaauuauggaccuucacccuggcgcugggaagacgaaacggauccugccguccauuguccgcgaggcccugaagagacggcuccgcacccugauccuugcgcccacaagagugguugcugccgaaauggaggaagcccugcggggacucccuaucagauaucagacccccgcugugaaaagcgagcauaccggccgcgagauugucgaucugaugugccacgccacauuuacgacccggcuccugucuuccacaagagugccuaauuacaaccuuaucguuauggacgaagcucacuucaccgaucccagcuccguggccgcgcgcggguacauuucuacacgggucgagaugggcgaagccgcugccaucuuuaugaccgcuacgccuccgggagccacagaccccuucccucaaagcaauucccccauugaggauaucgaaagagagaucccugagcgcagcuggaacaccggcuuugacuggauuaccgacuaucaggggaagacagugugguucguccccucuaucaaggccggaaaugauauugcuaacugccugcggaaauccggcaagaaagugauccagcugagcagaaagaccuuugacacagaauacccgaaaaccaagcucacggauugggacuucguugugacaaccgauauuucugagaugggggcgaacuuucgcgccggaagagugaucgacccucggcgcugucugaagcccgucauccuuacagauggccccgaaagaguuauucuggcugggccuauccccgugaccccugccagcgccgcucaacggcgcggcagaauuggacggaauccggcccaggaggacgaucaguauguguucuccggcgacccccucaaaaacgaugaagaccaugcgcacuggacggaggcuaagaugcugcuggauaauaucuacaccccugaggggauuauccccacacucuucggaccugaaagagagaaaacccaggccauugacggcgaauuucgccuuagaggggaacaaagaaagacauucgucgagcugaugcgccggggagaccugcccguguggcucucuuauaaaguugccagcgcuggcaucuccuacaaggauagagaauggugcuuuaccggcgagcggaacaaucagauccuggaagagaacauggaaguggagauuuggacacgcgagggggaaaagaagaaacuuagaccgcgguggcuggacgcccgcgucuaugcggauccuauggcccucaaagacuucaaagaguuugcuucuggaagaaaaagcaucacccuggauauucugacggaaaucgccucccuccccacauaccuuagcucucgggcuaagcuggcccuggacaauauugugaugcuccauaccaccgagcgcggcgggagagcuuaccagcacgcccugaacgaacuuccugagucccuggagacacucaugcuggucgcgcugcucggagccaugaccgcuggcaucuuccucuuuuucaugcaggggaagggaaucggcaaacugagcaugggccugauugccaucgcuguggccuccgggcuccuguggguugccgaaauucaaccccaguggaucgcugcgucuauuauccuugaguuuuuccugauggugcuccugaucccugaacccgagaagcagcggacaccgcaggauaaucaacugauuuaugucauccucacgauucuuaccaucauuggacugaucgccgcuaacgaaaugggccugauugagaaaacaaagaccgacuuuggguucuaccaggugaaaacagagaccacgauccucgauguugaccugcgcccugccagcgccuggacccuuuaugcuguggccacaaccauccugacacccaugcucagacacaccauugaaaauacguccgcgaaccugucucuggccgcuaucgccaaucaggcugccguccucaugggacuuggcaagggguggccccugcaucggauggaucugggagugccucuccuggcgaugggcuguuacagccaggugaacccgacaacccuuacagccucccugguuaugcuccugguccacuaugcuauuaucggccccgggcugcaagccaaagcuaccagagaggcccagaagcgcaccgcugccggaauuaugaagaauccuacaguggacggcaucacggugaucgaucucgaacccauuagcuacgacccuaaauuugagaagcagcuugggcaagucaugcugcugguucucugcgcgggacagcugcuucugaugcggaccacaugggccuucugugaggugcucacccuggcuacaggccccacccugacgcucugggaagggaacccuggaagauucuggaacacaaccaucgccgugucuaccgcuaauauuuuucgcggcuccuaucuugccggcgccgggcuggcguucagccugaucaaaaacgcucagacaccgcggagaggaaccggcacaacgggggagacccucggagaaaaguggaaacgccagcucaauucucuugaccggaaggaguuugaagaguacaagagauccggcauucuggaggucgaucgcacagaagccaaaagcgcucucaaggacgggucuaaaaccaagcaugccgugagccggggauccucuaaaaucagauggaucguugagcgcggcauggugaagcccaagggcaaagucguggaucuggggugcggacggggcggguggagcuacuauauggccacacugaagaacguuaccgaagugaaaggauacacgaagggcgggccuggacacgaggaacccauuccuauggcuaccuauggcuggaaucucgucaaacuucauuccggcguggacguguucuacaagcccacagagcaagucgauacccugcugugugacaucggggagagcuccucuaacccgacaauugaagagggaagaacccuccgcguucugaagaugguggaaccuuggcuuagcuccaaacccgaguuuugcaucaaggugcugaaucccuauaugccuacagucauugaagaacuggagaaacugcagagaaagcacggcgggaaccuggugcgguguccccucucucgcaauagcacccacgaaauguacuggguuuccggagccucuggcaacaucgugagcuccgucaauacgacaagcaaaaugcuucugaacagauucaccacccggcauagaaagccuacauaugagaaagauguggaccugggggcgggaacgcggucuguuuccaccgaaacagagaagccggauaugaccauuaucggccgcagacuccagcggcugcaggaggaacacaaggagacauggcauuacgaccaagaaaaucccuaccgcaccugggccuaucacggcagcuacgaggcuccuucuacaggguccgccagcucuauggugaacggagucgugaaacuucugaccaagcccugggauguuaucccuauggugacgcagcucgcuaugaccgacacaacccccuuuggccagcagagagucuucaaagaaaagguggacacacggaccccgcaaccuaaacccgggacgcgcaugauuaugacaaccacagccaauuggcugugggcgcugcucggaaagaagaaaaacccuagacugugcacccgggaggaguuuaucuccaagguccgcagcaaugccgcuauuggcgccguguuccaggaggagcagggguggacguccgcuagcgaagccguuaacgauucuagauuuugggagcuuguggacaaagaacgggcucugcaccaagagggcaagugugagagcugcgucuauaacaugaugggaaaacgcgaaaagaagcucggcgaguucgggagagccaaaggaucccgggcgaucugguacauguggcugggcgcccgcuuucuugaguucgaggcucugggguuccucaaugaagaucauugguuuggaagagagaacucuuggagcggcguggagggggaaggccugcaccggcugggauauauucucgaggaaaucgacaagaaagauggcgaccugauguacgccgaugacaccgcugggugggauacaagaaucaccgaggacgaucuucagaaugaggaacugauuacagagcagauggcgccccaccacaagauccucgccaaagccauuuucaagcugaccuaucagaacaaggugguuaaagugcuucgcccuacaccccggggagcugucauggacaucauuuccagaaaggaucaacgcggcucuggacaggugggaaccuacggccugaauacguuuacaaacauggaaguucagcucauccggcagauggaggccgaaggggugaucacccaagacgacaugcagaauccgaaaggccugaaggagagagucgagaaauggcugcgcgaaugcggaguggaucggcucaagagaauggccauuagcggcgacgauugugucgugaaaccucuggacgagcgcuucgggaccucccuucuguuucucaacgauaugggaaagguucggaaggacaucccccagugggaacccucuaaaggcuggaagaauuggcaggaggugccuuucugcagccaucacuuucacaaaauuuucaugaaggaugggagaucccuggucgugccgugucgcaaccaagacgaacuuaucggacgggcuagaauuagccagggcgccggguggucucugcgggagacagcuugccucggcaaagccuacgcgcagauguggucccugauguauuuucauagacgcgaucugcggcucgccagcauggcuaucuguucugccguucccaccgagugguucccuacauccagaacgaccuggagcauccacgcucaucaccaguggaugacaaccgaagacaugcugaagguguggaaucgcgucuggauugaggauaaccccaauaugacagacaagaccccuauccacuccugggaagacauucccuaccuuggaaaaagagaggaucuguggugcggcucucucaucgggcugagcucccgggccacgugggcgaagaacauucauaccgccaucacacaagugcgcaaucuuauuggaaaagaagaguauguggacuacaugccuguuaugaagagauauagcgcucccucugaguccgaaggcguccuguga

SEQ ID NO: 20980 - RNA, 9867 nt, Artificial Sequence
  derived and/or modified CDS sequence (opt5) from DENV-4__GQ199881__SS-prME
agcaccaucacccugcucugccugauucccacggugauggcuuuccaccuuuccacccgggacggcgagccucugaugaucguggcuaagcaugaacgggggcgcccgcuccuguuuaagaccaccgagggaauuaacaaguguacccuuaucgccauggaucugggcgaaaugugcgaggacaccguuacauacaaguguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaagcaugcccaacgcguggagucuuggauccuuagaaauccuggcuucgcucugcucgccggcuuuauggcuuacaugaucgggcagacacggauucagcgcaccguuuucuuugugcugaugaugcuugucgcccccagcuauggaaugagaugugugggcguugggaaccgggauuucguggaaggagucuccggcggggcguggguggaccuggugcucgagcacggaggcugcgucacaaccauggcccagggcaagccuacccuggauuuugaacugacaaagacgaccgcuaaagagguugcccuccugcgcacauacuguaucgaagcuagcauuucuaauaucaccacagccaccagaugcccgacgcaaggggagcccuaucuuaaggaggaacaggaccagcaguacauuugucggcgcgaugugguggacagaggauggggcaacgggugcggacuguucggcaaagggggagucgugacaugcgcgaaguuuuccuguagcggcaaaaucaccggcaaucucguucaaauugagaaccuggaauauaccguggucgugacaguucauaauggggauacccacgccgugggaaacgacacaucuaaucacggcgucacggcuaccaucacaccucggucccccagcguggaggucaaacuuccugauuacggggaacugacccucgacugcgagcccagaucuggaaucgacuucaacgagaugauucugaugaagaugaaaaagaaaacauggcuggugcauaagcagugguuucucgaucugccgcuuccuuggaccgccggcgcugacacguccgaaguucacuggaauuacaaagagcgcauggugaccuucaaggucccccaugccaaacggcaggaugugacaguucuggggagccaggaaggcgccaugcacuccgcucucgcgggagccaccgagguggacucuggcgaugggaaccacauguuugcuggacaucugaaguguaaggucagaauggaaaaacuucgcaucaagggcaugagcuauacaaugugcuccgggaaauucagcauugacaaggagauggccgagacccaacacggaacgacaguggugaaaguuaaguacgaaggcgccggggcuccuuguaagguccccaucgagauucgggaugugaauaaagaaaagguggucggcagagugaucucuuccacaccccuggccgagaacacaaacagcguuaccaauaucgagcucgaaccuccguucggagacucuuauauugugaucggcgucgggaacagcgcgcugacccugcauugguuucgcaaaggauccucuauuggcaagauguucgagagcacauacagaggggcuaaaagaauggccauccucggagaaacggccugggauuuuggcuccgucgggggccuguucaccagccuuggaaaggcuguucaccagguguuuggcucugucuauacaaccauguucgggggaguguccuggaugauucgcauccugaucggcuuucucguucuguggauugggacaaauagccggaacaccucuauggccaugacgugcaucgcugugggaggcauuacacuguuccuuggguuuaccguccaggccgacaugggcugugugguguccuggagcggaagagagcucaagugcggcuccgggaucuucgucguugauaaugugcauaccuggacagaacaauacaaauuucagcccgagucuccugcgcgccuggccagcgcuauucugaacgcccacaaggacggaguguguggcauccgguccaccacaagacucgagaaugucauguggaaacagauuacgaacgaacugaauuaugugcuuugggaagggggacacgaccugaccguuguggcuggcgaugucaagggcgugcucacaaaagggaagcgggcccugacacccccuguuucugaccugaaguacagcuggaaaacauggggaaaggcgaaaaucuucacccccgaagcccgcaacuccacguuucuuaucgauggcccggacaccagcgagugcccuaaugaaagacgggcuuggaacucucucgagguggaggauuacggguucggaauguucacaaccaauauuuggaugaaguuuagagaaggcuccagcgaggucugugaccaucgccugaugucugccgcuaucaaagaucagaaggccgugcacgccgacaugggguauuggauugaauccagcaaaaaccaaacauggcagaucgagaaggcuucucugauugaaguuaagaccugccucuggcccaaaacacauacccuguggagcaauggagugcuugagucccagaugcugaucccuaagagcuacgcgggccccuucucucagcacaacuaucggcaaggcuacgccacgcagacagucgggccuuggcaccucggaaaacuggagaucgauuuuggcgaaugccccgggaccaccgugacaauucaggaggacugugaucauagaggaccgucccugcgcaccacgacagcuagcggcaaacuugugacccaguggugcuguagauccugcacaaugccuccccuccgguuccugggggaagacggauguugguauggcauggagauccgcccccugucugagaaagaagagaacauggucaagagccaaguugccgccggccaggggaccuccgaaacauuuuucaugggacuccugugccuuacccuguuuguggaggaaugucucagacggcgcgugacgagaaagcacaugauucuggcugucgugaucacccugugcgccauuauccuuggcgggcucacauggauggaucugcugcgggcgcucaucaugcugggagacaccaugucuggccgcauugggggacagacacaucuugcuaucauggccguuuucaaaaugagcccuggcuacgugcugggcgucuuucucagaaagcugaccucccgggagacggcccugauggugauugggauggcuaugacaaccacacuuucuaucccgcacgaccugauggagcucauugauggaaucagccugggccucauccugcuuaaaauuguuacccaguucgacaauacccaaguggggacacuggcccucucccugacguuuauccgcagcaccaugucucuggucauggcguggagaacaauuauggcugugcuuuucgucgugacccugaucccccucugucggacauccugccugcagaagcagagccauuggguugaaauuaccgcccucauccugggagcccaagcccuuccuguguaucugaugacgcucaugaaaggcgccucuagacgcuccuggccccugaacgaggggaugauggcugucggacuggugagccuucugggcucugcccuccugaagaaugauguuccucucgcgggccccaugguggccgggggacugcuucuggcugccuacgucauguccggcagcuccgcugaccugagccucgaaaaggccgccaacgugcagugggaugagauggcugacauuacagggucuagcccuaucaucgaagugaaacaggaugaggacggauccuuuucuauucgggauguugaggaaaccaauaugaucacccugcuugucaagcuggcgcucauuacagugagcggccuguacccccucgccaucccggugaccaugacacugugguauauguggcaggucaaaacgcaaagauccggggcucuuugggacgugccuucucccgccgccacccagaaggcugcccugagcgagggaguuuaccgcauuaugcagcggggccuguucggcaaaacacaggugggggucggaauccacauggaaggcguguuccacaccauguggcauguuacaagaggguccgugaucugucacgagaccggacgccucgaaccuucuugggcggauguccggaacgacaugauuagcuauggcgggggauggagacugggcgauaagugggacaaggaggaggacgugcaaguucuugcuaucgaacccggcaaaaauccgaagcaugugcagacgaaaccugggcuguuuaagacccucacaggagagauuggcgccgucacccuggauuucaaacccggguccagcggaucuccuaucauuaaccgcaagggcaaagugaucgggcucuacggcaauggaguggucacaaaguccggcgacuauguuagcgccaucacccaggcugaacggauuggggagcccgauuacgagguggacgaagauaucuuuagaaagaaacggcugacaauuauggaccuucaccccggagccggcaagacgaaacgcauccugccuucuauugugagagaggcgcugaagcggcgccucagaacccugauccuugcuccgacacgggucguggccgccgaaauggaggaagcucugagagggcuccccauucgcuaucagaccccugccguuaaauccgagcauaccggacgggagaucguggaucugaugugccacgcuacauucacgaccagacuccugagcuccacacgcguccccaacuacaaucuuaucgugauggacgaagcccacuuuaccgauccuucuagcguugcggcccggggcuacauuuccacaagaguggagaugggggaagcugccgcuaucuucaugaccgccacgcccccuggcgccacagacccguuuccccaaagcaacucuccuauugaggauaucgaacgcgagauucccgagcgguccuggaauaccggauucgacuggaucaccgacuaucagggcaagacagucugguuugugccuagcaucaaggcugggaacgauauugcgaauugccugagaaaaucuggaaagaaagucauccagcugagccgcaagaccuucgacacagaauaccccaaaaccaagcucacggauugggacuuugugguuacaaccgauauuuccgagaugggcgccaacuucagagcugggcgggugaucgacccgcgcagaugucugaagccugugauucuuacagauggacccgaacgggucauccuggccggccccaucccuguuacccccgccucugcugcccaacgcagagggcggauuggcagaaacccugcgcaggaggacgaucaguauguguucagcggagacccgcucaaaaaugaugaagaccaugcucacuggacggaggccaagaugcugcuggauaacaucuacacccccgagggcauuaucccuacacucuuugggcccgaacgcgagaaaacccaggccauugacggagaguuccggcuuagaggcgagcaacgcaagacauuuguggagcugaugcggagaggggaccugccugucuggcucuccuauaaaguggcuucugccggaaucagcuacaaggaucgggaauggugcuucaccggcgagcgcaauaaccagauucuggaagagaauauggaaguugagaucuggacaagagagggcgaaaagaagaaacuucggccccgcuggcuggacgcgagaguguaugccgauccgauggcucucaaagacuuuaaagaguucgccuccgggcggaaaagcaucacccuggauauucugacggaaaucgcuucucucccuacauaccuuuccagccgcgccaagcuggcucuggacaacauugucaugcuccauaccaccgagagaggaggccgggccuaccagcacgcgcugaaugaacuucccgagucccuggagacacucaugcugguggcccugcucggggcuaugaccgccggaaucuuucuuuucuuuaugcagggcaaggggauuggaaaacugucuaugggccugaucacaaucgcugucgccagcggccuccuguggguggccgaaauucaaccucaguggaucgcugcguccauuauccuugaguucuuucugaugguucuccugauucccgaaccugagaagcagcgcacgccccaggauaaccaacugaucuaugugauccucgccauucuuaccaucauugggcugaucgcugccaaugaaaugggacugauugagaaaacaaagaccgacuucggcuuuuaccaggucaaaacagagaccacgauccucgauguggaccugagaccggccucugcuuggacccuuuaugccguugcgacaaccauucugacaccuaugcuccggcacaccaucgaaaacacgagcgccaaucugucccuggcugccaucgcuaaccaggccgcggugcucauggggcuuggaaagggcuggccccugcauagaauggaucugggggucccccuccuggccaugggauguuacagccaggugaauccuacaacccuuacagcuucucuggugaugcuccugguucacuaugccauuaucggcccgggccugcaagcuaaagccacccgcgaggcucagaagcggaccgccgcggggauuaugaagaaccccacagucgacggaaucacggugauugaucucgaaccuaucuccuacgaccccaaauucgagaagcagcuuggccaagugaugcugcugguccucugcgccgggcagcugcuucugaugagaaccacaugggcuuucugugagguucucacccuggccacaggaccuauccugacccucugggaaggcaaucccgggcgcuuuuggaacacgacaauugcugugagcaccgccaacaucuuccggggaucuuaucuugccggcgcgggccuggcuuuuucccugauuaaaaaugcccagaccccuagacgcgggacaggaaccacaggcgagacgcucggggaaaaguggaaacggcagcugaacagccuugacagaaaggaguucgaagaguacaagcgcucuggaauccuggagguggaucggaccgaagcuaaaagcgcccucaaggacggcuccaaaauuaagcaugccgucucuagagggagcuccaaaauccgcuggaucguggagcggggaaugguuaagccgaagggcaaaguggucgaucugggcugcgggagaggaggcuggagcuacuauauggcuacacugaagaaugugaccgaaguuaaaggguacacaaagggaggccccgggcacgaggaaccuauucccauggccaccuauggauggaaccucgugaaacuucauuccggcgucgacguguuuuacaagccuacggagcaaguggauacccugcugugugacaucggcgagucuagcuccaaucccacaauugaagaggggcgcacccucagaguccugaagaugguugaaccguggcuuucuagcaaaccugaguucugcaucaaggugcugaaccccuauaugcccacagugauugaggaacucgagaaacugcagcggaagcacggaggcaaucugguccgcuguccucucuccagaaacucuacccacgaaauguacugggugagcggggcguccggaaauaucguuagcucugugaacacaaccuccaaaaugcuucugaaucgguuuacgacaagacaucggaagcccaccuaugagaaagaugucgaccugggcgccgggacccgcagcgugucuacagaaacggagaagccugauaugaccauuaucggaagacggcuccagcgccugcaggaggaacacaaggagacauggcauuacgaccaagaaaacccguacagaaccugggcuuaucacggcuccuacgaggcccccagcacaggcucugcuuccagcaugguuaaugggguggucaaacuucugaccaagccuugggaugugauccccaugguuacacagcucgccaugaccgacacgaccccuuucggacagcagcggguguuuaaagaaaaggucgacacacgcacaccccaaccgaaaccuggcacaagaauggugaugaccacgacagcgaacuggcugugggcccugcucgggaagaagaaaaauccccggcugugcacccgcgaggaguucauuuccaaggucagaagcaacgcugccaucggagcuguguuucaggaggaacagggcuggacaucugccagcgaagcuguuaaugauucccgguucugggagcuuguggacaaagaacgcgcccugcaccaagaggggaagugugagucuugcgucuauaacaugaugggcaaaagagaaaagaagcucggagaguuuggccgggcgaaagggagccgcgccauuugguacauguggcugggagcuagauuccuugaguucgaggcccugggcuuucucaacgaagaucauugguucgggcgggaaaauuccuggucuggaguggagggcgaagggcugcacagacugggcuauauccucgaggaaauugacaagaaagauggagaccugauguacgcugaugacaccgccggcugggauacgcgcaucaccgaggacgaucuucagaacgaggaacugaucacagagcagauggccccucaucacaagauucucgcgaaagcuaucuuuaagcugaccuaucagaauaaggugguuaaagugcuucggcccacaccuagaggggccgucauggacauuaucagccgcaaggaucaacggggauccggccagguggggaccuacggacugaacacauucaccaauauggaaguucagcucauuagacagauggaggccgaaggcgugaucacgcaagacgacaugcagaaccccaaagggcugaaggagcgcgucgagaaauggcugcgggaaugcggcguggauagacucaagcgcauggcuaucucuggagacgauugugucgugaaaccgcuggacgagcgguuuggcacaagccuucuguuccucaaugauauggggaagguuagaaaggacauuccucagugggaacccuccaaaggauggaagaacuggcaggaggugcccuuuugcagccaucacuuccacaaaaucuuuaugaaggauggccgcucucuggucgugccuugucggaaucaagacgaacuuauugggagagcccggaucucccagggagcuggcuggagccugagagagaccgccugccucgggaaagcguacgcccagauguggucucugauguauuuccaucgccgggaucugagacucgcuuccauggccauuuguagcgcuguuccgaccgagugguuucccacaucccgcaccacauggucuauccacgcccaucaccaguggaugacgaccgaagacaugcugaagguguggaacagagucuggaucgaggauaauccuaacaugauugacaagacacccgugcacagcugggaagacaucccuuaccuuggcaaacgggaggaucuguggugcggaucccucauuggccugagcucucgcgcgaccugggccaagaauauccauacagcuauuacccaagugagaaaccuuaucgggaaagaagaguauguugacuacaugcccgucaugaagcgguauuccgccccuagcgagucugaaggagugcuguga

SEQ ID NO: 20981 - RNA, 9867 nt, Artificial Sequence
  derived and/or modified CDS sequence (opt5) from DENV-4__GQ199882__SS-prME
agcaccaucacccugcuuugccugauucccacggugauggcuuuccaucuuuccacccgggacggagagccucugaugaucgucgcuaagcaugaacgggggcgcccgcuccuguuuaagaccaccgaggggauuaacaaguguacccuuaucgccauggaucugggcgaaaugugcgaggacaccguuacauacaaguguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaagcaugcccaacgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaccaucacaccuagaucccccagcguggaggucaaacuuccugauuacggagaacugacccucgacugcgagccccggucuggcaucgacuucaacgagaugauucugaugaagaugaaaaagaaaacauggcuggugcauaagcagugguuucucgaucugccgcuuccuuggaccgccggggcugacacguccgaaguucacuggaauuacaaagagagaauggugaccuucaaggucccccaugccaaacgccaggaugugacaguucugggcagccaggaaggagccaugcacuccgcucucgcgggcgccaccgagguggacucuggggauggaaaccacauguuugcuggccaucugaaguguaagguccggauggaaaaacuuagaaucaaggggaugagcuauacaaugugcuccggaaaauucagcauugacaaggagauggccgagacccaacacggcacgacaguggugaaaguuaaguacgaaggggccggcgcuccuuguaagguccccaucgagauucgcgaugugaauaaagaaaagguggucggacgggugaucucuuccacaccccuggccgagaacacaaacagcguuaccaauaucgagcucgaaccuccguucggcgacucuuauauugugaucggggucggaaacagcgcgcugacccugcauugguuuagaaaaggcuccucuauugggaagauguucgagagcacauaccgcggagcuaaacggauggccauccucggcgaaacggccugggauuuuggguccgugggcggacuguucaccagccuuggcaaggcuguucaccagguguuugggucugucuauacaaccauguucggaggcguguccuggaugauuagaauccugaucggguuucucguucuguggauuggaacaaauagccgcaacaccucuauggccaugacgugcaucgcugugggcgggauuacacuguuccuuggcuuuaccguccaggccgacaugggaugugugguguccuggagcggccgggagcucaagugcggguccggaaucuucgucguugauaaugugcauaccuggacagaacaauacaaauuucagcccgagucuccugcgagacuggccagcgcuauucugaacgcccacaaggacggcgugugugggauccgcuccaccacacggcucgagaaugucauguggaaacagauuacgaacgaacugaauuaugugcuuugggagggaggccacgaccugaccguuguggcuggcgaugucaagggggugcucacaaaaggaaagagagcccugacacccccuguuucugaccugaaguacagcuggaaaacauggggcaaggcgaaaaucuucacccccgaagcccggaacuccacguuucuuaucgaugggccggacaccagcgagugcccuaaugaacgcagagcuuggaacucucucgagguggaggauuacggauucggcauguucacaaccaauauuuggaugaaguuucgggaaggguccagcgaggucugugaccauagacugaugucugccgcuaucaaagaucagaaggccgugcacgccgacaugggauauuggauugaauccagcaaaaaccaaacauggcagaucgagaaggcuucucugauugaaguuaagaccugccucuggcccaaaacacauacccuguggagcaauggcgugcuugagucccagaugcugaucccuaagagcuacgcgggccccuucucucagcacaacuaucgccaaggguacgccacgcagacagucggaccuuggcaccucggcaaacuggagaucgauuuuggggaaugccccggaaccaccgugacaauucaggaggacugugaucaucggggcccgucccugagaaccacgacagcuagcgggaaacuugugacccaguggugcugucgcuccugcacaaugccuccccucagauuccugggagaagacggcuguugguauggcauggagauccggccccugucugagaaagaagagaacauggucaagagccaaguugccgccgggcagggaaccuccgaaacauuuucuaugggccuccugugccuuacccuguucguggaggaaugucuccgcagacgggugacgcgcaagcacaugauucuggcugucgugaucacccugugcgccauuauccuugggggacucacauggauggaucugcugagagcgcucaucaugcugggcgacaccaugagcgggcggauuggaggccagacacaucuugcuaucauggccguuuuuaaaauguccccuggcuacgugcugggggucuuccuccgcaagcugaccucuagagagacggcccugauggugauuggaauggcuaugacaaccacacuuagcaucccgcacgaccugauggagcucauugauggcaucucccuggggcucauccugcuuaaaauuguuacccaguuugacaauacccaagugggaacacuggcccucagccugacguucauccggucuaccaugucccuggucauggcguggcgcacaauuauggcugugcuuuuugucgugacccugaucccccucuguagaacaagcugccugcagaagcagucucauuggguugaaauuaccgcccucauccugggcgcccaagcccuuccuguguaucugaugacgcucaugaaaggggccucccggagaagcuggccccugaacgagggaauuauggcugucggccuggugucucuucugggcuccgcccuccugaagaaugauguuccucucgcggggcccaugguggccggaggccugcuucuggcugccuacgucaugagcggguccagcgcugaccugucucucgaaaaggccgccaacgugcagugggaugagauggcugacaucacaggaagcuccccuaucauugaagugaaacaggaugaggacggcucuuucagcauccgcgauguugaggaaaccaauaugauuacccugcuugucaagcuggcgcucaucacaguguccgggcuguacccccucgccauuccggugaccaugacacugugguauauguggcaggucaaaacgcaacggucuggagcucuuugggacgugccuagccccgccgccacccagaaggcugcccuguccgagggcguuuacagaaucaugcagcgcggccuguuugggaaaacacaggugggagucggcauccacauggaagggguguuccacaccauguggcauguuacacggggaucugugauuugucacgagaccggcagacucgaaccuagcugggcggauguccgcaacgacaugaucuccuaugggggaggcuggcggcugggcgauaagugggacaaggaggaggacgugcaaguucuugcuauugaacccgggaaaaauccgaagcaugugcagacgaaaccuggacuguucaagacccucacaggcgagaucggggccgucacccuggauuuuaaacccggaacaagcggcucuccuauuaucaacagaaaggggaaagugaucggccucuacggaaauggcguggucaccaaguccggggacuauguuagcgccauuacacaggcugaacgcaucggagagcccgauuacgagguggacgaagauauuuuccggaagaaaagacugacgaucauggaccuucaccccggcgccgggaagaccaaacggauucugccuucuaucgugcgcgaggcgcugaagagacggcuccgcacacugauucuugcuccgaccagagucguggccgccgaaauggaggaagcucugcggggacuccccaucagauaucagaccccugccguuaaauccgagcauacaggccgcgagaucguggaucugaugugccacgcuacguuuaccacacggcuccugagcuccaccagaguccccaacuacaaucuuauugugauggacgaagcccacuucacagauccuucuagcguugcggcccgcggguacaucuccacccggguggagaugggcgaagcugccgcuauuuuuaugacggccacacccccuggagccaccgacccguucccccaaagcaacucuccuaucgaggauauugaaagagagauccccgagcgcuccuggaauaccggcuuugacuggaucacagacuaucaggggaagaccgucugguucgugccuagcauuaaggcuggaaacgauaucgcgaauugccugcggaaaucuggcaagaaagucauucagcugagcagaaagacauuugacaccgaauaccccaaaacgaagcucacagauugggacuucgugguuaccacagauaucuccgagaugggggccaacuuucgcgcuggaagagugauugacccgcggcgcugucugaagccugugauccuuaccgauggcucugaaagagucauccuggccgggcccauucccguuacgccugccagcgcugcccaacggcgcggcagaaucggacggaaccccgcgcaggaggacgaucaguauguguucuccggcgacccucucaaaaaugaugaagaccaugcucacuggaccgaggccaagaugcugcuggauaacauuuacacaccggaggggaucauucccacccucuucggaccugaaagagagaaaacacaggccaucgacggcgaauuucgccuuagaggggaacaaagaaagaccuucguggagcugaugcgccggggagaccugcccgucuggcucucuuauaaaguggcuagcgccggcauuuccuacaaggauagagaauggugcuuuacaggcgagcggaauaaccagauccuggaagagaauauggaaguugagaucuggacccgcgagggggaaaagaagaaacuuagaccucgguggcuggacgcgcgcguguaugccgaucccauggcucucaaagacuucaaagaguuugccagcggaagaaaaucuauuacgcuggauauccugacagaaauugcuucccucccgaccuaccuuagcucccgggccaagcuggcucuggacaacaucgucaugcuccauaccacagagcgcggcgggagagccuaccagcacgcgcugaaugaacuuccugagucucuggagacccucaugcugguggcccugcucggagcuaugacagccggcauuuuccucuuuuucaugcaggggaagggaaucggcaaacugagcaugggccugaucacgauugcugucgccuccgggcuccuguggguggccgaaauccaaccccaguggauugcugcgucuaucauucuugaguuuuuccugaugguucuccugaucccugaacccgagaagcagcggaccccucaggauaaccaacugaucuaugugauucucacaauccuuaccauuaucggacugauugccgcuaaugaaaugggccugaucgagaaaacaaagaccgacuuuggguucuaccaggucaaaacggagaccacaauucucgauguggaccugcgccccgccagcgccuggacccuuuaugcuguugccacaaccauccugacgccgaugcucagacacacaaucgaaaacaccuccgcgaaucugagccuggccgcuauugccaaccaggcugccgugcucaugggacuuggcaagggguggccucugcaucggauggaucugggagucccccuccuggcgaugggcuguuacucucaggugaaucccacaacccuuaccgccucccuggugaugcuccugguucacuaugcuaucauuggcccugggcugcaagccaaagcuacaagagaggcccagaagcgcacggcugccggaaucaugaagaacccgaccgucgacggcauuacagugaucgaucucgaacccaucagcuacgacccuaaauuugagaagcagcuugggcaagugaugcugcugguccucugcgcgggacagcugcuucugaugcggaccacaugggccuucugugagguucucacccuggcuacgggccccauucugacacucugggaagggaauccuggaagauucuggaacaccaccaucgccgugucuacagcuaacauuuuucgcggcuccuaucuugccggcgccgggcuggcguucagccugaucaaaaaugcucagacaccccggagaggaacaggcacgaccggggagacacucggagaaaaguggaaacgccagcugaacucucuugaccggaaggaguuugaagaguacaagagaagcggcauucuggagguggaucgcaccgaagccaaauccgcucucaaggacgggucuaaaaucaagcaugccgucagccggggauccagcaaaaucagauggauuguggagcgcggcaugguuaagccuaagggcaaaguggucgaucuggggugcggacggggcgggugguccuacuauauggccacacugaagaaugugaccgaaguuaaaggauacacgaagggcgggccgggacacgaggaacccaucccuauggcuaccuauggcuggaaccucgugaaacuucauucuggcgucgacguguucuacaagcccacagagcaaguggauacccugcugugugacauuggggagagcuccucuaauccuacaaucgaagagggaagaacccuccgcguccugaagaugguugaacccuggcuuagcuccaaaccggaguuuugcauuaaggugcugaacccuuauaugcccacagugaucgaggaacucgagaaacugcagagaaagcacggcgggaaucugguccgguguccccucucucgcaacagcacccacgaaauguacuggguguccggagccagcggcaauauuguuucuuccgugaacacgacaagcaaaaugcuucugaauagauucaccacccggcauagaaagccuacauaugagaaagaugucgaccugggggcgggaacgcggucuguguccaccgaaacagagaagcccgauaugaccaucaucggccgcagacuccagcggcugcaggaggaacacaaggagacauggcauuacgaccaagaaaacccuuaccgcaccugggccuaucacggcagcuacgaggcuccgucuacaggguccgccagcuccaugguuaauggaguggucaaacuucugaccaagcccugggaugugauuccuaugguuacgcagcucgcuaugaccgacacaacccccuuuggccagcagagaguguucaaagaaaaggucgacacacggaccccucaacccaaaccggggacgcgcauggugaugacaaccacagccaacuggcugugggcgcugcucggaaagaagaaaaauccuagacugugcacccgggaggaguuuaucagcaagguccgcucuaacgccgcuauuggcgccguguuccaggaggagcagggguggacgagcgcuuccgaagccguuaaugauucuagauuuugggagcuuguggacaaagaacgggcucugcaccaagagggcaagugugagagcugcgucuauaacaugaugggaaaacgcgaaaagaagcucggcgaguucgggagagccaaaggaucccgggcgaucugguacauguggcugggcgcccgcuuucuugaguucgaggcucugggguuccucaacgaagaucauugguuuggaagagaaaauucuuggagcggcguggagggggaaggccugcaccggcugggauauauucucgaggaaaucgacaagaaagauggcgaccugauguacgccgaugacaccgcugggugggauacaagaaucaccgaggacgaucuucagaacgaggaacugauuacagagcagauggcgccccaccacaagauccucgccaaagccauuuucaagcugaccuaucagaauaaggugguuaaagugcuucgcccuacaccccggggagcugucauggacaucauuuccagaaaggaucaacgcggcucuggacaggugggaaccuacggccugaacacguuuacaaauauggaaguucagcucauccggcagauggaggccgaaggggugaucacccaagacgacaugcagaacccuaaaggccugaaggagagagucgagaaauggcugcgcgaaugcggaguggaucggcucaagagaauggccauuagcggcgacgauugugucgugaaaccccuggacgagcgcuucgggaccucccuucuguuucucaaugauaugggaaagguucggaaggacaucccgcagugggaaccuagcaaaggcuggaagaacuggcaggaggugcccuucugcucucaucacuuucacaaaauuuucaugaaggaugggagaucccuggucgugcccugucgcaaucaagacgaacuuaucggacgggcuagaauuagccagggcgccggguggucucugcgggagacagcuugccucggcaaagccuacgcgcagauguggucccugauguauuuucauagacgcgaucugcggcucgccagcauggcuaucuguuccgccguuccuaccgagugguucccgacaucuagaacgaccuggagcauccacgcucaucaccaguggaugacaaccgaagacaugcugaagguguggaaccgcgucuggauugaggauaaucccaacaugaucgacaagacaccugugcacuccugggaagacauucccuaccuuggaaaaagagaggaucuguggugcggcagccucaucgggcugucuucccgggccaccugggcgaagaauauucauacggccaucacccaagugcgcaaccuuauuggaaaagaagaguauguugacuacaugccugucaugaagagauauagcgcucccucugagagcgaaggcgugcuguga

SEQ ID NO: 20982 - RNA, 9867 nt, Artificial Sequence
  derived and/or modified CDS sequence (opt5) from DENV-4__GQ199883__SS-prME
agcaccaucacccugcuuugccugauucccacggugauggccuuccaccuuuccacccgggacggagagccucugaugaucguggcuaagcaugaacgggggcgcccgcuccuguuuaagaccaccgagggaauuaacaaguguacccuuaucgccauggaucugggcgaaaugugcgaggacaccguuacauacaaguguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaagcaugcccagcgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaccaucacaccuagaucccccagcgccgaggugaaacuuccugauuacggagaacugacccucgacugcgagccccggucuggcaucgacuucaacgagaugauucugaugaagaugaaaaagaaaacauggcugguccauaagcagugguuucucgaucugccgcuuccuuggaccgcuggggccgacacguccgaagugcacuggaauuacaaagagagaaugguuaccuucaaggugccccaugccaaacgccaggaugucacagugcugggcagccaggaaggagcuaugcacuccgcgcucgccggcgcuaccgagguugacucuggggauggaaaccacauguuugccggccaucugaaguguaaggugcggauggaaaaacuuagaaucaaggggaugagcuauacaaugugcuccggaaaauucagcauugacaaggagauggccgagacccaacacggcacgacagucgugaaagugaaguacgaaggggcuggcgccccuuguaagguucccaucgagauucgcgaugucaauaaagaaaagguggugggacgggucaucucuuccacaccccuggcggagaacacaaacagcgugaccaauaucgagcucgaaccuccguucggcgacucuuauauuguuaucggggugggaaacagcgcucugacccugcauugguuuagaaaaggcuccucuauugggaagauguucgagagcacauaccgcggagccaaacggauggccauccucggcgaaacggcuugggauuuuggguccgucggcggacuguucaccagccuuggcaaggccgugcaccagguuuuugggucuguguauacaaccauguucggaggcgucuccuggaugauuagaauccugaucggguuucucgugcuguggauuggaacaaauagccgcaacaccucuauggcuaugacgugcaucgccguuggcgggauuacacuguuccuuggcuuuaccgugcaggcggacaugggaugugucguguccuggagcggccgggagcucaagugcggguccggaaucuucguggucgauaauguucauaccuggacagaacaauacaaauuucagcccgagucuccugccagacuggcuagcgccauucugaacgcucacaaggacggcgugugugggauccgcuccaccacacggcucgagaaugugauguggaaacagauuacgaacgaacugaauuauguccuuugggagggaggccacgaccugaccgugguugccggcgaugugaaggggguccucacaaaaggaaagagagcgcugacacccccugugucugaccugaaguacagcuggaaaacauggggcaaggccaaaaucuucacccccgaagcucggaacuccacguuucuuaucgaugggccggacaccagcgagugcccuaaugaacgcagagccuggaacucucucgagguugaggauuacggauucggcauguucacaaccaauauuuggaugaaguuucgggaaggguccagcgaggugugugaccauagacugaugucugcugccaucaaagaucagaaggccguccacgcugacaugggauauuggauugaauccagcaaaaaccaaacauggcagaucgagaaggcgucucugauugaagugaagaccugccucuggcccaaaacacauacccuguggagcaauggcguucuugagucccagaugcugaucccuaagagcuacgccggccccuucucucagcacaacuaucgccaaggguacgcuacgcagacagugggaccuuggcaccucggcaaacuggagaucgauuuuggggaaugccccggaaccaccgucacaauucaggaggacugugaucaucggggcccgucccugagaaccacgacagccagcgggaaacuugugacccaguggugcugucgcuccugcacaaugccuccccucagauuccugggagaagacggcuguugguauggcauggagauccggccccugucugagaaagaagagaacauggucaagagccaagucgccgcugggcagggaaccuccgaaacauuuucuaugggccuccugugccuuacccuguucguugaggaaugucuccgcagacgggugacgcgcaagcacaugauucuggccguggucaucacccugugcgcgauuauccuugggggacucacauggauggaucugcugagagcucucaucaugcugggcgacaccaugagcgggcggauuggaggccagacacaucuugccaucauggccguguuuaaaauguccccuggcuacguucuggggguguuccuccgcaagcugaccucuagagagacggcucugauggucauuggaauggccaugacaaccacacuuagcaucccgcacgaccugauggagcucauugauggcaucucccuggggcucauccugcuuaaaauugugacccaguuugacaauacccaaguuggaacacuggcgcucagccugacguucauccggucuaccaugucccuggugauggcuuggcgcacaauuauggccguccuuuuuguggucacccugaucccccucuguagaacaagcugccugcagaagcagucucauuggguggaaauuaccgcccucauccugggcgcucaagcccuuccuguuuaucugaugacgcucaugaaaggggcuucccggagaagcuggccccugaacgagggaauuauggccgugggccuggucucucuucugggcuccgcgcuccugaagaaugaugugccucucgccgggcccaugguugcuggaggccugcuucuggccgcuuacgugaugagcggguccagcgccgaccugucucucgaaaaggccgcuaacguccagugggaugagauggcggacaucacaggaagcuccccuaucauugaagugaaacaggaugaggacggcucuuucagcauccgcgauguggaggaaaccaauaugauuacccugcuuguuaagcuggcccucaucacagucuccgggcuguacccccucgcuauuccggugaccaugacacugugguauauguggcaagugaaaacgcaacggucuggagcccuuugggacgucccuagccccgccgcuacccagaaggccgcgcuguccgagggcguguacagaaucaugcagcgcggccuguuugggaaaacacagguuggagugggcauccacauggaaggggucuuccacaccauguggcaugugacacggggaucuguuauuugucacgagaccggcagacucgaaccuagcugggcugaugugcgcaacgacaugaucuccuaugggggaggcuggcggcugggcgauaagugggacaaggaggaggacguccaagugcuugccauugaacccgggaaaaauccgaagcauguucagacgaaaccuggacuguucaagacccucacaggcgagaucggggccgugacccuggauuuuaaacccggaacaagcggcucuccuauuaucaacagaaaggggaaagucaucggccucuacggaaauggcguggugaccaaguccggggacuaugucagcgcuauuacacaggccgaacgcaucggagagcccgauuacgagguugacgaagauauuuuccggaagaaaagacugacgaucauggaccuucaccccggcgcggggaagaccaaacggauucugccuucuaucgugcgcgaggcucugaagagacggcuccgcacacugauucuugccccgaccagaguggucgccgcugaaauggaggaagcccugcggggacuccccaucagauaucagaccccugcugugaaauccgagcauacaggccgcgagaucguugaucugaugugccacgccacguuuaccacacggcuccugagcuccaccagagugcccaacuacaaucuuauugucauggacgaagcgcacuucacagauccuucuagcguggccgcucgcggguacaucuccacccggguugagaugggcgaagccgcugccauuuuuaugacggccacacccccuggagcuaccgacccguucccccaaagcaacucuccuaucgaggauauugaaagagagauccccgagcgcuccuggaauaccggcuuugacuggaucacagacuaucaggggaagaccgugugguucgucccuagcauuaaggcgggaaacgauaucgccaauugccugcggaaaucuggcaagaaagugauucagcugagcagaaagacauuugacaccgaauaccccaaaacgaagcucacagauugggacuucgucgugaccacagauaucuccgagaugggggcuaacuuucgcgccggaagaguuauugacccgcggcgcugucugaagccugugauccuuaccgauggccccgaaagagugauccuggccgggcccauuccugucacgcccgcuucugccgcgcaacggcgcggcagaaucggacggaacccugcucaggaggacgaucaguauguuuucagcggcgacccgcucaaaaaugaugaagaccaugcccacuggaccgaggccaagaugcugcuggauaacauuuacacacccgaggggaucauuccuacccucuucggacccgaaagagagaaaacacaggcuaucgacggcgaauuucgccuuagaggggaacaaagaaagaccuucguggagcugaugcgccggggagaccugccuguguggcucuccuauaaagucgccucugcgggcauuagcuacaaggauagagaauggugcuuuacaggcgagcggaauaaccagauccuggaagagaauauggaaguggagaucuggacccgcgagggggaaaagaagaaacuuagaccccgguggcuggacgcccgcguuuaugcugauccgauggcccucaaagacuucaaagaguuugcuuccggaagaaaaagcauuacgcuggauauccugacagaaauugccucucucccuaccuaccuuuccagccgggcuaagcuggcccuggacaacaucgugaugcuccauaccacagagcgcggcgggagagcguaccagcacgcccugaaugaacuucccgagucccuggagacccucaugcuggucgcucugcucggagccaugacagcuggcauuuuccucuuuuucaugcaggggaagggaaucggcaaacugucuaugggccugaucacgauugccguggccagcgggcuccugugggucgcugaaauccaaccucaguggauugcggccuccaucauucuugaguuuuuccugauggugcuccugauccccgaaccugagaagcagcggacaccccaggauaaccaacugaucuauguuauucucgcuauccuuacaauuaucggacugauugccgccaaugaaaugggccugaucgagaaaaccaagacagacuuuggguucuaccaggugaaaaccgagacgaccauucucgaugucgaccugcgcccggcuucugccuggacacuuuaugcgguggccaccacaauccugaccccuaugcucagacacacgaucgaaaacacaagcgcuaaucugucccuggccgcuauugccaaccaggcggccguucucaugggacuuggcaagggguggccccugcaucggauggaucugggagugccccuccuggcuaugggcuguuacagccaggucaauccuaccacacuuaccgccucucuggugaugcuccuggugcacuaugcuaucauuggcccggggcugcaagccaaagcuaccagagaggcccagaagcgcacagcggccggaaucaugaagaaccccacgguugacggcauuaccgucaucgaucucgaaccuaucuccuacgaccccaaauuugagaagcagcuugggcaagugaugcugcuggugcucugcgcuggacagcugcuucugaugcggacaaccugggccuucugugagguccucacacuggcuaccggcccuauucugacgcucugggaagggaaucccggaagauucuggaacacaaccaucgccguuagcaccgccaacauuuuucgcggcucuuaucuugcgggcgcugggcuggccuucucccugaucaaaaaugcucagacaccucggagaggaaccggcacaacgggggagacccucggagaaaaguggaaacgccagcugaacagccuugaccggaaggaguuugaagaguacaagagaucuggcauucuggagguggaucgcacagaagccaaaagcgcccucaaggacggguccaaaaucaagcaugcugugucucggggaagcuccaaaaucagauggauugucgagcgcggcauggugaagccgaagggcaaaguuguggaucuggggugcggacggggcggguggagcuacuauauggccacccugaagaaugucacagaagugaaaggauacaccaagggcgggcccggacacgaggaaccuauccccauggcgacguauggcuggaaccucguuaaacuucauuccggcguggacgucuucuacaagccuaccgagcaaguggauacacugcugugugacauuggggagucuagcuccaaucccaccaucgaagagggaagaacacuccgcgugcugaagauggucgaaccguggcuuucuagcaaaccugaguuuugcauuaagguucugaaccccuauaugcccaccgugaucgaggaacucgagaaacugcagagaaagcacggcgggaaucuggugcgguguccucucucccgcaacucuacacacgaaauguacugggucagcggagccuccggcaauauugugagcucuguuaacaccacguccaaaaugcuucugaauagauucacaacccggcauagaaagcccaccuaugagaaagauguggaccugggggcuggaacacggagcgucucuacggaaaccgagaagccugauaugacaaucaucggccgcagacuccagcggcugcaggaggaacacaaggagaccuggcauuacgaccaagaaaacccguaccgcacaugggccuaucacggcuccuacgaggcucccagcaccgggucugccuccagcauggugaauggaguugugaaacuucugacaaagccuugggaugucauucccauggugacccagcucgcgaugacggacaccacaccuuuuggccagcagagaguuuucaaagaaaagguggacacccggacaccccaaccgaaaccugggacccgcauggucaugacgacaaccgccaacuggcugugggcucugcucggaaagaagaaaaaucccagacugugcacacgggaggaguuuaucuccaaggugcgcagcaacgccgcuauuggcgccgucuuccaggaggagcagggguggaccucugcuagcgaagccgugaaugauuccagauuuugggagcuuguugacaaagaacgggcgcugcaccaagagggcaagugugagucuugcguguauaacaugaugggaaaacgcgaaaagaagcucggcgaguucgggagagccaaaggaagccgggcuaucugguacauguggcugggcgcccgcuuucuugaguucgaggcucugggguuccucaacgaagaucauugguuuggaagagaaaauuccuggucuggcgucgagggggaaggccugcaccggcugggauauauucucgaggaaaucgacaagaaagauggcgaccugauguacgccgaugacacggccgggugggauaccagaaucacagaggacgaucuucagaacgaggaacugauuaccgagcagauggcgccucaucacaagauccucgcuaaagccauuuucaagcugacauaucagaauaagguggugaaaguucuucgccccaccccucggggagccgugauggacaucauuagcagaaaggaucaacgcggcuccgggcaggucggaacauacggccugaacaccuuuacgaauauggaagugcagcucauccggcagauggaggcugaagggguuaucacacaagacgacaugcagaaccccaaaggccugaaggagagaguggagaaauggcugcgcgaaugcggagucgaucggcucaagagaauggccauuucuggcgacgauuguguggucaaaccgcuggacgagcgcuucgggaccagccuucuguuucucaaugauaugggaaaggugcggaaggacaucccucagugggaacccuccaaaggcuggaagaacuggcaggagguucccuucugcagccaucacuuucacaaaauuuucaugaaggaugggagaucucugguggucccuugucgcaaucaagacgaacuuaucggacgggcuagaauuucccagggcgccggguggagccugcgggagaccgcgugccucggcaaagccuacgcucagauguggucucugauguauuuucauagacgcgaucugcggcucgccuccauggcuaucuguagcgccgugccgacagagugguuccccaccuccagaacaacguggucuauccacgcgcaucaccaguggaugaccacagaagacaugcugaagguuuggaaccgcguguggauugaggauaauccuaacaugaucgacaagacccccguccacagcugggaagacauuccuuaccuuggaaaaagagaggaucuguggugcggcucccucaucgggcugagcucucgggccacaugggcuaagaauauucauaccgccaucacgcaagugcgcaaccuuauuggaaaagaagaguauguggacuacaugcccguuaugaagagauauuccgcuccuagcgagucugaaggcguccuguga

SEQ ID NO: 20983 - RNA, 9867 nt, Artificial Sequence
  derived and/or modified CDS sequence (opt5) from DENV-4__GQ199884__SS-prME
agcaccaucacccugcuuugccugauucccacggugauggcuuuccaccuuuccacccgggacggagagccucugaugaucgucgcuaagcaugaacgggggcgcccgcuccuguuuaagaccaccgaggggauuaacaaguguacccuuaucgccauggaucugggcgaaaugugcgaggacaccguuacauacaaguguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaagcaugcccaacgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaccaucacaccuagaucccccagcguggaggucaaacuuccugauuacggagaacugacccucgacugcgagccccggucuggcaucgacuucaacgagaugauucugaugaagaugaaaaagaaaacauggcuggugcauaagcagugguuucucgaucugccgcuuccuuggaccgccggggcugacacguccgaaguucacuggaauuacaaagagagaauggugaccuucaaggucccccaugccaaacgccaggaugugacaguucugggcagccaggaaggagccaugcacuccgcucucgcgggcgccaccgagguggacucuggggauggaaaccacauguuugcuggccaucugaaguguaagguccggauggaaaaacuuagaaucaaggggaugagcuauacaaugugcuccggaaaauucagcauugacaaggagauggccgagacccaacacggcacgacaguggugaaaguuaaguacgaaggggccggcgcuccuuguaagguccccaucgagauucgcgaugugaauaaagaaaagguggucggacgggugaucucuuccacaccccuggccgagaacacaaacagcguuaccaauaucgagcucgaaccuccguucggcgacucuuauauugugaucggggucggaaacagcgcgcugacccugcauugguuuagaaaaggcuccucuauugggaagauguucgagagcacauaccgcggagcuaaacggauggccauccucggcgaaacggccugggauuuuggguccgugggcggacuguucaccagccuuggcaaggcuguucaccagguguuugggucugucuauacaaccauguucggaggcguguccuggaugauuagaauccugaucggguuucucguucuguggauuggaacaaauagccgcaacaccucuauggccaugacgugcaucgcugugggcgggauuacacuguuccuuggcuuuaccguccaggccgacaugggaugugugguguccuggagcggccgggagcucaagugcggguccggaaucuucgucguugauaaugugcauaccuggacagaacaauacaaauuucagcccgagucuccugcgagacuggccagcgcuauucugaacgcccacaaggacggcgugugugggauccgcuccaccacacggcucgagaaugucauguggaaacagauuacgaacgaacugaauuaugugcuuugggagggaggccacgaccugaccguuguggcuggcgaugucaagggggugcucacaaaaggaaagagagcccugacacccccuguuucugaccugaaguacagcuggaaaacauggggcaaggcgaaaaucuucacccccgaagcccggaacuccacguuucuuaucgaugggccggacaccagcgagugcccuaaugaacgcagagcuuggaacucucucgagguggaggauuacggauucggcauguucacaaccaauauuuggaugaaguuucgggaaggguccagcgaggucugugaccauagacugaugucugccgcuaucaaagaucagaaggccgugcacgccgacaugggauauuggauugaauccagcaaaaaccaaacauggcagaucgagaaggcuucucugauugaaguuaagaccugccucuggcccaaaacacauacccuguggagcaauggcgugcuugagucccagaugcugaucccuaagagcuacgcgggccccuucucucagcacaacuaucgccaaggguacgccacgcagacagucggaccuuggcaccucggcaaacuggagaucgauuuuggggaaugccccggaaccaccgugacaauucaggaggacugugaucaucggggcccgucccugagaaccacgacagcuagcgggaaacuugugacccaguggugcugucgcuccugcacaaugccuccccucagauuccugggagaagacggcuguugguauggcauggagauccggccccugucugagaaagaagagaacauggucaagagccaaguugccgccgggcagggaaccuccgaaacauuuucuaugggccuccugugccuuacccuguucguggaggaaugucuccgcagacgggugacgcgcaagcacaugauucuggcugucgugaucacccugugcgccauuauccuugggggacucacauggauggaucugcugagagcgcucaucaugcugggcgacaccaugagcgggcggauuggaggccagacacaucuugcuaucauggccguuuuuaaaauguccccuggcuacgugcugggggucuuccuccgcaagcugaccucuagagagacggcccugauggugauuggaauggcuaugacaaccacacuuagcaucccgcacgaccugauggagcucauugauggcaucucccuggggcucauccugcuuaaaauuguuacccaguuugacaauacccaagugggaacacuggcccucagccugacguucauccggucuaccaugucccuggucauggcguggcgcacaauuauggcugugcuuuuugucgugacccugaucccccucuguagaacaagcugccugcagaagcagucucauuggguugaaauuaccgcccucauccugggcgcccaagcccuuccuguguaucugaugacgcucaugaaaggggccucccggagaagcuggccccugaacgagggaauuauggcugucggccuggugucucuucugggcuccgcccuccugaagaaugauguuccucucgcggggcccaugguggccggaggccugcuucuggcugccuacgucaugagcggguccagcgcugaccugucucucgaaaaggccgccaacgugcagugggaugagauggcugacaucacaggaagcuccccuaucauugaagugaaacaggaugaggacggcucuuucagcauccgcgauguugaggaaaccaauaugauuacccugcuugucaagcuggcgcucaucacaguguccgggcuguacccccucgccauuccggugaccaugacacugugguauauguggcaggucaaaacgcaacggucuggagcucuuugggacgugccuagccccgccgccacccagaaggcugcccuguccgagggcguuuacagaaucaugcagcgcggccuguuugggaaaacacaggugggagucggcauccacauggaagggguguuccacaccauguggcauguuacacggggaucugugauuugucacgagaccggcagacucgaaccuagcugggcggauguccgcaacgacaugaucuccuaugggggaggcuggcggcugggcgauaagugggacaaggaggaggacgugcaaguucuugcuauugaacccgggaaaaauccgaagcaugugcagacgaaaccuggacuguucaagacccucacaggcgagaucggggccgucacccuggauuuuaaacccggaacaagcggcucuccuauuaucaacagaaaggggaaagugaucggccucuacggaaauggcguggucaccaaguccggggacuauguuagcgccauuacacaggcugaacgcaucggagagcccgauuacgagguggacgaagauauuuuccggaagaaaagacugacgaucauggaccuucaccccggcgccgggaagaccaaacggauucugccuucuaucgugcgcgaggcgcugaagagacggcuccgcacacugauucuugcuccgaccagagucguggccgccgaaauggaggaagcucugcggggacuccccaucagauaucagaccccugccguuaaauccgagcauacaggccgcgagaucguggaucugaugugccacgcuacguuuaccacacggcuccugagcuccaccagaguccccaacuacaaucuuauugugauggacgaagcccacuucacagauccuucuagcguugcggcccgcggguacaucuccacccggguggagaugggcgaagcugccgcuauuuuuaugacggccacacccccuggagccaccgacccguucccccaaagcaacucuccuaucgaggauauugaaagagagauccccgagcgcuccuggaauaccggcuuugacuggaucacagacuaucaggggaagaccgucugguucgugccuagcauuaaggcuggaaacgauaucgcgaauugccugcggaaaucuggcaagaaagucauucagcugagcagaaagacauuugacaccgaauaccccaaaacgaagcucacagauugggacuucgugguuaccacagauaucuccgagaugggggccaacuuucgcgcuggaagagugauugacccgcggcgcugucugaagccugugauccuuaccgauggccccgaaagagucauccuggccgggcccauuccuguuacgcccgccucugcugcccaacggcgcggcagaaucggacggaacccugcgcaggaggacgaucaguauguguucagcggcgacccgcucaaaaaugaugaagaccaugcucacuggaccgaggccaagaugcugcuggauaacauuuacacacccgaggggaucauuccuacccucuucggacccgaaagagagaaaacacaggccaucgacggcgaauuucgccuuagaggggaacaaagaaagaccuucguggagcugaugcgccggggagaccugccugucuggcucuccuauaaaguggcuucugccggcauuagcuacaaggauagagaauggugcuuuacaggcgagcggaauaaccagauccuggaagagaauauggaaguugagaucuggacccgcgagggggaaaagaagaaacuuagaccccgguggcuggacgcgcgcguguaugccgauccgauggcucucaaagacuucaaagaguuugccuccggaagaaaaagcauuacgcuggauauccugacagaaauugcuucucucccuaccuaccuuuccagccgggccaagcuggcucuggacaacaucgucaugcuccauaccacagagcgcggcgggagagccuaccagcacgcgcugaaugaacuucccgagucccuggagacccucaugcugguggcccugcucggagcuaugacagccggcauuuuccucuuuuucaugcaggggaagggaaucggcaaacugucuaugggccugaucacgauugcugucgccagcgggcuccuguggguggccgaaauccaaccucaguggauugcugcguccaucauucuugaguuuuuccugaugguucuccugauccccgaaccugagaagcagcggacaccccaggauaaccaacugaucuaugugauucucgccauccuuacaauuaucggacugauugcugccaaugaaaugggccugaucgagaaaaccaagacagacuuuggguucuaccaggucaaaaccgagacgaccauucucgauguggaccugcgcccggccucugcuuggacacuuuaugccguugcgaccacaauccugaccccuaugcucagacacacgaucgaaaacacaagcgccaaucugucccuggcugccauugcuaaccaggccgcggugcucaugggacuuggcaagggguggccccugcaucggauggaucugggagucccccuccuggccaugggcuguuacagccaggugaauccuaccacacuuaccgcuucucuggugaugcuccugguucacuaugccaucauuggcccggggcugcaagcuaaagccaccagagaggcucagaagcgcacagccgcgggaaucaugaagaaccccacggucgacggcauuaccgugaucgaucucgaaccuaucuccuacgaccccaaauuugagaagcagcuugggcaagugaugcugcugguccucugcgccggacagcugcuucugaugcggacaaccugggcuuucugugagguucucacacuggccaccggcccuauucugacgcucugggaagggaaucccggaagauucuggaacacaaccaucgcugugagcaccgccaacauuuuucgcggcucuuaucuugccggcgcggggcuggcuuucucccugaucaaaaaugcccagacaccucggagaggaaccggcacaacgggggagacccucggagaaaaguggaaacgccagcugaacagccuugaccggaaggaguuugaagaguacaagagaucuggcauucuggagguggaucgcacagaagcuaaaagcgcccucaaggacggguccaaaaucaagcaugccgucucucggggaagcuccaaaaucagauggauuguggagcgcggcaugguuaagccgaagggcaaaguggucgaucuggggugcggacggggcggguggagcuacuauauggcuacccugaagaaugugacagaaguuaaaggauacaccaagggcgggcccggacacgaggaaccuauccccauggccacguauggcuggaaccucgugaaacuucauuccggcgucgacguguucuacaagccuaccgagcaaguggauacacugcugugugacauuggggagucuagcuccaaucccaccaucgaagagggaagaacacuccgcguccugaagaugguugaaccguggcuuucuagcaaaccugaguuuugcauuaaggugcugaaccccuauaugcccaccgugaucgaggaacucgagaaacugcagagaaagcacggcgggaaucugguccgguguccucucucccgcaacucuacacacgaaauguacugggugagcggagcguccggcaauauuguuagcucugugaacaccacguccaaaaugcuucugaauagauucacaacccggcauagaaagcccaccuaugagaaagaugucgaccugggggccggaacacggagcgugucuacggaaaccgagaagccugauaugacaaucaucggccgcagacuccagcggcugcaggaggaacacaaggagaccuggcauuacgaccaagaaaacccguaccgcacaugggcuuaucacggcuccuacgaggcccccagcaccgggucugcuuccagcaugguuaauggaguggucaaacuucugacaaagccuugggaugugauucccaugguuacccagcucgccaugacggacaccacaccuuuuggccagcagagaguguucaaagaaaaggucgacacccggacaccccaaccgaaaccugggacccgcauggugaugacgacaaccgcgaacuggcugugggcccugcucggaaagaagaaaaaucccagacugugcacacgggaggaguuuaucuccaagguccgcagcaacgcugccauuggcgcuguguuccaggaggagcagggguggaccucugccagcgaagcuguuaaugauuccagauuuugggagcuuguggacaaagaacgggcccugcaccaagagggcaagugugagucuugcgucuauaacaugaugggaaaacgcgaaaagaagcucggcgaguucgggagagcgaaaggaagccgggccaucugguacauguggcugggcgcucgcuuucuugaguucgaggcccugggguuccucaacgaagaucauugguuuggaagagaaaauuccuggucuggcguggagggggaaggccugcaccggcugggauauauucucgaggaaaucgacaagaaagauggcgaccugauguacgcugaugacacggccgggugggauaccagaaucacagaggacgaucuucagaacgaggaacugauuaccgagcagauggccccucaucacaagauccucgcgaaagcuauuuucaagcugacauaucagaauaaggugguuaaagugcuucgccccaccccucggggagccgucauggacaucauuagcagaaaggaucaacgcggcuccggacaggugggaacauacggccugaacaccuuuacgaauauggaaguucagcucauccggcagauggaggccgaaggggugaucacacaagacgacaugcagaaccccaaaggccugaaggagagagucgagaaauggcugcgcgaaugcggaguggaucggcucaagagaauggcuauuucuggcgacgauugugucgugaaaccgcuggacgagcgcuucgggaccagccuucuguuucucaaugauaugggaaagguucggaaggacaucccucagugggaacccuccaaaggcuggaagaacuggcaggaggugcccuucugcagccaucacuuucacaaaauuuucaugaaggaugggagaucucuggucgugccuugucgcaaucaagacgaacuuaucggacgggccagaauuucccagggcgcuggguggagccugcgggagaccgccugccucggcaaagcguacgcccagauguggucucugauguauuuucauagacgcgaucugcggcucgcuuccauggccaucuguagcgcuguuccgacagagugguuccccaccuccagaacaacguggucuauccacgcccaucaccaguggaugaccacagaagacaugcugaagguguggaaccgcgucuggauugaggauaauccuaacaugaucgacaagacccccgugcacagcugggaagacauuccuuaccuuggaaaaagagaggaucuguggugcggcucccucaucgggcugagcucucgggcgacaugggccaagaauauucauaccgcuaucacgcaagugcgcaaccuuauuggaaaagaagaguauguugacuacaugcccgucaugaagagauauuccgccccuagcgagucugaaggcgugcuguga

SEQ ID NO: 20984 - RNA, 9867 nt, Artificial Sequence
  derived and/or modified CDS sequence (opt5) from DENV-4__FJ882595__SS-prME
agcaccaucacccugcuuugccugauucccacggccauggcuuuccaccuuuccaccagagacggagagccucugaugaucguggccaagcaugaacgggggcgcccgcuccuguuuaagacaaccgagggaauuaacaaguguacccuuaucgcgauggaucugggagaaaugugcgaggacaccgugacauacaaguguccccuccugguuaauaccgaaccugaggauauugacugcugguguaaccugacgucuaccugggugauguaugggacaugcacccagagcggagagagacggcgcgaaaagagauccguggcucucacaccccacucuggcauggggcuggagacccgggccgaaacguggaugagcuccgagggagccuggaagcaugcucagcgcgucgagucuuggauccuuagaaauccuggcuucgcccugcucgcuggcuuuauggccuacaugaucgggcagacaggcauucagcggaccguguucuuuguucugaugaugcuuguggcgcccagcuauggcaugcgcugugucggggugggaaacagagauuucguugaaggcguguccgggggagccugggucgaccuggugcucgagcacggcggcugcgugacaaccauggcucaggggaagccuacccuggauuuugaacugacaaagacgaccgccaaagaggucgcucuccugcggacauacuguaucgaagccagcauuucuaauaucaccacagcgacccgcugcccgacgcaaggagagcccuaucuuaaggaggaacaggaccagcaguacauuuguagacgggauguuguggaccgcggcugggggaacggaugcggccuguucgggaaaggaggcguggucacaugcgccaaguuuuccuguagcggcaaaaucaccgggaaucucgugcaaauugagaaccuggaauauaccguuguggucacagugcauaauggagauacccacgcuguuggcaacgacacaucuaaucacggggugacggccaccaucacaccuagaucccccagcgucgaggugaaacuuccugauuacggagaacugacccucgacugcgagccccggucuggcaucgacuucaacgagaugauucugaugaagaugaaaaagaaaacauggcugguccauaagcagugguuucucgaucugccgcuuccuuggaccgcuggggccgacacguccgaagugcacuggaauuacaaagagagaaugguuaccuucaaggugccccaugccaaacgccaggaugucacagugcugggcagccaggaaggagcuaugcacuccgcgcucgccggcgcuaccgagguugacucuggggauggaaaccacauguuugccggccaucugaaguguaaggugcggauggaaaaacuuagaaucaaggggaugagcuauacaaugugcuccggaaaauucagcauugacaaggagauggccgagacccaacacggcacgacagucgugaaagugaaguacgaaggggcuggcgccccuuguaagguucccaucgagauucgcgaugucaauaaagaaaagguggugggacgggucaucucuuccacaccccuggcggagaacacaaacagcgugaccaauaucgagcucgaaccuccguucggcgacucuuauauuguuaucggggugggaaacagcgcucugacccugcauugguuuagaaaaggcuccucuauugggaagauguucgagagcacauaccgcggagccaaacggauggccauccucggcgaaacggcuugggauuuuggguccgucggcggacuguucaccagccuuggcaaggccgugcaccagguuuuugggucuguguauacaaccauguucggaggcgucuccuggaugauuagaauccugaucggguuucucgugcuguggauuggaacaaauagccgcaacaccucuauggcuaugacgugcaucgccguuggcgggauuacacuguuccuuggcuuuaccgugcaggcggacaugggaugugucguguccuggagcggccgggagcucaagugcggguccggaaucuucguggucgauaauguucauaccuggacagaacaauacaaauuucagcccgagucuccugccagacuggcuagcgccauucugaacgcucacaaggacggcgugugugggauccgcuccaccacacggcucgagaaugugauguggaaacagauuacgaacgaacugaauuauguccuuugggagggaggccacgaccugaccgugguugccggcgaugugaaggggguccucacaaaaggaaagagagcgcugacacccccugugucugaccugaaguacagcuggaaaacauggggcaaggccaaaaucuucacccccgaagcucggaacuccacguuucuuaucgaugggccggacaccagcgagugcccuaaugaacgcagagccuggaacucucucgagguugaggauuacggauucggcauguucacaaccaauauuuggaugaaguuucgggaaggguccagcgaggugugugaccauagacugaugucugcugccaucaaagaucagaaggccguccacgcugacaugggauauuggauugaauccagcaaaaaccaaacauggcagaucgagaaggcgucucugauugaagugaagaccugccucuggcccaaaacacauacccuguggagcaauggcguucuugagucccagaugcugaucccuaagagcuacgccggccccuucucucagcacaacuaucgccaaggguacgcuacgcagacagugggaccuuggcaccucggcaaacuggagaucgauuuuggggaaugccccggaaccaccgucacaauucaggaggacugugaucaucggggcccgucccugagaaccacgacagccagcgggaaacuugugacccaguggugcugucgcuccugcacaaugccuccccucagauuccugggagaagacggcuguugguauggcauggagauccggccccugucugagaaagaagagaacauggucaagagccaagucgccgcugggcagggaaccuccgaaacauuuucuaugggccuccugugccuuacccuguucguugaggaaugucuccgcagacgggugacgcgcaagcacaugauucuggccguggucaucacccugugcgcgauuauccuugggggacucacauggauggaucugcugagagcucucaucaugcugggcgacaccaugagcgggcggauuggaggccagacacaucuugccaucauggccguguuuaaaauguccccuggcuacguucuggggguguuccuccgcaagcugaccucuagagagacggcucugauggucauuggaauggccaugacaaccacacuuagcaucccgcacgaccugauggagcucauugauggcaucucccuggggcucauccugcuuaaaauugugacccaguuugacaauacccaaguuggaacacuggcgcucagccugacguucauccggucuaccaugucccuggugauggcuuggcgcacaauuauggccguccuuuuuguggucacccugaucccccucuguagaacaagcugccugcagaagcagucucauuggguggaaauuaccgcccucauccugggcgcucaagcccuuccuguuuaucugaugacgcucaugaaaggggcuucccggagaagcuggccccugaacgagggaauuauggccgugggccuggucucucuucugggcuccgcgcuccugaagaaugaugugccucucgccgggcccaugguugcuggaggccugcuucuggccgcuuacgugaugagcggguccagcgccgaccugucucucgaaaaggccgcuaacguccagugggaugagauggcggacaucacaggaagcuccccuaucauugaagugaaacaggaugaggacggcucuuucagcauccgcgauguggaggaaaccaauaugauuacccugcuuguuaagcuggcccucaucacagucuccgggcuguacccccucgcuauuccggugaccaugacacugugguauauguggcaagugaaaacgcaacggucuggagcccuuugggacgucccuagccccgccgcuacccagaaggccgcgcuguccgagggcguguacagaaucaugcagcgcggccuguuugggaaaacacagguuggagugggcauccacauggaaggggucuuccacaccauguggcaugugacacggggaucuguuauuugucacgagaccggcagacucgaaccuagcugggcugaugugcgcaacgacaugaucuccuaugggggaggcuggcggcugggcgauaagugggacaaggaggaggacguccaagugcuugccauugaacccgggaaaaauccgaagcauguucagacgaaaccuggacuguucaagacccucacaggcgagaucggggccgugacccuggauuuuaaacccggaacaagcggcucuccuauuaucaacagaaaggggaaagucaucggccucuacggaaauggcguggugaccaaguccggggacuaugucagcgcuauuacacaggccgaacgcaucggagagcccgauuacgagguugacgaagauauuuuccggaagaaaagacugacgaucauggaccuucaccccggcgcggggaagaccaaacggauucugccuucuaucgugcgcgaggcucugaagagacggcuccgcacacugauucuugccccgaccagaguggucgccgcugaaauggaggaagcccugcggggacuccccaucagauaucagaccccugcugugaaauccgagcauacaggccgcgagaucguugaucugaugugccacgccacguuuaccacacggcuccugagcuccaccagagugcccaacuacaaucuuauugucauggacgaagcgcacuucacagauccuucuagcguggccgcucgcggguacaucuccacccggguugagaugggcgaagccgcugccauuuuuaugacggccacacccccuggagcuaccgacccguucccccaaagcaacucuccuaucgaggauauugaaagagagauccccgagcgcuccuggaauaccggcuuugacuggaucacagacuaucaggggaagaccgugugguucgucccuagcauuaaggcgggaaacgauaucgccaauugccugcggaaaucuggcaagaaagugauucagcugagcagaaagacauuugacaccgaauaccccaaaacgaagcucacagauugggacuucgucgugaccacagauaucuccgagaugggggcuaacuuucgcgccggaagaguuauugacccgcggcgcugucugaagccugugauccuuaccgauggccccgaaagagugauccuggccgggcccauuccugucacgcccgcuucugccgcgcaacggcgcggcagaaucggacggaacccugcucaggaggacgaucaguauguuuucagcggcgacccgcucaaaaaugaugaagaccaugcccacuggaccgaggccaagaugcugcuggauaacauuuacacacccgaggggaucauuccuacccucuucggacccgaaagagagaaaacacaggcuaucgacggcgaauuucgccuuagaggggaacaacggaagaccuucguggagcugaugcgccggggagaccugccuguguggcucuccuauaaagucgccucugcgggcauuagcuacaaggauagagaauggugcuuuacaggcgagcggaauaaccagauccuggaagagaauauggaaguggagaucuggacccgcgagggggaaaagaagaaacuuagaccccgguggcuggacgcccgcguuuaugcugauccgauggcccucaaagacuucaaagaguuugcuuccggaagaaaaagcauuacgcuggauauccugacagaaauugccucucucccuaccuaccuuuccagccgggcuaagcuggcccuggacaacaucgugaugcuccauaccacagagcgcggcgggagagcguaccagcacgcccugaaugaacuucccgagucccuggagacccucaugcuggucgcucugcucggagccaugacagcuggcauuuuccucuuuuucaugcaggggacgggaaucggcaagcugucuaugggccugaucaccauugccguggccagcgggcuccugugggucgcugaaauccaaccucaguggauugcggccuccaucauucuugaguuuuuccugauggugcuccugauccccgaaccugagaaacagcggacaccccaggauaaccaacugaucuauguuauucucaccauccuuacaauuaucggacugauugcugccaaugaaaugggccugaucgagaagaccaaaacggacuuuggguucuaccaggugaagaccgagacaaccauucucgaugucgaccugcgcccggccucugcuuggacacuuuaugccguggcgaccacgauccugacaccuaugcucagacacaccaucgaaaacacaagcgccaaucugucccuggcugccauugcuaaccaggccgcgguucucaugggacuuggcaaaggguggccccugcaucggauggaucugggagugccccuccuggccaugggcuguuacagccaggucaauccuaccacccuuacagcuucucuggugaugcuccuggugcacuaugccaucauuggcccggggcugcaagcuaaggccacgagagaggcucagaaacgcaccgccgcgggaaucaugaagaaccccacaguugacggcauuaccgucaucgaucucgaaccuaucuccuacgaccccaaguuugagaaacagcuugggcaagugaugcugcuggugcucugcgccggacagcugcuucugaugcggacaaccugggcuuucugugagguccucacgcuggccacaggcccuauucugacccucugggaagggaaucccggaagauucuggaacaccacaaucgcuguuagcaccgccaacauuuuucgcggcucuuaucuugccggcgcggggcuggcuuucucccugaucaagaaugcccagacaccucggagaggaacgggcaccacaggggagacccucggagaaaaauggaagcgccagcugaacagccuugaccggaaagaguuugaagaguacaagagaucuggcauucuggagguggaucgcacagaagcuaagagcgcccucaaagacggguccaagaucaaacaugccgugucucggggaagcuccaagaucagauggauugucgagcgcggcauggugaaaccgaagggcaagguuguggaucuggggugcggacggggcggguggagcuacuauauggcuacccugaaaaaugucacggaagugaagggauacaccaaaggcgggcccggacacgaggaaccuauccccauggccacauauggcuggaaccucguuaaacuucauuccggcguggacgucuucuacaaaccuaccgagcaaguggauacacugcugugugacauuggggagucuagcuccaaucccaccaucgaagagggaagaacacuccgcgugcugaagauggucgaaccguggcuuucuagcaagccugaguuuugcauuaaaguucugaaccccuauaugcccaccgugaucgaggaacucgagaagcugcagagaaaacacggcgggaaucuggugcgguguccucucucccgcaacucuacgcacgaaauguacugggucagcggagcguccggcaauauugugagcucuguuaacacaaccuccaagaugcuucugaauagauucaccacacggcauagaaaacccacguaugagaaggauguggaccugggggccggaacccggagcgucucuacagaaaccgagaaaccugauaugacaaucaucggccgcagacuccagcggcugcaggaggaacacaaggagaccuggcauuacgaccaagaaaacccguaccgcacaugggcuuaucacggcuccuacgaggcccccagcaccgggucugcuuccagcauggugaauggaguugugaaacuucugacgaaaccuugggaugucauucccauggugacccagcucgccaugacagacaccacaccuuuuggccagcagagaguuuucaaggaaaaaguggacacccggacgccccaaccgaagccugggacacgcauggucaugaccacaaccgcgaacuggcugugggcccugcucggcaagaagaagaaucccagacugugcacgcgggaggaguuuaucuccaaagugcgcagcaacgcugccauuggcgcugucuuccaggaggaacagggguggaccucugccagcgaagcugugaaugauuccagauuuugggagcuuguugacaaggaacgggcccugcaccaagagggcaaaugugagucuugcguguauaacaugaugggaaagcgcgagaagaagcucggcgaguucgggagagcgaagggaagccgggccaucugguacauguggcugggcgcucgcuuucuugaguucgaggcccugggguuccucaacgaagaucauugguuuggaagagaaaauuccuggucuggcgucgagggggaaggccugcaccggcugggauauauucucgaggaaaucgacaaaaaggauggcgaccugauguacgcugaugacacagccgggugggauaccagaaucacagaggacgaucuucagaacgaggaacugauuaccgagcagauggccccucaucacaaaauccucgcgaaggcuauuuucaaacugacauaucagaauaagguggugaagguucuucgccccaccccucggggagccgugauggacaucauuagcagaaaagaucaacgcggcuccgggcaggucggaacguacggccugaacacauuuaccaauauggaagugcagcucauccggcagauggaggccgaagggguuaucacccaagacgacaugcagaaccccaagggccugaaagagagaguggagaaguggcugcgcgaaugcggagucgaucggcucaaaagaauggcuauuucuggcgacgauuguguggucaagccgcuggacgagcgcuucgggacaagccuucuguuucucaaugauaugggaaaagugcggaaggacaucccucagugggaacccuccaagggcuggaaaaacuggcaggagguucccuucugcagccaucacuuucacaagauuuucaugaaagaugggagaucucugguggucccuugucgcaaucaagacgaacuuaucggacgggccagaauuucccagggcgcuggguggagccugcgggagaccgccugccucggcaaggcguacgcccagauguggucucugauguauuuucauagacgcgaucugcggcucgcuuccauggccaucuguagcgcugugccgacagagugguuccccacguccagaaccacauggucuauccacgcccaucaccaguggaugaccacagaagacaugcugaaaguuuggaaccgcguguggauugaggauaauccuaacaugaucgacaagacccccguccacagcugggaagacauuccuuaccuuggaaagagagaggaucuguggugcggcucccucaucgggcugagcucucgggcgacgugggccaaaaauauucauaccgcuaucacacaagugcgcaaccuuauuggaaaggaagaguauguggacuacaugcccguuaugaaaagauauuccgccccuagcgagucugaaggcguccuguga

SEQ ID NO: 20985 - RNA, 9867 nt, Artificial Sequence
  derived and/or modified CDS sequence (opt5) from DENV-4__FJ882596__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaccaucacaccuagaucccccagcguggaggucaagcuuccugauuacggagaacugacccucgacugcgagccccggucuggcaucgacuucaacgagaugauucugaugaagaugaaaaagaaaacauggcuggugcauaagcagugguuucucgaucugccgcuuccuuggaccgccggggcugacacguccgaaguucacuggaauuacaaagagagaauggugaccuucaaggucccccaugccaaacgccaggaugugacaguucugggcagccaggaaggagccaugcacuccgcucucgcgggcgccaccgagguggacucuggggauggaaaccacauguuugcuggccaucugaaguguaagguccggauggaaaaacuuagaaucaaggggaugagcuauacaaugugcuccggaaaauucagcauugacaaggagauggccgagacccaacacggcacgacaguggugaaaguuaaguacgaaggggccggcgcuccuuguaagguccccaucgagauucgcgaugugaauaaagaaaagguggucggacgggugaucucuuccaccccccuggccgagaacacaaacagcguuaccaauaucgagcucgaaccuccguucggcgacucuuauauugugaucggggucggaaacagcgcgcugacccugcauugguuuagaaaaggcuccucuauugggaagauguucgagagcacauaccgcggagcuaaacggauggccauccucggcgaaacggccugggauuuuggguccgugggcggacuguucaccagccuuggcaaggcuguucaccagguguuugggucugucuauacaaccauguucggaggcguguccuggaugauuagaauccugaucggguuucucguucuguggauuggaacaaauagccgcaacaccucuauggccaugacgugcaucgcugugggcgggauuacacuguuccuuggcuuuaccguccaggccgacaugggaugugugguguccuggagcggccgggagcucaagugcggguccggaaucuucgucguugauaaugugcauaccuggacagaacaauacaaauuucagcccgagucuccugcgagacuggccagcgcuauucugaacgcccacaaggacggcgugugugggauccgcuccaccacacggcucgagaaugucauguggaaacagauuacgaacgaacugaauuaugugcuuugggagggaggccacgaccugaccguuguggcuggcgaugucagaggggugcucacaaagggaaaacgggcccugacccccccuguuucugaccugaaguacagcuggaagacauggggcaaagcgaagaucuucacccccgaagcccgcaacuccacguuucuuaucgaugggccggacaccagcgagugcccuaaugaaagacgggcuuggaacucucucgagguggaggauuacggauucggcauguucacaaccaauauuuggaugaaauuuagagaaggguccagcgaggucugugaccaucgccugaugucugccgcuaucaaggaucagaaagccgugcacgccgacaugggauauuggauugaauccagcaagaaccaaacauggcagaucgagaaagcuucucugauugaaguuaagaccugccucuggcccaagacacauacccuguggagcaauggcgugcuugagucccagaugcugaucccuaaaagcuacgcgggccccuucucucagcacaacuaucggcaaggguacgccacgcagacagucggaccuuggcaccucggcaagcuggagaucgauuuuggggaaugccccggaaccaccgugacaauucaggaggacugugaucauagaggcccgucccugcgcaccacgacagcuagcgggaaacuugugacccaguggugcuguagauccugcacaaugccuccccuccgguuccugggagaagacggcuguugguauggcauggagauccgcccccugucugagaaggaagagaacauggucaaaagccaaguugccgccgggcagggaaccuccgaaacauuuucuaugggccuccugugccuuacccuguucguggaggaaugucucagacggcgcgugacgagaaagcacaugauucuggcugucgugaucacccugugcgccauuauccuugggggacucacauggauggaucugcugcgggcgcucaucaugcugggcgacaccaugagcgggcgcauuggaggccagacacaucuugcuaucauggccguuuuuaagauguccccuggcuacgugcugggggucuuccucagaaaacugaccucucgggagacggcccugauggugauuggaauggcuaugacaaccacacuuagcaucccgcacgaccugauggagcucauugauggcaucucccuggggcucauccugcuuaagauuguuacccaguuugacaauacccaagugggaacacuggcccucagccugacguucauccgcucuaccaugucccuggucauggcguggagaacaauuauggcugugcuuuuugucgugacccugaucccccucugucggacaagcugccugcagaaacagucucauuggguugaaauuaccgcccucauccugggcgcccaagcucuuccuguguaucugaugacgcucaugaagggggccuccagacgcagcuggccccugaacgagggaauuauggcugucggccuggugucucuucugggcuccgcccuccugaaaaaugauguuccucucgcggggcccaugguggccggaggccugcuucuggcugccuacgucaugagcggguccagcgcugaccugucucucgaaaaggccgccaacgugcagugggaugagauggcugacaucacaggaagcuccccuaucauugaagugaagcaggaugaggacggcucuuucagcauccgggauguugaggaaaccaauaugauuacccugcuugucaaacuggcgcucaucacaguguccgggcuguacccccucgccauuccggugaccaugacacugugguauauguggcaggucaagacgcaaagaucuggagcucuuugggacgugccuagccccgccgccacccagaaagcugcccuguccgagggcguuuaccgcaucaugcagcggggccuguuugggaagacacaggugggagucggcauccacauggaagggguguuccacaccauguggcauguuacaagaggaucugugauuugucacgagaccggccgccucgaaccuagcugggcggauguccggaacgacaugaucuccuaugggggaggcuggagacugggcgauaaaugggacaaggaggaggacgugcaaguucuugcuauugaacccgggaagaauccgaaacaugugcagacgaagccuggacuguucaaaacccucacaggcgagaucggggccgucacccuggauuuuaagcccggaacaagcggcucuccuauuaucaaccgcaaagggaaggugaucggccucuacggaaauggcguggucaccaaauccggggacuauguuagcgccauuacacaggcugaacggaucggagagcccgauuacgagguggacgaagauauuuucagaaagaagcggcugacgaucauggaccuucaccccggcgccgggaaaaccaagcgcauucugccuucuaucgugagagaggcgcugaaacggcgccucagaacacugauucuugcuccgacccgggucguggccgccgaaauggaggaagcucugagaggacuccccauccgcuaucagaccccugccguuaaguccgagcauacaggccgggagaucguggaucugaugugccacgcuacguuuaccacaagacuccugagcuccacccgcguccccaacuacaaucuuauugugauggacgaagcccacuucacagauccuucuagcguugcggcccggggguacaucuccaccagaguggagaugggcgaagcugccgcuauuuuuaugacggccacacccccuggagccaccgacccguucccccaaagcaacucuccuaucgaggauauugaacgcgagauccccgagcgguccuggaauaccggcuuugacuggaucacagacuaucaggggaaaaccgucugguucgugccuagcauuaaggcuggaaacgauaucgcgaauugccugagaaagucuggcaaaaaggucauucagcugagccgcaaaacauuugacaccgaauaccccaagacgaaacucacagauugggacuucgugguuaccacagauaucuccgagaugggggccaacuuuagagcuggacgggugauugacccgcgcagaugucugaagccugugauccuuaccgauggccccgaacgggucauccuggccgggcccauuccuguuacgcccgccucugcugcccaacgcagaggccggaucggaagaaacccugcgcaggaggacgaucaguauguguucagcggcgacccgcucaagaaugaugaagaccaugcucacuggaccgaggccaaaaugcugcuggauaacauuuacacacccgaggggaucauuccuacccucuucggacccgaacgcgagaagacacaggccaucgacggcgaauuucggcuuagaggggagcaacgcaaaaccuucguggagcugaugcggagaggagaccugccugucuggcucuccuauaagguggcuucugccggcauuagcuacaaagaucgggaauggugcuuuacaggcgagcgcaauaaccagauccuggaagagaauauggaaguugagaucuggaccagagagggggaaaagaagaaacuucggccccgcuggcuggacgcgagaguguaugccgauccgauggcucucaaggacuucaaagaguuugccuccggacggaagagcauuacgcuggauauccugacagaaauugcuucucucccuaccuaccuuuccagccgcgccaaacuggcucuggacaacaucgucaugcuccauaccacagagagaggcgggcgggccuaccagcacgcgcugaaugaacuucccgagucccuggagacccucaugcugguggcccugcucggagcuaugacagccggcauuuuccuuuuuuucaugcaggggaagggaaucggcaagcugucuaugggccugaucacgauugcugucgccagcgggcuccuguggguggccgaaauccaaccucaguggauugcugcguccaucauucuugaguuuuuccugaugguucuccugauccccgaaccugagaaacagcgcaccccccaggauaaccaacugaucuaugugauucucacaauccuuaccauuaucggacugauugccgcuaaugaaaugggccugaucgagaagacaaaaaccgacuuuggguucuaccaggucaagacggagaccacaauucucgauguggaccugagaccggccucugccuggacccuuuaugcuguugccacaaccauccugacgccuaugcuccggcacacaaucgaaaacaccagcgcgaaucugucccuggccgcuauugccaaccaggcugccgugcucaugggacuuggcaaaggguggccccugcauagaauggaucugggagucccccuccuggcgaugggcuguuacagccaggugaauccuacaacccuuaccgccucucuggugaugcuccugguucacuaugcuaucauuggcccggggcugcaagccaaggcuacacgcgaggcccagaaacggacggcugccggaaucaugaagaaccccaccgucgacggcauuacagugaucgaucucgaaccuaucuccuacgaccccaaguuugagaaacagcuugggcaagugaugcugcugguccucugcgcgggacagcugcuucugaugagaaccacaugggccuucugugagguucucacccuggcuacgggcccuauucugacacucugggaagggaaucccggacgcuucuggaacaccaccaucgccgugagcacagcuaacauuuuucggggcucuuaucuugccggcgccgggcuggcguucucccugaucaagaaugcucagaccccuagacgcggaacaggcacgaccggggagacacucggagaaaaauggaagcggcagcugaacagccuugacagaaaagaguuugaagaguacaagcgcucuggcauucuggagguggaucggaccgaagccaagagcgcucucaaagacggguccaagaucaaacaugccgucucuagaggaagcuccaagauccgcuggauuguggagcggggcaugguuaaaccgaagggcaagguggucgaucuggggugcggaagaggcggguggagcuacuauauggccacacugaaaaaugugaccgaaguuaagggauacacgaaaggcgggcccggacacgaggaaccuauccccauggcuaccuauggcuggaaccucgugaagcuucauuccggcgucgacguguucuacaaaccuacagagcaaguggauacccugcugugugacauuggggagucuagcuccaaucccacaaucgaagagggacgcacccucagaguccugaagaugguugaaccguggcuuucuagcaagccugaguuuugcauuaaagugcugaaccccuauaugcccacagugaucgaagagcucgagaagcugcagcggaaacacggcgggaaucugguccgcuguccucucuccagaaacucuacccacgaaauguacugggugagcggagccuccggcaauauuguuagcucugugaacacgacauccaagaugcuucugaaucgguucaccaccagacaucggaaacccacauaugagaaggaugucgaccugggggcgggaacgcgcagcgugucuaccgaaacagagaaaccugauaugaccaucaucggcagacggcuccagcgccugcaggaggaacacaaggagacauggcauuacgaccaagaaaacccguacagaaccugggccuaucacggcuccuacgaggcucccagcacagggucugccuccagcaugguuaauggaguggucaagcuucugaccaaaccuugggaugugauucccaugguuacgcagcucgcuaugaccgacacaaccccuuuuggccagcagcggguguucaaggaaaaagucgacacacgcaccccccaaccgaagccugggacgagaauggugaugacaaccacagccaacuggcugugggcgcugcucggaaaaaagaagaauccccggcugugcacccgcgaggaguuuaucuccaaagucagaagcaacgccgcuauuggcgccguguuccaggaagagcagggguggacgucugcuagcgaagccguuaaugauucccgguuuugggagcuuguggacaaggaacgcgcucugcaccaagagggcaaaugugagucuugcgucuauaacaugaugggaaagagagaaaaaaagcucggcgaguucgggcgggccaagggaagccgcgcgaucugguacauguggcugggcgccagauuucuugaauucgaggcucugggguuccucaacgaagaucauugguuuggacgggagaauuccuggucuggcguggagggggaaggccugcacagacugggauauauucucgaggaaaucgacaaaaaggauggcgaccugauguacgccgaugacaccgcugggugggauacacgcaucaccgaggacgaucuucagaacgaggaacugauuacagagcagauggccccucaucacaaaauccucgccaaggcgauuuucaaacugaccuaucagaauaaggugguuaaggugcuucggcccacaccuagaggagcugucauggacaucauuagccgcaaagaucaacggggcuccgggcaggugggaaccuacggccugaacacguuuacaaauauggaaguucagcucaucagacagauggaggccgaaggggugaucacccaagacgacaugcagaaccccaagggccugaaagagcgcgucgagaaguggcugcgggaaugcggaguggauagacucaaacgcauggccauuucuggcgacgauugugucgugaagccgcuggacgagcgguucgggaccagccuucuguuucucaaugauaugggaaaaguuagaaaggacaucccucagugggaacccuccaagggcuggaaaaacuggcaggaggugcccuucugcagccaucacuuucacaagauuuucaugaaagaugggcgcucucuggucgugccuugucggaaucaagacgaacuuaucggaagagcucggauuucccagggcgccggguggagccugagagagacagcuugccucggcaaggccuacgcgcagauguggucucugauguauuuucaucgccgggaucugagacucgccuccauggcuaucuguagcgccguuccgaccgagugguuccccacaucccgcacgaccuggucuauccacgcucaucaccaguggaugacaaccgaagacaugcugaaaguguggaacagagucuggauugaggauaauccuaacaugaucgacaagacacccgugcacagcugggaagacauuccuuaccuuggaaagcgggaggaucuguggugcggcucccucaucgggcugagcucucgcgccaccugggcgaaaaauauucauacggccaucacccaagugagaaaccuuauuggaaaggaagaguauguugacuacaugcccgucaugaaacgguauuccgcuccuagcgagucugaaggcgugcuguga

SEQ ID NO: 20986 - RNA, 9867 nt, Artificial Sequence
  derived and/or modified CDS sequence (opt5) from DENV-4__FJ850059__SS-prME
agcaccaucacacugcuuugccugauucccacggugauggccuuccaccuuuccaccagagacggagagccucugaugaucgucgcuaagcaugaacgggggcgcccgcuccuguuuaagaccaccgagggaauuaauaaguguacccuuaucgccauggaucugggagaaaugugcgaggacaccguuacauacaaguguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggaguguggguggaccugguccucgagcacggcggcugcguuacaaccauggcgcaggggaagccuacccuggauuuugaacugacaaagacgaccgccaaagagguggcucuccugcggacauacuguaucgaagccagcauuucuaauaucaccacagcuacccgcugcccgacgcaaggagagcccuaucuuaaggaggaacaggaccagcaguacauuuguagacgggauguggucgaccgcggcugggggaacggaugcggccuguucgggaaaggaggcgugguuacaugcgccaaguuuuccuguagcggcaaaaucaccgggaaucucgugcaaauugagaaccuggaauauaccgucgugguuacagugcauaauggagauacccacgcggucggcaacgacacaucuaaucacggggugacggccaccaucacaccuagaucccccagcgucgaggugaaacuuccugauuacggagaacugacccucgacugcgagccccggucuggcaucgacuucaacgagaugauucugaugaagaugaaaaagaaaacauggcugguucauaagcagugguuucucgaucugccgcuuccuuggaccgcuggggccgacacguccgaagugcacuggaauuacaaagagagaauggucaccuucaaggugccccaugcuaaacgccaggauguuacagugcugggcagccaggaaggagccaugcacuccgcccucgcuggcgcgaccgaggucgacucuggggauggaaaccacauguuugccggccaucugaaguguaaggugcggauggaaaaacuuagaaucaaggggaugagcuauacaaugugcuccggaaaauucagcauugacaaggagauggcugagacccaacacggcacgacagugguuaaagucaaguacgaaggggccggcgccccuuguaaggugcccaucgagauucgcgaugugaauaaagaaaaggucgugggacggguuaucucuuccacaccccuggcugagaacacaaacagcgugaccaauaucgagcucgaaccuccguucggcgacucuuauauugucaucggggugggaaacagcgcccugacccugcauugguuuagaaaaggcuccucuauugggaagauguucgagagcacauaccgcggagcgaaacggauggcuauccucggcgaaacggccugggauuuuggguccguuggcggacuguucaccagccuuggcaaggccgugcaccaggucuuugggucuguguauacaaccauguucggaggcguuuccuggaugauuagaauccugaucggguuucucgugcuguggauuggaacaaauagccgcaacaccucuauggcuaugacgugcaucgccgucggcgggauuacacuguuccuuggcuuuaccgugcaggcugacaugggauguguggucuccuggagcggccgggagcucaagugcggguccggaaucuucguuguggauaaugugcauaccuggacagaacaauacaaauuucagcccgagucuccugccagacuggcgagcgccauucugaucgcucacaaggacggcgucugugggauucgcuccaccacacggcucgagaacgugauguggaaacagaucacgaaugaacugaacuauguucuuugggagggaggccacgaccugaccguggucgccggcgaugcuaagggggugcucacaaaaggaaagagagcccugacacccccuguuucugaccugaaguacagcuggaaaacauggggcaaggcgaaaaucuucacccccgaagccagaaauuccacguuucuuauugaugggccggacaccagcgagugcccuaacgaacgcagagcuuggaacucucucgagguggaggauuacggauucggcauguucacaaccaacaucuggaugaaguuucgggaaggguccagcgaggucugugaccauagacugaugucugccgcuauuaaagaucagaaggccgugcacgccgacaugggauauuggaucgaauccagcaaaaaucaaacauggcagauugagaaggcuucucugaucgaaguuaagaccugccucuggcccaaaacacauacccuguggagcaacggcgugcuugagucccagaugcugaucccuaagagcuacgcgggccccuucucucagcacaauuaucgccaaggguacgccacgcagacagucggaccuuggcaccucggcaaacuggagauugauuuuggggaaugccccggaaccaccgugacaauccaggaggacugugaucaucggggcccgucccugagaaccacgacagcuagcgggaaacuugugacccaguggugcugucgcuccugcacaaugccuccccucagauuccugggagaagacggcuguugguauggcauggagauucggccccugucugagaaagaagagaacauggucaagagccaaguuaccgccgggcagggaacauccgaaaccuuuucuaugggccuccugugccuuacgcuguucguggaggaaugucuccgcagacgggugacccgcaagcacaugauccuggccgucgugauuacacugugcgcuaucauccuugggggacucaccuggauggaucugcugagagcccucauuaugcugggcgacacaaugagcgggcggaucggaggccagacccaucuugcgauuauggcuguuuuuaaaauguccccuggcuacgugcugggggucuuccuccgcaagcugacgucuagagagacagcccugauggugaucggaauggccaugaccacaacccuuagcauuccgcacgaccugauggagcucaucgauggcaucucccuggggcucauucugcuuaaaaucguuacccaguuugacaacacacaagugggaacgcuggcucucagccugaccuucauucggucuacaaugucccuggucauggccuggcgcaccaucauggcggugcuuuuugucgugacacugauuccccucuguagaaccagcugccugcagaagcagucucauuggguugaaaucacggcucucauucugggcgcccaagcccuuccuguguaucugaugacacucaugaaaggggcuucccggagaagcuggccccugaaugagggaaucauggccgucggccuggugucucuucugggcuccgcucuccugaagaacgauguuccucucgccgggcccaugguggcgggaggccugcuucuggccgcuuacgucaugagcggguccagcgccgaccugucucucgaaaaggcugccaaugugcagugggaugagauggccgacaucaccggaagcuccccuauuaucgaagugaaacaggaugaggacggcucuuucagcauucgcgauguugaggaaaccaacaugaucacacugcuugucaagcuggcucucauuaccguguccgggcuguacccccucgcgaucccggugacaaugacgcugugguauauguggcaggucaaaacccaacggucuggagcccuuugggacgugccuagccccgcugccacacagaaggccgcucuguccgagggcguuuacagaaucaugcagcgcggccuguuugggaaaacccaggugggagucggcauucacauggaagggguguuccacacaauguggcauguuacccggggaucugugaucugucacgagacgggcagacucgaaccuagcugggccgauguccgcaaugacaugauuuccuaugggggaggcuggcggcugggcgauaagugggacaaggaggaggacgugcaaguucuugcgaucgaacccgggaaaaacccgaagcaugugcagaccaaaccuggacuguucaagacacucaccggcgagauuggggcugucacacuggauuuuaaacccggaaccagcggcucuccuaucaucaauagaaaggggaaagugauuggccucuacggaaacggcguggucacaaaguccggggacuauguuagcgccaucacgcaggccgaacgcauuggagagcccgauuacgagguggacgaagauaucuuccggaagaaaagacugaccauuauggaccuucaccccggcgcugggaagacaaaacggauccugccuucuauugugcgcgaggcccugaagagacggcuccgcacccugauccuugcgccgaccagagucguggcugccgaaauggaggaagcccugcggggacuccccaucagauaucagaccccugcuguuaaauccgagcauacgggccgcgagauuguggaucugaugugccacgccaccuuuacaacccggcuccugagcuccacaagaguccccaauuacaaccuuaucgugauggacgaagcucacuucaccgauccuucuagcguugccgcgcgcggguacauuuccacgcggguggagaugggcgaagccgcugccaucuuuaugacagcuacacccccuggagccaccgacccguucccccaaagcaauucuccuauugaggauaucgaaagagagauccccgagcgcuccuggaacacaggcuuugacuggauuaccgacuaucaggggaagacagucugguucgugccuagcaucaaggccggaaaugauauugcuaacugccugcggaaaucuggcaagaaagucauccagcugagcagaaagaccuuugacacggaauaccccaaaacaaagcucaccgauugggacuucgugguuacaaccgauauuuccgagaugggggcgaauuuucgcgccggaagagugaucgacccgcggcgcugucugaagccugugauccuuacggauggccccgaaagagucauucuggcugggcccaucccuguuacccccgccucugccgcucaacggcgcggcagaauuggacggaacccugcccaggaggacgaucaguauguguucagcggcgacccgcucaaaaacgaugaagaccaugcgcacuggacagaggcuaagaugcugcuggauaauaucuacacccccgaggggauuaucccuacacucuucggacccgaaagagagaaaacccaggccauugacggcgaauuucgccuuagaggggaacaacggaagacauucguggagcugaugcgccggggagaccugccugucuggcucuccuauaaaguggccucugcuggcaucagcuacaaggauagagaauggugcuuuaccggcgagcggaacaaucagauccuggaagagaacauggaaguugagauuuggacgcgcgagggggaaaagaagaaacuuagaccccgguggcuggacgcccgcguguaugcggauccgauggcccucaaagacuucaaagaguuugcuuccggaagaaaaagcaucacacuggauauucugaccgaaaucgccucucucccuaccuaccuuuccagccgggcuaagcuggcccuggacaauauugucaugcuccauacaaccgagcgcggcgggagagcuuaccagcacgcccugaacgaacuucccgagucccuggagacacucaugcugguggcgcugcucggagccaugacggcuggcaucuuccucuuuuucaugcaggggaagggaaucggcaaacugucuaugggccugauuaccaucgccgucgcuagcgggcuccuguggguggccgaaauucaaccucaguggaucgccgcuuccauuauccuugaguuuuuccugaugguucuccugauccccgaaccugagaagcagcggacaccccaggauaaucaacugauuuaugugauccucaccauucuuacaaucauuggacugaucgcggccaacgaaaugggccugauugagaaaaccaagacggacuuuggguucuaccaggucaaaaccgagacaaccauccucgauguggaccugcgcccggcuucugccuggacacuuuaugccguugcuaccacgauccugacaccuaugcucagacacaccauugaaaauacaagcgccaaccugucccuggcggccaucgcuaaucaggccgcugugcucaugggacuuggcaagggguggccccugcaucggauggaucugggagucccccuccuggccaugggcuguuacagccaggugaacccuaccacccuuacagcgucucuggugaugcuccugguucacuaugccauuaucggcccggggcugcaagcuaaagccacgagagaggcucagaagcgcaccgccgcuggaauuaugaagaaucccacagucgacggcaucaccgugaucgaucucgaaccuauuuccuacgaccccaaauuugagaagcagcuugggcaagugaugcugcugguccucugcgccggacagcugcuucugaugcggacaaccugggcguucugugagguucucacgcuggccacaggcccuauccugacccucugggaagggaaccccggaagauucuggaauaccacaauugcugugagcaccgccaacaucuuucgcggcucuuaucuugcuggcgccgggcuggccuucucccugauuaaaaacgcgcagacaccucggagaggaacgggcaccacaggggagacccucggagaaaaguggaaacgccagcugaauagccuugaccggaaggaguuugaagaguacaagagaucuggcauccuggagguggaucgcacagaagcuaaaagcgcccucaaggacggguccaaaaucaagcaugcugucucucggggaagcuccaaaauuagauggaucguggagcgcggcaugguuaagccgaagggcaaaguggucgaucuggggugcggacggggcggguggagcuacuauauggccacccugaagaacgugacggaaguuaaaggauacaccaagggcgggcccggacacgaggaaccuauucccauggccacauauggcuggaaucucgugaaacuucauuccggcgucgacguguucuacagaccuaccgagcaaguggauacacugcugugugacaucggggagucuagcuccaaccccaccauugaagagggacgcacacucagaguccugaagaugguugaaccguggcuuucuagcaagccugaguuuugcaucaaagugcugaaucccuauaugcccaccgugauugaagaacucgagaagcugcagcggaaacacggcgggaaccugguccgcuguccucucuccagaaauucuacgcacgaaauguacugggugagcggagcuuccggcaacaucguuagcucugugaauacaaccuccaagaugcuucugaaccgguucaccacaagacaucggaaacccacguaugagaaggaugucgaccugggggccggaacccgcagcgugucuacagaaaccgagaaaccugauaugacaaucauuggcagacggcuccagcgccugcaggaggaacacaaggagaccuggcauuacgaccaagaaaauccguacagaacaugggcguaucacggcuccuacgaggcccccagcaccgggucugcuuccagcaugguuaacggaguggucaaacuucugacgaaaccuugggaugugauccccaugguuacccagcucgccaugacagacaccacaccuuuuggccagcagcggguguucaaggaaaaagucgacacccgcacgccccaaccgaagccugggacaagaauggugaugaccacaaccgcuaauuggcugugggcccugcucggcaagaagaagaacccccggcugugcacgcgcgaggaguuuauuuccaaagucagaagcaaugcggccaucggcgcuguguuccaggaggaacagggguggaccucugccagcgaagcuguuaacgauucccgguuuugggagcuuguggacaaggaacgcgcccugcaccaagagggcaaaugugagucuugcgucuauaauaugaugggaaagagagagaagaagcucggcgaguucgggcgggcuaagggaagccgcgccauuugguacauguggcugggcgcgagauuucuugaguucgaggcccugggguuccucaacgaagaucauugguuuggacgggagaacuccuggucuggcguggagggggaaggccugcacagacugggauauauccucgaggaaaucgacaaaaaggauggcgaccugauguacgcugaugacacagccgggugggauacccgcauuacagaggacgaucuucagaaugaggaacugaucaccgagcagauggcuccucaucacaaaauucucgccaaggccaucuucaaacugacauaucagaacaaggugguuaaggugcuucggcccaccccuagaggagcggucauggacauuaucagccgcaaagaucaacggggcuccggacaggugggaacguacggccugaauacauuuaccaacauggaaguucagcucaucagacagauggaggcugaaggggugauuacccaagacgacaugcagaaucccaagggccugaaagagcgcgucgagaaguggcugcgggaaugcggaguggauagacucaaacgcauggccaucucuggcgacgauugugucgugaagccgcuggacgagcgguucgggacaagccuucuguuucucaacgauaugggaaaaguuagaaaggacauuccucagugggaacccuccaagggcuggaaaaauuggcaggaggugcccuucugcagccaucacuuucacaagaucuucaugaaagaugggcgcucucuggucgugccuugucggaaccaagacgaacuuauugggcgggcccggaucucccagggcgcuggguggagccugagagagaccgccugccucggcaaggcuuacgcccagauguggucucugauguauuuucaucgccgggaucugagacucgcguccauggccaucuguagcgcuguuccgacagagugguuccccacgucccgcaccacauggucuauucacgcccaucaccaguggaugaccacagaagacaugcugaaaguguggaauagagucuggaucgaggauaacccuaauaugauugacaagacccccgugcacagcugggaagacaucccuuaccuuggaaagcgggaggaucuguggugcggcucccucauugggcugagcucucgcgcuacgugggccaaaaacauccauaccgcgauuacacaagugagaaaucuuaucggaaaggaagaguauguugacuacaugcccgucaugaaacgguauuccgccccuagcgagucugaaggcgugcuguga

SEQ ID NO: 20987 - RNA, 9867 nt, Artificial Sequence
  derived and/or modified CDS sequence (opt5) from DENV-4__FJ882598__SS-prME
agcaccaucacccugcuuugccugauucccacggccauggcuuuccaccuuuccacccgggacggagagccucugaugaucguggccaagcaugaacgggggcgcccgcuccuguuuaagaccaccgagggaauuaacaaguguacccuuaucgcgauggaucugggcgaaaugugcgaggacaccgugaccuacaaguguccccuccugguuaauaccgaaccugaggauauugacugcugguguaaccugacgucuaccugggugauguaugggacaugcacccagagcggagagagacggcgcgaaaagagauccguggcucucacaccccacucuggcauggggcuggagacccgggccgaaacguggaugagcuccgagggagccuggaagcaugcucaacgcgucgagucuuggauccuuagaaauccuggcuucgcccugcucgcuggcuuuauggccuacaugaucgggcagacaggcauucagcggaccguguucuuuguucugaugaugcuuguggcgcccagcuauggcaugcgcugugucggggugggaaacagagauuucguugaaggcguguccgggggagccugggucgaccuggugcucgagcacggcggcugcgugacaaccauggcucaggggaagccuacccuggauuuugaacugacaaagacgaccgccaaagaggucgcucuccugcggacauacuguaucgaagccagcauuucuaauaucaccacagcgacccgcugcccgacgcaaggagagcccuaucuuaaggaggaacaggaccagcaguacauuuguagacgggauguuguggaccgcggcugggggaacggaugcggccuguucgggaaaggaggcguggucacaugcgccaaguuuuccuguagcggcaaaaucaccgggaaucucgugcaaauugagaaccuggaauauaccguuguggucacagugcauaauggagauacccacgcuguuggcaacgacacaucuaaucacggggugacggccaccaucacaccuagaucccccagcgucgaggugaaacuuccugauuacggagaacugacccucgacugcgagccccggucuggcaucgacuucaacgagaugauucugaugaagaugaaaaagaaaacauggcugguccauaagcagugguuucucgaucugccgcuuccuuggaccgcuggggccgacacguccgaagugcacuggaauuacaaagagagaaugguuaccuucaaggugccccaugccaaacgccaggaugucacagugcugggcagccaggaaggagcuaugcacuccgcgcucgccggcgcuaccgagguugacucuggggauggaaaccacauguuugccggccaucugaaguguaaggugcggauggaaaaacuuagaaucaaggggaugagcuauacaaugugcuccggaaaauucagcauugacaaggagauggccgagacccaacacggcacgacagucgugaaagugaaguacgaaggggcuggcgccccuuguaagguucccaucgagauucgcgaugucaauaaagaaaagguggugggacgggucaucucuuccacaccccuggcggagaacacaaacagcgugaccaauaucgagcucgaaccuccguucggcgacucuuauauuguuaucggggugggaaacagcgcucugacccugcauugguuuagaaaaggcuccucuauugggaagauguucgagagcacauaccgcggagccaaacggauggccauccucggcgaaacggcuugggauuuuggguccgucggcggacuguucaccagccuuggcaaggccgugcaccagguuuuugggucuguguauacaaccauguucggaggcgucuccuggaugauuagaauccugaucggguuucucgugcuguggauuggaacaaauagccgcaacaccucuauggcuaugacgugcaucgccguuggcgggauuacacuguuccuuggcuuuaccgugcaggcggacaugggaugugucguguccuggagcggccgggagcucaagugcggguccggaaucuucguggucgauaauguucauaccuggacagaacaauacaaauuucagcccgagucuccugccagacuggcuagcgccauucugaacgcucacaaggacggcgugugugggauccgcuccaccacacggcucgagaaugugauguggaaacagauuacgaacgaacugaauuauguccuuugggagggaggccacgaccugaccgugguugccggcgaugugaaggggguccucacaaaaggaaagagagcgcugacacccccugugucugaccugaaguacagcuggaaaacauggggcaaggccaaaaucuucacccccgaagcucggaacuccacguuucuuaucgaugggccggacaccagcgagugcccuaaugaacgcagagccuggaacucucucgagguugaggauuacggauucggcauguucacaaccaauauuuggaugaaguuucgggaaggguccagcgaggugugugaccauagacugaugucugcugccaucaaagaucagaaggccguccacgcugacaugggauauuggauugaauccagcaaaaaccaaacauggcagaucgagaaggcgucucugauugaagugaagaccugccucuggcccaaaacacauacccuguggagcaauggcguucuugagucccagaugcugaucccuaagagcuacgccggccccuucucucagcacaacuaucgccaaggguacgcuacgcagacagugggaccuuggcaccucggcaaacuggagaucgauuuuggggaaugccccggaaccaccgucacaauucaggaggacugugaucaucggggcccgucccugagaaccacgacagccagcgggaaacuugugacccaguggugcugucgcuccugcacaaugccuccccucagauuccugggagaagacggcuguugguauggcauggagauccggccccugucugagaaagaagagaacauggucaagagccaagucgccgcugggcagggaaccuccgaaacauuuucuaugggccuccugugccuuacccuguucguugaggaaugucuccgcagacgggugacgcgcaagcacaugauucuggccguggucaucacccugugcgcgauuauccuugggggacucacauggauggaucugcugagagcucucaucaugcugggcgacaccaugagcgggcggauuggaggccagacacaucuugccaucauggccguguuuaaaauguccccuggcuacguucuggggguguuccuccgcaagcugaccucuagagagacggcucugauggucauuggaauggccaugacaaccacacuuagcaucccgcacgaccugauggagcucauugauggcaucucccuggggcucauccugcuuaaaauugugacccaguuugacaauacccaaguuggaacacuggcgcucagccugacguucauccggucuaccaugucccuggugauggcuuggcgcacaauuauggccguccuuuuuguggucacccugaucccccucuguagaacaagcugccugcagaagcagucucauuggguggaaauuaccgcccucauccugggcgcucaagcccuuccuguuuaucugaugacgcucaugaaaggggcuucccggagaagcuggccccugaacgagggaauuauggccgugggccuggucucucuucugggcuccgcgcuccugaagaaugaugugccucucgccgggcccaugguugcuggaggccugcuucuggccgcuuacgugaugagcggguccagcgccgaccugucucucgaaaaggccgcuaacguccagugggaugagauggcggacaucacaggaagcuccccuaucauugaagugaaacaggaugaggacggcucuuucagcauccgcgauguggaggaaaccaauaugauuacccugcuuguuaagcuggcccucaucacagucuccgggcuguacccccucgcuauuccggugaccaugacacugugguauauguggcaagugaaaacgcaacggucuggagcccuuugggacgucccuagccccgccgcuacccagaaggccgcgcuguccgagggcguguacagaaucaugcagcgcggccuguuugggaaaacacagguuggagugggcauccacauggaaggggucuuccacaccauguggcaugugacacggggaucuguuauuugucacgagaccggcagacucgaaccuagcugggcugaugugcgcaacgacaugaucuccuaugggggaggcuggcggcugggcgauaagugggacaaggaggaggacguccaagugcuugccauugaacccgggaaaaauccgaagcauguucagacgaaaccuggacuguucaagacccucacaggcgagaucggggccgugacccuggauuuuaaacccggaacaagcggcucuccuauuaucaacagaaaggggaaagucaucggccucuacggaaauggcguggugaccaaguccggggacuaugucagcgcuauuacacaggccgaacgcaucggagagcccgauuacgagguugacgaagauauuuuccggaagaaaagacugacgaucauggaccuucaccccggcgcggggaagaccaaacggauucugccuucuaucgugcgcgaggcucugaagagacggcuccgcacacugauucuugccccgaccagaguggucgccgcugaaauggaggaagcccugcggggacuccccaucagauaucagaccccugcugugaaauccgagcauacaggccgcgagaucguugaucugaugugccacgccacguuuaccacacggcuccugagcuccaccagagugcccaacuacaaucuuauugucauggacgaagcgcacuucacagauccuucuagcguggccgcucgcggguacaucuccacccggguugagaugggcgaagccgcugccauuuuuaugacggccacacccccuggagcuaccgacccguucccccaaagcaacucuccuaucgaggauauugaaagagagauccccgagcgcuccuggaauaccggcuuugacuggaucacagacuaucaggggaagaccgugugguucgucccuagcauuaaggcgggaaacgauaucgccaauugccugcggaaaucuggcaagaaagugauucagcugagcagaaagacauuugacaccgaauaccccaaaacgaagcucacagauugggacuucgucgugaccacagauaucuccgagaugggggcuaacuuucgcgccggaagaguuauugacccgcggcgcugucugaagccugugauccuuaccgauggccccgaaagagugauccuggccgggcccauuccugucacgcccgcuucugccgcgcaacggcgcggcagaaucggacggaacccugcucaggaggacgaucaguauguuuucagcggcgacccgcucaaaaaugaugaagaccaugcccacuggaccgaggccaagaugcugcuggauaacauuuacacacccgaggggaucauuccuacccucuucggacccgaaagagagaaaacacaggcuaucgacggcgaauuucgccuuagaggggaacaaagaaagaccuucguggagcugaugcgccggggagaccugccuguguggcucuccuauaaagucgccucugcgggcauuagcuacaaggauagagaauggugcuuuacaggcgagcggaauaaccagauccuggaagagaauauggaaguggagaucuggacccgcgagggggaaaagaagaaacuuagaccccgguggcuggacgcccgcguuuaugcugauccgauggcccucaaagacuucaaagaguuugcuuccggaagaaaaagcauuacgcuggauauccugacagaaauugccucucucccuaccuaccuuuccagccgggcuaagcuggcccuggacaacaucgugaugcuccauaccacagagcgcggcgggagagcguaccagcacgcccugaaugaacuucccgagucccuggagacccucaugcuggucgcucugcucggagccaugacagcuggcauuuuccucuuuuucaugcaggggaagggaaucggcaaacugucuaugggccugaucacgauugccguggccagcgggcuccugugggucgcugaaauccaaccucaguggauugcggccuccaucauucuugaguuuuuccugauggugcuccugauccccgaaccugagaagcagcggacaccccaggauaaccaacugaucuauguuauucucacaauccuuaccauuaucggacugauugcugccaaugaaaugggccugaucgagaaaacaaagaccgacuuuggguucuaccaggugaaaacggagaccacaauucucgaugucgaccugcgcccggccucugcuuggacccuuuaugccguggcgacaaccauccugacgccuaugcucagacacacaaucgaaaacaccagcgccaaucugucccuggcugccauugcuaaccaggccgcgguucucaugggacuuggcaagggguggccccugcaucggauggaucugggagugccccuccuggccaugggcuguuacagccaggucaauccuacaacccuuaccgcuucucuggugaugcuccuggugcacuaugccaucauuggcccggggcugcaagcuaaagccacaagagaggcucagaagcgcacggccgcgggaaucaugaagaaccccaccguugacggcauuacagucaucgaucucgaaccuaucuccuacgaccccaaauuugagaagcagcuugggcaagugaugcugcuggugcucugcgccggacagcugcuucugaugcggaccacaugggcuuucugugagguccucacccuggccacgggcccuauucugacacucugggaagggaaucccggaagauucuggaacaccaccaucgcuguuagcacagccaacauuuuucgcggcucuuaucuugccggcgcggggcuggcuuucucccugaucaaaaaugcccagaccccucggagaggaacaggcacgaccggggagacacucggagaaaaguggaaacgccagcugaacagccuugaccggaaggaguuugaagaguacaagagaucuggcauucuggagguggaucgcaccgaagcuaaaagcgcccucaaggacggguccaaaaucaagcaugccgugucucggggaagcuccaaaaucagauggauugucgagcgcggcauggugaagccgaagggcaaaguuguggaucuggggugcggacggggcggguggagcuacuauauggcuacacugaagaaugucaccgaagugaaaggauacacgaagggcgggcccggacacgaggaaccuauccccauggccaccuauggcuggaaccucguuaaacuucauuccggcguggacgucuucuacaagccuacagagcaaguggauacccugcugugugacauuggggagucuagcuccaaucccacaaucgaagagggaagaacccuccgcgugcugaagauggucgaaccguggcuuucuagcaaaccugaguuuugcauuaagguucugaaccccuauaugcccacagugaucgaggaacucgagaaacugcagagaaagcacggcgggaaucuggugcgguguccucucucccgcaacucuacccacgaaauguacugggucagcggagcguccggcaauauugugagcucuguuaacacgacauccaaaaugcuucugaauagauucaccacccggcauagaaagcccacauaugagaaagauguggaccugggggccggaacgcggagcgucucuaccgaaacagagaagccugauaugaccaucaucggccgcagacuccagcggcugcaggaggaacacaaggagacauggcauuacgaccaagaaaacccguaccgcaccugggcuuaucacggcuccuacgaggcccccagcacagggucugcuuccagcauggugaauggaguugugaaacuucugaccaagccuugggaugucauucccauggugacgcagcucgccaugaccgacacaaccccuuuuggccagcagagaguuuucaaagaaaagguggacacacggacaccccagccgaaaccugggacgcgcauggucaugacaaccacagcgaacuggcugugggcccugcucggaaagaagaaaaaucccagacugugcacccgggaggaguuuaucuccaaggugcgcagcaacgcugccauuggcgcugucuuccaggaggagcagggguggacgucugccagcgaagcugugaaugauuccagauuuugggagcuuguugacaaagaacgggcccugcaccaagagggcaagugugagucuugcguguauaacaugaugggaaaacgcgaaaagaagcucggcgaguucgggagagcgaaaggaagccgggccaucugguacauguggcugggcgcucgcuuucuugaguucgaggcccugggguuccucaacgaagaucauugguuuggaagagaaaauuccuggucuggcgucgagggggaaggccugcaccggcugggauauauucucgaggaaaucgacaagaaagauggcgaccugauguacgcugaugacaccgccgggugggauacaagaaucaccgaggacgaucuucagaacgaggaacugauuacagagcagauggccccucaucacaagauccucgcgaaagcuauuuucaagcugaccuaucagaauaagguggugaaaguucuucgccccacaccucggggagccgugauggacaucauuagcagaaaggaucaacgcggcuccgggcaggucggaaccuacggccugaacacguuuacaaauauggaagugcagcucauccggcagauggaggccgaagggguuaucacccaagacgacaugcagaaccccaaaggccugaaggagagaguggagaaauggcugcgcgaaugcggagucgaucggcucaagagaauggcuauuucuggcgacgauuguguggucaaaccgcuggacgagcgcuucgggaccagccuucuguuucucaaugauaugggaaaggugcggaaggacaucccucagugggaacccuccaaaggcuggaagaacuggcaggagguucccuucugcagccaucacuuucacaaaauuuucaugaaggaugggagaucucugguggucccuugucgcaaucaagacgaacuuaucggacgggccagaauuucccagggcgcuggguggagccugcgggagacagccugccucggcaaagcguacgcccagauguggucucugauguauuuucauagacgcgaucugcggcucgcuuccauggccaucuguagcgcugugccgaccgagugguuccccacauccagaacgaccuggucuauccacgcccaucaccaguggaugacaaccgaagacaugcugaagguuuggaaccgcguguggauugaggauaauccuaacaugaucgacaagacacccguccacagcugggaagacauuccuuaccuuggaaaaagagaggaucuguggugcggcucccucaucgggcugagcucucgggcgaccugggccaagaauauucauacggcuaucacccaagugcgcaaccuuauuggaaaagaagaguauguggacuacaugcccguuaugaagagauauuccgccccuagcgagucugaaggcguccuguga

SEQ ID NO: 20988 - RNA, 9867 nt, Artificial Sequence
  derived and/or modified CDS sequence (opt5) from DENV-4__FJ882601__SS-prME
agcaccaucacccugcucugccugauucccacggugauggcuuuccaccuuuccacccgggacggagagccucugaugaucgucgcuaagcaugaacgggggcgcccgcuucuguuuaagaccaccgaggggauuaacaaguguacccuuaucgccauggaucugggcgaaaugugcgaggacaccguuaccuacaaguguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaagcaugcccaacgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaccaucacaccuagaucccccagcguggaggucaaacuuccugauuacggagaacugacccucgacugcgagccccggucuggcaucgacuucaacgagaugauucugaugaagaugaaaaagaaaacauggcuggugcauaagcagugguuucucgaucugccgcuuccuuggaccgccggggcugacacguccgaaguucacuggaauuacaaagagagaauggugaccuucaaggucccccaugccaaacgccaggaugugacaguucugggcagccaggaaggagccaugcacuccgcucucgcgggcgccaccgagguggacucuggggauggaaaccacauguuugcuggccaucugaaguguaagguccggauggaaaaacuuagaaucaaggggaugagcuauacaaugugcuccggaaaauucagcauugacaaggagauggccgagacccaacacggcacgacaguggugaaaguuaaguacgaaggggccggcgcuccuuguaagguccccaucgagauucgcgaugugaauaaagaaaagguggucggacgggugaucucuuccacaccccuggccgagaacacaaacagcguuaccaauaucgagcucgaaccuccguucggcgacucuuauauugugaucggggucggaaacagcgcgcugacccugcauugguuuagaaaaggcuccucuauugggaagauguucgagagcacauaccgcggagcuaaacggauggccauccucggcgaaacggccugggauuuuggguccgugggcggacuguucaccagccuuggcaaggcuguucaccagguguuugggucugucuauacaaccauguucggaggcguguccuggaugauuagaauccugaucggguuucucguucuguggauuggaacaaauagccgcaacaccucuauggccaugacgugcaucgcugugggcgggauuacacuguuccuuggcuuuaccguccaggccgacaugggaugugugguguccuggagcggccgggagcucaagugcggguccggaaucuucgucguugauaaugugcauaccuggacagaacaauacaaauuucagcccgagucuccugcgagacuggccagcgcuauucugaacgcccacaaggacggcgugugugggauccgcuccaccacacggcucgagaaugucauguggaaacagauuacgaacgaacugaauuaugugcuuugggagggaggccacgaccugaccguuguggcuggcgaugucaagggggugcucacaaaaggaaagagagcccugacacccccuguuucugaccugaaguacagcuggaaaacauggggcaaggcgaaaaucuucacccccgaagcccggaacuccacguuucuuaucgaugggccggacaccagcgagugcccuaaugaacgcagagcuuggaacucucucgagguggaggauuacggauucggcauguucacaaccaauauuuggaugaaguuucgggaaggguccagcgaggucugugaccauagacugaugucugccgcuaucaaagaucagaaggccgugcacgccgacaugggauauuggauugaauccagcaaaaaccaaacauggcagaucgagaaggcuucucugauugaaguuaagaccugccucuggcccaaaacacauacccuguggagcaauggcgugcuugagucccagaugcugaucccuaagagcuacgcgggccccuucucucagcacaacuaucgccaaggguacgccacgcagacagucggaccuuggcaccucggcaaacuggagaucgauuuuggggaaugccccggaaccaccgugacaauucaggaggacugugaucaucggggcccgucccugagaaccacgacagcuagcgggaaacuugugacccaguggugcugucgcuccugcacaaugccuccccucagauuccugggagaagacggcuguugguauggcauggagauccggccccugucugagaaagaagagaacauggucaagagccaaguugccgccgggcagggaaccuccgaaacauuuucuaugggccuccugugccuuacccuguucguggaggaaugucuccgcagacgggugacgcgcaagcacaugauucuggcugucgugaucacccugugcgccauuauccuugggggacucacauggauggaucugcugagagcgcucaucaugcugggcgacaccaugagcgggcggauuggaggccagacacaucuugcuaucauggccguuuuuaaaauguccccuggcuacgugcugggggucuuccuccgcaagcugaccucuagagagacggcccugauggugauuggaauggcuaugacaaccacacuuagcaucccgcacgaccugauggagcucauugauggcaucucccuggggcucauccugcuuaaaauuguuacccaguuugacaauacccaagugggaacacuggcccucagccugacguucauccggucuaccaugucccuggucauggcguggcgcacaauuauggcugugcuuuuugucgugacccugaucccccucuguagaacaagcugccugcagaagcagucucauuggguugaaauuaccgcccucauccugggcgcccaagcccuuccuguguaucugaugacgcucaugaaaggggccucccggagaagcuggccccugaacgagggaauuauggcugucggccuggugucucuucugggcuccgcccuccugaagaaugauguuccucucgcggggcccaugguggccggaggccugcuucuggcugccuacgucaugagcggguccagcgcugaccugucucucgaaaaggccgccaacgugcagugggaugagauggcugacaucacaggaagcuccccuaucauugaagugaaacaggaugaggacggcucuuucagcauccgcgauguugaggaaaccaauaugauuacccugcuugucaagcuggcgcucaucacaguguccgggcuguacccccucgccauuccggugaccaugacacugugguauauguggcaggucaaaacgcaacggucuggagcucuuugggacgugccuagccccgccgccacccagaaggcugcccuguccgagggcguuuacagaaucaugcagcgcggccuguuugggaaaacacaggugggagucggcauccacauggaagggguguuccacaccauguggcauguuacacggggaucugugauuugucacgagaccggcagacucgaaccuagcugggcggauguccgcaacgacaugaucuccuaugggggaggcuggcggcugggcgauaagugggacaaggaggaggacgugcaaguucuugcuauugaacccgggaaaaauccgaagcaugugcagacgaaaccuggacuguucaagacccucacaggcgagaucggggccgucacccuggauuuuaaacccggaacaagcggcucuccuauugugaacagaaaggggaaagugaucggccucuacggaaauggcgucguuaccaaguccggggacuaugugagcgccaucacacaggcugaacgcauuggagagcccgauuacgagguggacgaagauaucuuccggaagaaaagacugacgauuauggaccuucaccccggcgccgggaagaccaaacggauccugccuucuauuguccgcgaggcgcugaagagacggcuccgcacacugauccuugcuccgaccagagugguugccgccgaaauggaggaagcucugcggggacuccccauuagauaucagaccccugccgugaaauccgagcauacaggccgcgagaucgucgaucugaugugccacgcuacguuuaccacacggcuccugagcuccaccagagugcccaacuacaaucuuaucguuauggacgaagcccacuucacagauccuucuagcguggcggcccgcggguacauuuccacccgggucgagaugggcgaagcugccgcuaucuuuaugacggccacacccccuggagccaccgacccguucccccaaagcaacucuccuauugaggauaucgaaagagagauucccgagcgcuccuggaauaccggcuuugacuggaucacagacuaucaggggaagaccgugugguucgucccuagcaucaaggcuggaaacgauauugcgaauugccugcggaaaucuggcaagaaagugauccagcugagcagaaagacauuugacaccgaauaccccaaaacgaagcucacagauugggacuucguugugaccacagauauuuccgagaugggggccaacuuucgcgcuggaagagugaucgacccgcggcgcugucugaagccugucauucuuaccgauggccccgaaagaguuauccuggccgggcccaucccugugacgcccgccucugcugcccaacggcgcggcagaauuggacggaacccugcgcaggaggacgaucaguauguguucagcggcgacccgcucaaaaaugaugaagaccaugcucacuggaccgaggccaagaugcugcuggauaacaucuacacacccgaggggauuaucccuacccucuucggacccgaaagagagaaaacacaggccauugacggcgaauuucgccuuagaggggaacaaagaaagaccuucgucgagcugaugcgccggggagaccugccuguguggcucuccuauaaaguugcuucugccggcaucagcuacaaggauagagaauggugcuuuacaggcgagcggaauaaccagauucuggaagagaauauggaaguggagaucuggacccgcgagggggaaaagaagaaacuuagaccccgguggcuggacgcgcgcgucuaugccgauccgauggcucucaaagacuucaaagaguuugccuccggaagaaaaagcaucacgcuggauauucugacagaaaucgcuucucucccuaccuaccuuuccagccgggccaagcuggcucuggacaacauugugaugcuccauaccacagagcgcggcgggagagccuaccagcacgcgcugaaugaacuucccgagucccuggagacccucaugcuggucgcccugcucggagcuaugacagccggcaucuuccucuuuuucaugcaggggaagggaauuggcaaacugucuaugggccugaucacgaucgcuguggccagcgggcuccuguggguugccgaaauucaaccucaguggaucgcugcguccauuauccuugaguuuuuccugauggugcuccugauucccgaaccugagaagcagcggacaccccaggauaaccaacugaucuaugucauccucgccauucuuacaaucauuggacugaucgcugccaaugaaaugggccugauugagaaaaccaagacagacuuuggguucuaccaggagaaaaccgaaacgaccauccucgauguggaccugcgcccggccucugcuuggacacuuuaugccguugcgaccacaauucugaccccuaugcucagacacacgaucgagaacacaagcgccaaucugucccugaccgcuaucgccaaccaggcugccgugcucaugggacuuggcaagggguggccccugcaucggauggaucugggagucccccuccuggcgaugggcuguuacagccaggugaauccuacaacccuuaccgccucucuggugaugcuccugguucacuaugcuauuaucggcccggggcugcaagccaaagcuacaagagaagcccucaagcgcacggcugccggaauuaugaagaaccccaccgucgacggcaucacagugauugaucuugagccuaucuccuacgaccccaaauuugagaagcagcugggacaggugaugcugcucguccugugcgcgggacaacuucugcucaugcggaccacaugggccuucugugaaguucugacccuggcuacgggcccuauccucacacuuugggaggggaaucccggaagauucuggaacaccaccauugccgugagcacagcuaacaucuuucgcggcucuuaucuggccggcgccgggcuggcguucucccucauuaaaaaugugcagaccccucggagaggaacaggcacgaccggggaaacacugggagagaaguggaaacgccagcuuaacagccuggaccggaaggaauuugaggaguacaagagaucuggcauccucgaagucgaucgcaccgaggcuaaaagcgcccugaaggacggguccaaaauuaagcaugcugugucucggggaagcuccaaaaucagauggaucguugaacgcggcauggugaagccgaagggcaaagucguggaucuggggugcggacggggcggguggagcuacuauauggccacacucaagaauguuaccgaggugaaaggauacacgaagggcgggcccggacacgaggaaccuauucccauggccaccuauggcuggaaccuugucaaacugcauuccggcguggacguguucuacaagccuacagagcaggucgauacccugcucugugacaucggggaaucuagcuccaaucccacaauugaggaaggaagaacccugcgcguucuuaagaugguggagccguggcugucuagcaaaccugaauuuugcaucaaggugcucaaccccuauaugcccacagucauugaggagcuggaaaaacugcaaagaaagcacggcgggaaucucgugcgguguccucuuucccgcaacucuacccacgagauguacuggguuagcggagcuuccggcaauaucgugagcucugucaacacgacauccaaaaugcugcugaauagauucaccacccggcauagaaagcccacauaugaaaaagauguggaccucggggccggaacgcggagcguuucuaccgagacagagaagccugauaugaccauuaucggccgcagacugcagcggcuucaggaggagcacaaggaaacauggcauuacgaccaggagaacccguaccgcaccugggcguaucacggcuccuacgaagcccccagcacagggucugcuuccagcauggugaauggagucgugaaacugcucaccaagccuugggauguuauccccauggugacgcaacuggccaugaccgacacaaccccuuuuggccagcagagagucuucaaagagaagguggacacacggacaccccagccgaaaccugggacgcgcauggucaugacaaccacagcuaacuggcugugggcccuccugggaaagaagaaaaaucccagacuuugcacccgggaggaauuuauuuccaaggugcgcagcaacgcggccaucggcgcuguuuuccaagaggaacagggguggacgucugccagcgaggcugugaaugauuccagauuuugggaacuggucgacaaagagcgggcccuccaccaggagggcaagugugaaucuugcguguauaacaugaugggaaaacgcgagaagaagcugggcgaguucgggagagcuaaaggaagccgggccauuugguacauguggcuuggcgcgcgcuuucuggaguucgaagcccucggguuccugaacgaggaucauugguuuggaagagaaaauuccuggucuggcguggaaggggagggccugcaccggcucggauauauccuggaagagauugacaagaaagauggcgaccuuauguacgcugaugacaccgccgggugggauacaagaaucaccgaggacgaucugcaaaacgaggaacucguuacagaacagauggcuccucaucacaagauccuggccaaagccauuuucaaacuuaccuaucagaauaagguggucaaagugcugcgccccacaccucggggagcgguuauggacaucauuagcagaaaggaucagcgcggcuccgggcaagugggaaccuacggccucaacacguuuacaaauauggagguccagcugauccggcagauggaagcugagggggugauuacccaggacgacaugcaaaaccccaaaggccugaaggagagagucgaaaaauggcuccgcgagugcggaguggaucggcugaagagaauggccaucucuggcgacgauuguguugugaaaccgcuugacgaacgcuucgggaccagccugcucuuucugaaugauaugggaaagguccggaaggacaucccucagugggagcccuccaaaggcuggaagaacuggcaggaagugcccuucugcagccaucacuuucacaaaauuuucaugaaggaugggagaucucuuguugugccuugucgcaaucaggacgagcugaucggacgggccagaauuucccaaggcgcuggguggagccuccgggagacagccugccugggcaaggcuuacgcccagauguggucucugauguauuuucauagacgcgaucuccggcuggcguccauggccaucuguagcgcugucccgaccgaaugguuccccacauccagaacgaccuggucuauucacgcccaucaccaguggaugacaaccgaggacaugcuuaagguguggaaccgcguguggaucgaagauaauccuaacaugaucgacaagacacccguucacagcugggaggacauuccuuaccugggaaaaagagaagaucucuggugcggcucccugaucgggcuuagcucucgggcuaccugggccaagaauauucauacggcgaucacccagguccgcaaccugauuggaaaagaggaguauguggacuacaugcccgugaugaagagauauuccgccccuagcgaaucugagggcguccucuga

SEQ ID NO: 20989 - RNA, 9867 nt, Artificial Sequence
  derived and/or modified CDS sequence (opt5) from DENV-4__FJ226067__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaccaucacaccuagaucccccagcguggaggucaagcuuccugauuacggagaacugacccucgacugcgagccccggucuggcaucgacuucaacgagaugauucugaugaagaugaaaaagaaaacauggcuggugcauaagcagugguuucucgaucugccgcuuccuuggaccgccggggcugacacguccgaaguucacuggaauuacaaagagagaauggugaccuucaaggucccccaugccaaacgccaggaugugacaguucugggcagccaggaaggagccaugcacuccgcucucgcgggcgccaccgagguggacucuggggauggaaaccacauguuugcuggccaucugaaguguaagguccggauggaaaaacuuagaaucaaggggaugagcuauacaaugugcuccggaaaauucagcauugacaaggagauggccgagacccaacacggcacgacaguggugaaaguuaaguacgaaggggccggcgcuccuuguaagguccccaucgagauucgcgaugugaauaaagaaaagguggucggacgggugaucucuuccaccccccuggccgagaacacaaacagcguuaccaauaucgagcucgaaccuccguucggcgacucuuauauugugaucggggucggaaacagcgcgcugacccugcauugguuuagacgcggcuccucuauugggaaaauguucgagagcacauaccggggagcuaagagaauggccauccucggcgaaacggccugggauuuuggguccgugggcggacuguucaccagccuuggcaaagcuguucaccagguguuugggucugucuauacaaccauguucggaggcguguccuggaugauucgcauccugaucggguuucucguucuguggauuggaacaaauagccggaacaccucuauggccaugacgugcaucacagugggcgggauuacccuguuccuuggcuuuaccguccaggcugacaugggaugugugguguccuggagcggcagagagcucaagugcggguccggaaucuucgucguugauaaugugcauacauggaccgaacaauacaaguuucagcccgagucuccugcccgccuggcgagcgccauucugaacgcucacaaagacggcgugugugggauccgguccacaacgagacucgagaaugucauguggaagcagauuaccaacgaacugaauuaugcccuuugggagggaggccacgaccugacagugguugcuggcgaugugaaagggguccucaccaagggaaaacgggcccugacacccccugugucugaccugaaguacagcuggaagaccuggggcaaagcgaagaucuucacgcccgaagcccgcaacuccaccuuucuuaucgaugggccggacacaagcgagugcccuaaugaaagacgggcuuggaacucucucgagguugaggauuacggauucggcauguucaccacaaauauuuggaugaaauuuagagaaggguccagcgaggugugugaccaucgccugaugucugccgcuaucaaggaucagaaagccguccacgccgacaugggauauuggauugaauccagcaagaaccaaaccuggcagaucgagaaagcuucucugauugaagugaagacaugccucuggcccaagacccauacgcuguggagcaauggcguucuugagucccagaugcugaucccuaaaagcuacgcgggccccuucucucagcacaacuaucggcaaggguacgccacacagaccgugggaccuuggcaccucggcaagcuggagaucgauuuuggggaaugccccggaaccacagucaccauucaggaggacugugaucauagaggcccgucccugcgcacgacaaccgcuagcgggaaacuugugacacaguggugcuguagauccugcaccaugccuccccuccgguuccugggagaagacggcuguugguauggcauggagauccgcccccugucugagaaggaagagaacauggugaaaagccaagucacagccgggcagggaaccuccgaaacguuuucuaugggccuccugugccuuacccuguucguugaggaaugucucagacggcgcgugacaagaaagcacaugauucugguggucgugaucacccugugcgccauuauccuugggggacucacauggauggaucugcugcgggcucucaucaugcugggcgacaccaugagcgggcgcauuggaggccagauccaucuugccauuauggcgguuuuuaagauguccccuggcuacgugcugggggucuuccucagaaaacugacgucucgggagacagcucugauggugaucggaauggccaugaccacaguucuuagcauuccgcacgaccugauggagcucaucgauggcaucucccuggggcucauucugcuuaagaucgugacccaguuugacaauacccaagucggaacacuggcccucagccugacguucauucgcucuaccaugccccuggugauggcuuggagaacaaucauggccguccuuuuugugguuacccugauuccucucugucggacauccugccugcagaaacagagccauuggguggaaaucaccgcgcucauucugggcgcucaagcccuucccgucuaucugaugacgcucaugaagggggccucuagacgcuccuggccucugaacgagggaaucauggcugugggccugguuagccuucugggcucugcccuccugaaaaaugaugugccccucgcugggccuauggucgccggaggccugcuucuggcggccuacgugauguccgggagcuccgcugaccugagccucgaaaaggccgcuaacgugcagugggaugagauggccgacaucacaggaucuagccccauuaucgaaguuaagcaggaugaggacggcuccuucucuauucgggaugucgaggaaaccaauaugaucacccugcuugugaaacuggcccucauuacagugagcgggcuguacccgcucgcuaucccugucaccaugacacugugguauauguggcaggugaagacgcaaagauccggagcgcuuugggacguucccucuccugccgcuacccagaaagccgcccugagcgagggcguguaccgcaucaugcagcggggccuguuugggaagacacaggucggagugggcauucacauggaagggguuuuccacaccauguggcaugugacaagaggauccgucaucugucacgagaccggccgccucgaacccucuugggcugaugugcggaacgacaugauuagcuaugggggaggcuggagacugggcgauaaaugggacaaggaggaggacguucaagugcuugccaucgaaccggggaagaauccuaaacauguccagacgaagcccggacuguucaaaacccucacaggcgagauuggggcggugacccuggauuuuaagccuggaacauccggcagccccaucaucaaccgcaaagggaaggugauuggccucuacggaaauggcgucguuaccaaaucuggggacuauguguccgcuaucacacaggccgaacggauuggagagcccgauuacgagguggacgaagauaucuucagaaagaagcggcugacgauuauggaccuucacccuggcgccgggaaaaccaagcgcauccugccgagcauugucagagaggcucugaaacggcgccucagaacacugauccuugcccccacccgggugguugcggcugaaauggaggaagcccugagaggacucccuauccgcuaucagacccccgccgugaagucugagcauacaggccgggagauugucgaucugaugugccacgcuacguuuaccacaagacuccuguccagcacccgcgugccuaacuacaaucuuaucguuauggacgaagcccacuucacagaucccuccucuguggcugcccggggguacauuagcaccagagucgagaugggcgaagcggccgcuaucuuuaugacggccacaccuccgggagcuaccgaccccuucccucaauccaacagccccauugaggauaucgaacgcgagaucccugagcggucuuggaauaccggcuuugacuggauuacagacuaucaggggaaaaccgugugguucguccccuccaucaaggccggaaacgauauugccaauugccugagaaagagcggcaaaaaggugauccagcugucucgcaaaacauuugacaccgaauacccgaagacgaaacucacagauugggacuucguugugaccacagauauuagcgagaugggggcuaacuuuagagcgggacgggugaucgacccucgcagaugucugaagcccgucauccuuaccgauggccccgaacggguuauucuggccgggccuauccccgugacgccugcuuccgccgcccaacgcagaggccggauuggaagaaacccggcucaggaggacgaucaguauguguucucuggcgacccccucaagaaugaugaagaccaugcccacuggaccgaggcgaaaaugcugcuggauaacaucuacacaccugaggggauuauccccacccucuucggaccugaacgcgagaagacacaggcuauugacggcgaauuucggcuuagaggggagcaacgcaaaaccuucgucgagcugaugcggagaggagaccugcccguguggcucagcuauaagguugccuccgccggcaucucuuacaaagaucgggaauggugcuuuacaggcgagcgcaauaaccagauccuggaagagaauauggaaguggagauuuggaccagagagggggaaaagaagaaacuucggccgcgcuggcuggacgcuagagucuaugccgauccuauggcgcucaaggacuucaaagaguuugccagcggacggaaguccaucacgcuggauauucugacagaaaucgcuagccuccccaccuaccuuucuucccgcgccaaacuggcucuggacaacauugugaugcuccauaccacagagagaggcgggcgggccuaccagcacgcucugaaugaacuuccugagagccuggagacccucaugcuggucgcccugcucggagcgaugacagccggcaucuuccuuuuuuucaugcaggggaagggaaucggcaagcuguccaugggccugauugcuaucgccguggcuucugggcuccuguggguugccgaaauucaaccccaguggaucgccgcuagcauuauccuugaguuuuuccugauggugcuccugaucccugaacccgagaaacagcgcacgccgcaggauaaccaacugauuuaugucauccucaccauucuuacaaucauuggacugaucgcggccaaugaaaugggccugauugagaagaccaaaacagacuuuggguucuaccaggugaagaccgagacgaccauccucgauguugaccugagaccugcuuccgccuggacacuuuaugccguggcuaccacaauccugacccccaugcuccggcacacgauugaaaacacaucugccaaucugagccuggcggccaucgcuaaccaggccgcuguccucaugggacuuggcaaaggguggccccugcauagaauggaucugggagugccucuccuggccaugggcuguuacucccaggugaauccgaccacacuuaccgcgagccugguuaugcuccugguccacuaugccauuaucggccccgggcugcaagcuaaggccacccgcgaggcucagaaacggacagccgcuggaauuaugaagaacccuacgguggacggcaucaccgugaucgaucucgaacccauuucuuacgacccuaaguuugagaaacagcuugggcaagucaugcugcugguucucugcgccggacagcugcuucugaugagaacaaccugggcguucugugaggugcucacacuggccaccggccccauccugacgcucugggaagggaauccuggacgcuucuggaacacaaccauugcuguguccaccgccaacaucuuucggggcagcuaucuugcuggcgccgggcuggccuucucucugauuaagaaugcgcagacaccgagacgcggaaccggcacaacgggggagacccucggagaaaaauggaagcggcagcugaacucccuugacagaaaagaguuugaagaguacaagcgcagcggcauccuggaggucgaucggacagaagcuaagucugcccucaaagacgggagcaagaucaaacaugcuguguccagaggaucuagcaagauucgcuggaucguugagcggggcauggugaaacccaagggcaaggucguggaucuggggugcggaagaggcgggugguccuacuauauggccacccugaaaaauguuacagaagugaagggauacaccaaaggcgggccuggacacgaggaacccauuccuauggccacguauggcuggaaccucgucaagcuucauagcggcguggacguguucuacaaacccaccgagcaagucgauacacugcugugugacaucggggaguccucuagcaauccgaccauugaagagggacgcacacucagaguucugaagaugguggaaccuuggcuuuccucuaagcccgaguuuugcaucaaagugcugaaccccuauaugccuaccgucauugaagagcucgagaagcugcagcggaaacacggcgggaaucuggugcgcuguccccucagcagaaacuccacacacgaaauguacuggguuucuggagcuagcggcaauaucguguccagcgucaacaccacgucuaagaugcuucugaaucgguucacaaccagacaucggaaaccuaccuaugagaaggauguggaccugggggccggaacacgcuccguuagcacggaaaccgagaaaccggauaugacaaucauuggcagacggcuccagcgccugcaggaggaacacaaggagaccuggcauuacgaccaagaaaaccccuacagaacaugggcguaucacggcucuuacgaggccccuuccaccgggagcgcuucuuccauggugaauggagucgugaagcuucugacaaaacccugggauguuaucccuauggugacccagcucgccaugacggacaccacacccuuuggccagcagcgggucuucaaggaaaaaguggacacccgcacaccgcaaccuaagcccgggaccagaauggucaugacgacaaccgcuaacuggcugugggcccugcucggaaaaaagaagaauccucggcugugcacacgcgaggaguuuauuagcaaagugagauccaacgcggccaucggcgcuguuuuccaggaagagcagggguggaccagcgccucugaagcugugaaugauagccgguuuugggagcuugucgacaaggaacgcgcccugcaccaagagggcaaaugugaguccugcguguauaacaugaugggaaagagagaaaaaaagcucggcgaguucgggcgggcuaagggaucucgcgccauuugguacauguggcugggcgcgagauuucuugaauucgaggcccugggguuccucaacgaagaucauugguuuggacgggagaauagcugguccggcguggagggggaaggccugcacagacugggauauauccucgaggaaaucgacaaaaaggauggcgaccugauguacgcugaugacacggccgggugggauacccgcauuacagaggacgaucuucagaacgaggaacugaucaccgagcagauggcuccccaucacaaaauucucgccaaggccaucuucaaacugacauaucagaauaagguugugaagguccuucggccuacccccagaggagcggugauggacauuaucucucgcaaagaucaacggggcagcgggcagguuggaacauacggccugaacaccuuuacgaauauggaagugcagcucaucagacagauggaggcugaaggggucauuacacaagacgacaugcagaacccgaagggccugaaagagcgcguggagaaguggcugcgggaaugcggagucgauagacucaaacgcauggccaucuccggcgacgauugugugguuaagccucuggacgagcgguucgggaccucucuucuguuucucaaugauaugggaaaagugagaaaggacauuccccagugggaacccagcaagggcuggaaaaacuggcaggaggucccuuucugcucccaucacuuucacaagaucuucaugaaagaugggcgcagccuggugguuccgugucggaaucaagacgaacuuauuggaagagcccggaucucucagggcgcuggguggucccugagagagaccgccugccucggcaaggcuuacgcccagauguggagccugauguauuuucaucgccgggaucugagacucgcgucuauggccaucuguuccgcugugcccacagagugguucccuaccagccgcacaacgugguccauucacgcccaucaccaguggaugaccacagaagacaugcugaaagucuggaacagaguguggaucgaggauaaucccaacaugaccgacaagacaccugugcacucuugggaagacauucccuaccuuggaaagcgggaggaucuguggugcggcagccucaucgggcuguccagccgcgcuaccugggccaaaaauauucauacggcgaucacccaaguuagaaaccuuauuggaaaggaagaguaugucgacuacaugccugugaugaaacgguauucugcccuguccgagagcgaaggcgugcucuga

SEQ ID NO: 20990 - RNA, 9867 nt, Artificial Sequence
  derived and/or modified CDS sequence (opt5) from DENV-4__EU854299__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggucuggccgggagcugaagugcggguccggaaucuucgucguugauaaugugcauacauggaccgaacaauacaaauuucagcccgagagcccugcgagacuggccuccgcuauucucaacgcccacaaggacggcgugugugggauccgcucuacaacgcggcuggagaaugucauguggaaacagauuaccaacgaacuuaauuaugugcugugggagggaggccacgaccucacaguuguggcuggcgaugucaagggggugcugaccaaaggaaagagagcccugacacccccugcgagcgaccuuaaguacuccuggaaaaccuggggcaaggccaaaaucuucacgcccgaagcucggaacucuaccuuucucaucgaugggccggacacaagcgagugcccuaaugaacgcagagccuggaacuccuucgagguugaggauuacggauucggcauguuuaccacaaauauuuggaugaaguuccgggaagggagcucugaggugugugaccauagacugauguccgcugccaucaaagaucagaaggccguccacgcugacaugggauauuggauugaaagcucuaaaaaccaaaccuggcagaucgagcgcgcgucccugauugaagugaagacaugccucuggcccaagacccauacgcuguggagcaauggcguucuugagucucagaugcugaucccuaaaagcuacgccggccccuuuucccagcacaacuaucggcaaggguacgcuacacagaccgugggaccuuggcaccucggcaagcuggagaucgauuucggggaaugccccggaaccacagucaccauucaggagaacugugaccauagaggcccgagccugcgcacgacaaccgccucugggaaacuugugacacaguggugcuguagauccugcaccaugccuccccuccgguuucugggagaagauggcuguugguauggcauggagauccgcccccugagcgagaaggaagagaauauggugaaaucccaagucacagccgggcagggaaccucugaaacguucagcaugggccuccugugccuuacccuguuuguugaggaaugucucagacggcgcgugacaagaaagcacaugauucuggcuguggucaucacccugugcgccauuauccuugggggacucacauggauggaccugcugcgggcgcucaucaugcugggcgauaccauguccgggcgcauuggaggccagacgcaucuugcuaucauggccguguucaagaugucuccuggcuacguucuggggguguuucucagaaaacugacaagccgggagaccgcccugauggucauuggaauggcuaugacaaccacccuuuccaucccgcacgaccugauggagcucauugacggcaucucucuggggcucauccugcuuaagauugugacacaguucgauaacacgcaaguuggaacccuggcccucagccugacauuuauccgcuccaccaugagccuggugauggcguggagaacaauuauggcuguccuuuucguggucacccugaucccccucugucggacgucuugccugcagaaacagucccauuggguggaaauuacagcccucauccugggcgcccaagcucuuccuguuuaucugaugacccucaugaagggggccagcagacgcucuuggccccugaaugagggaauuauggcugugggccuggucucccuucugggcagcgcccuccugaaaaacgacgugccucucgcggggcccaugguugccggaggccugcuucuggcugccuacgugaugucuggguccagcgcugaucugucccucgaaaaggccgccaauguccagugggacgagauggcugauaucaccggaagcucuccuaucauugaagugaagcaggacgaggauggcagcuuuuccauccgggacguggaggaaacaaacaugauuacccugcuuguuaaacuggcgcucaucacagucucugggcuguacccccucgccauuccgaucacgaugacccugugguauauguggcaggugaagacacaaagaagcggagcucuuugggaugugccuucccccgccgccacccagaaagcugcccugucugagggcgucuaccgcaucaugcagcggggccuguucgggaagacacaggugggaguuggcauucacauggaagggguguuccacaccauguggcaugucacgagaggaagcgugaucugucacgagaccggccgccucgaaccuuccugggcggacguucggaaugauaugauuucuuaugggggaggcuggagacugggcgacaaaugggauaaggaggaggacgugcaaguccuugcuaucgaacccgggaagaacccgaaacaugugcagacaaagccuggacuguuuaaaacccucacaggcgagauuggggccguuacccuggacuucaagcccggaacaagcggcuccccuaucaucaaucgcaaagggaaggugauuggccucuacggaaacggcgucgugacgaaaagcggggauuaugugucugccaucacccaggcugaacggauuggagagcccgacuacgaggucgaugaagacaucuuuagaaagaagcggcugacaauuauggaucuucaccccggcgccgggaaaaccaagcgcauccugccuuccauuguuagagaggcgcugaaacggcgccucagaacccugauccuugcuccgacacgggugguggccgccgaaauggaggaagcucugagaggacuccccauccgcuaucagacgccugccgucaagagcgagcauaccggccgggagauuguggaccugaugugccacgcuacauucaccacaagacuccugucuuccacccgcguucccaauuacaaccuuaucgugauggaugaagcccacuuuacggacccuagcuccgucgcggcccggggguacauuucuacaagaguggagaugggcgaagcugccgcuaucuucaugaccgccacccccccuggagccacagauccguuuccccaaagcaauuccccuauugaggacaucgaacgcgagauccccgagcggagcuggaacaccggcuucgauuggauuacagacuaucaggggaaaaccguuugguuugugccuucuaucaaggcuggaaaugacauugcgaacugccugagaaaguccggcaaaaaggucauccagcugagccgcaaaacguucgauacagaauaccccaagaccaaacucacagacugggauuuuguggucaccacggacauuucugagaugggggccaacuucagagcuggacgggugaucgauccgcgcagaugucugaagccuguuauccuuaccgacggccccgaacgggugauucuggccgggcccaucccugugacacccgccagcgcugcccaacgcagaggccggauuggaagaaauccugcgcaggaggaugaccaguaugucuucuccggcgauccgcucaagaacgacgaagaucaugcucacuggaccgaggccaaaaugcugcuggacaauaucuacacacccgaggggauuaucccuacccucuuuggacccgaacgcgagaagacacaggccauugauggcgaauuccggcuuagaggggagcaacgcaaaaccuuuguugagcugaugcggagaggagaccugccuguguggcucucuuauaagguggcuagcgccggcaucuccuacaaagaccgggaauggugcuucacgggcgagcgcaacaaucagauccuggaagagaacauggaagucgagauuuggacaagagagggggaaaagaagaaacuucggcccaaguggcuggaugcgcgcguguaugccgacccgauggcucucaaagauuuuaaggaguucgccucuggaagaaaaagcaucacccuggacauucugaccgaaaucgcuucccucccuacauaccuuagcucucgggccaagcuggcucuggauaauauuguuaugcuccauaccacagagcgcggcgggagagccuaccagcacgcgcugaacgaacuucccgagucccuggagacgcucaugcugguggcccugcucggagcuaugaccgccggcaucuuucuuuucuuuaugcaggggaagggaaucggcaaacugagcaugggccugauuacaaucgcugucgccuccgggcuccuguggguggccgaaauucaaccucaguggaucgcugcgucuauuauccuugaguucuuucugaugguccuccugauccccgaaccugagaagcagcggaccccccaggacaaucaacugauuuaugugauccucacaauucuuaccaucauuggacugaucgccgcuaacgaaaugggccugauugagaaaacgaagaccgauuucggguuuuaccagguuaaaacagagaccacaauccucgacguggaucugcgcccggccagcgccuggacccuuuaugcugucgccacgacaauccugaccccuaugcucagacacacaauugaaaauaccuccgcgaaccugucucuggccgcuaucgccaaucaggcugccgugcucaugggacuuggcaagggguggccccugcaucggauggaccugggaguuccccuccuggcgaugggcuguuacagccaggugaacccuaccacacuuacggccucccuggucaugcuccuggugcacuaugcuauuaucggcccggggcugcaagccaaagcuaccagagaggcccagaagcgcacagcugccggaauuaugaagaaucccaccguggauggcaucacaguuaucgaccucgaaccuauuagcuacgaucccaaauucgagaagcagcuugggcaagucaugcugcuggugcucugcgcgggacagcugcuucugaugcggaccacgugggccuucugugaggugcucacacuggcuaccggcccuauccugacccucugggaagggaaccccggaagauuuuggaacacaaccauugccgucucuacagcuaauaucuuccgcggcuccuaucuugccggcgccgggcuggcguuuagccugauuaaaaacgcucagacgccucggagaggaaccggcacaaccggggagacacucggagaaaaguggaaacgccagcugaauucucuugaccggaaggaguucgaagaguacaagagauccggcauccuggagguugaccgcaccgaagccaaaagcgcucucaaggaugggucuaaaaucaagcaugccgugagccggggauccucuaaaauuagauggaucguggagcgcggcauggucaagccgaagggcaaagugguugaccuggggugcggacggggcggguggagcuacuauauggccacgcugaagaacgugaccgaagucaaaggauacacaaagggcgggcccggacacgaggaaccuauucccauggcuaccuauggcuggaaucucgugaaacuucauuccggcguugauguguuuuacaagccuacagagcaagucgacacccugcugugugauaucggggagagcuccucuaaccccacaauugaagagggaagaacccuccgcgugcugaagaugguggaaccguggcuuagcuccaaaccugaguucugcaucaagguccugaaucccuauaugcccacgguuauugaagagcucgagaaacugcagagaaagcacggcgggaaccuggugcgguguccucucucucgcaauagcacacacgaaauguacuggguguccggagccucuggcaacaucgucagcuccgugaauaccaccagcaaaaugcuucugaacagauuuacaacgcggcauagaaagcccaccuaugagaaagacguugaucugggggcgggaacacggucuguguccaccgaaacagagaagccugacaugaccaucauuggccgcagacuccagcggcugcaggaggaacacaaggagacauggcauuacgaucaagaaaauccguaccgcaccugggccuaucacggcagcuacgaggcucccucuacgggguccgccagcucuauggucaacggagugguuaaacuucugaccaagccuugggacgugauccccauggucacacagcucgcuaugaccgauacaaccccuuucggccagcagagaguguuuaaagaaaagguugacacgcggacaccccaaccgaaaccugggacccgcauggugaugacaaccacggccaauuggcugugggcgcugcucggaaagaagaaaaaccccagacugugcacccgggaggaguucauuuccaagguccgcagcaaugccgcuaucggcgccguguuucaggaagagcagggguggacauccgcuagcgaagccgucaacgacucuagauucugggagcuuguggauaaagaacgggcucugcaccaagagggcaagugugagagcugcguuuauaacaugaugggaaaacgcgaaaagaagcucggcgaguuugggagagccaaaggaucccgggcgauuugguacauguggcugggcgcccgcuuccuugaauucgaggcucugggguuucucaaugaagaccauugguucggaagagagaacucuuggagcggcguggagggggaaggccugcaccggcugggauauauccucgaggaaaucgauaagaaagacggcgaucugauguacgccgacgauaccgcugggugggacacaagaauuaccgaggaugaccuucagaaugaggaacugaucacagagcagauggccccucaucacaagauucucgccaaagcgaucuuuaagcugaccuaucagaacaaggucgugaaagugcuucgccccacgccucggggagcuguuauggauauuaucuccagaaaggaccaacgcggcucugggcaggugggaacauacggccugaauaccuucaccaacauggaaguccagcucauccggcagauggaggccgaaggggugauuacacaagaugacaugcagaaucccaaaggccugaaggagagaguugagaaauggcugcgcgaaugcggaguggaccggcucaagagaauggccaucagcggcgaugacugugucgugaaaccgcuggaugagcgcuuugggaccucccuucuguuccucaacgacaugggaaagguccggaaggauauuccucagugggaacccucuaaaggcuggaagaauuggcaggaggugcccuuuugcagccaucacuuccacaaaaucuuuaugaaggacgggagaucccugguugugccuugucgcaaccaagaugaacuuauuggacgggcuagaaucagccagggcgccggguggucucugcgggagacagcuugccucggcaaagccuacgcgcagauguggucccugauguauuuccauagacgcgaccugcggcucgccagcauggcuaucuguucugccgucccgacggagugguuucccaccuccagaacaaccuggagcauucacgcucaucaccaguggaugacaaccgaagauaugcugaagguguggaaucgcguuuggaucgaggacaacccuaauaugauugauaagacgcccgugcacuccugggaagacaucccuuaccuuggaaaaagagaggaccuguggugcggcucucucauugggcugagcucccgggccaccugggcgaagaacauccauacagccauuacccaaguccgcaaucuuaucggaaaagaagaguauguggauuacaugcccgugaugaagagauauagcgcuccuucugaguccgaaggcguucuguga

SEQ ID NO: 20991 - RNA, 9867 nt, Artificial Sequence
  derived and/or modified CDS sequence (opt5) from DENV-4__FJ182016__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggucuggccgggagcugaagugcggguccggaaucuucgucguugauaaugugcauacauggaccgaacaauacaaauuucagcccgagagcccugcgagacuggccuccgcuauucucaacgcccacaaggacggcgugugugggauccgcucuacaacgcggcuggagaaugucauguggaaacagauuaccaacgaacuuaauuaugugcugugggagggaggccacgaccucacaguuguggcuggcgaugucaagggggugcugaccaaaggaaagagagcccugacacccccugcgagcgaccuuaaguacuccuggaaaaccuggggcaaggccaaaaucuucacgcccgaagcucggaacucuaccuuucucaucgaugggccggacacaagcgagugcccuaaugaacgcagagccuggaacuccuucgagguugaggauuacggauucggcauguuuaccacaaauauuuggaugaaguuccgggaagggagcucugaggugugugaccauagacugauguccgcugccaucaaagaucagaaggccguccacgcugacaugggauauuggauugaaagcucuaaaaaccaaaccuggcagaucgagcgcgcgucccugauugaagugaagacaugccucuggcccaagacccauacgcuguggagcaauggcguucuugagucucagaugcugaucccuaaaagcuacgccggccccuuuucccagcacaacuaucggcaaggguacgcuacacagaccgugggaccuuggcaccucggcaagcuggagaucgauuucggggaaugccccggaaccacagucaccauucaggagaacugugaccauagaggcccgagccugcgcacgacaaccgccucugggaaacuugugacacaguggugcuguagauccugcaccaugccuccccuccgguuucugggagaagauggcuguugguauggcauggagauccgcccccugagcgagaaggaagagaauauggugaaaucccaagucacagccgggcagggaaccucugaaacguucagcaugggccuccugugccuuacccuguuuguugaggaaugucucagacggcgcgugacaagaaagcacaugauucuggcuguggucaucacccugugcgccauuauccuugggggacucacauggauggaccugcugcgggcgcucaucaugcugggcgauaccauguccgggcgcauuggaggccagacgcaucuugcuaucauggccguguucaagaugucuccuggcuacguucuggggguguuucucagaaaacugacaagccgggagaccgcccugauggucauuggaauggcuaugacaaccacccuuuccaucccgcacgaccugauggagcucauugacggcaucucucuggggcucauccugcuuaagauugugacacaguucgauaacacgcaaguuggaacccuggcccucagccugacauuuauccgcuccaccaugagccuggugauggcguggagaacaauuauggcuguccuuuucguggucacccugaucccccucugucggacgucuugccugcagaaacagucccauuggguggaaauuacagcccucauccugggcgcccaagcucuuccuguuuaucugaugacccucaugaagggggccagcagacgcucuuggccccugaaugagggaauuauggcugugggccuggucucccuucugggcagcgcccuccugaaaaacgacgugccucucgcggggcccaugguugccggaggccugcuucuggcugccuacgugaugucuggguccagcgcugaucugucccucgaaaaggccgccaauguccagugggacgagauggcugauaucaccggaagcucuccuaucauugaagugaagcaggacgaggauggcagcuuuuccauccgggacguggaggaaacaaacaugauuacccugcuuguuaaacuggcgcucaucacagucucugggcuguacccccucgccauuccgaucacgaugacccugugguauauguggcaggugaagacacaaagaagcggagcucuuugggaugugccuucccccgccgccacccagaaagcugcccugucugagggcgucuaccgcaucaugcagcggggccuguucgggaagacacaggugggaguuggcauucacauggaagggguguuccacaccauguggcaugucacgagaggaagcgugaucugucacgagaccggccgccucgaaccuuccugggcggacguucggaaugauaugauuucuuaugggggaggcuggagacugggcgacaaaugggauaaggaggaggacgugcaaguccuugcuaucgaacccgggaagaacccgaaacaugugcagacaaagccuggacuguuuaaaacccucacaggcgagauuggggccguuacccuggacuucaagcccggaacaagcggcuccccuaucaucaaucgcaaagggaaggugauuggccucuacggaaacggcgucgugacgaaaagcggggauuaugugucugccaucacccaggcugaacggauuggagagcccgacuacgaggucgaugaagacaucuuuagaaagaagcggcugacaauuauggaucuucaccccggcgccgggaaaaccaagcgcauccugccuuccauuguuagagaggcgcugaaacggcgccucagaacccugauccuugcuccgacacgggugguggccgccgaaauggaggaagcucugagaggacuccccauccgcuaucagacgccugccgucaagagcgagcauaccggccgggagauuguggaccugaugugccacgcuacauucaccacaagacuccugucuuccacccgcguucccaauuacaaccuuaucgugauggaugaagcccacuuuacggacccuagcuccgucgcggcccggggguacauuucuacaagaguggagaugggcgaagcugccgcuaucuucaugaccgccacccccccuggagccacagauccguuuccccaaagcaauuccccuauugaggacaucgaacgcgagauccccgagcggagcuggaacaccggcuucgauuggauuacagacuaucaggggaaaaccguuugguuugugccuucuaucaaggcuggaaaugacauugcgaacugccugagaaaguccggcaaaaaggucauccagcugagccgcaaaacguucgauacagaauaccccaagaccaaacucacagacugggauuuuguggucaccacggacauuucugagaugggggccaacuucagagcuggacgggugaucgauccgcgcagaugucugaagccuguuauccuuaccgacggccccgaacgggugauucuggccgggcccaucccugugacacccgccagcgcugcccaacgcagaggccggauuggaagaaauccugcgcaggaggaugaccaguaugucuucuccggcgauccgcucaagaacgacgaagaucaugcucacuggaccgaggccaaaaugcugcuggacaauaucuacacacccgaggggauuaucccuacccucuuuggacccgaacgcgagaagacacaggccauugauggcgaauuccggcuuagaggggagcaacgcaaaaccuuuguugagcugaugcggagaggagaccugccuguguggcucucuuauaagguggcuagcgccggcaucuccuacaaagaccgggaauggugcuucacgggcgagcgcaacaaucagauccuggaagagaacauggaagucgagauuuggacaagagagggggaaaagaagaaacuucggcccaaguggcuggaugcgcgcguguaugccgacccgauggcucucaaagauuuuaaggaguucgccucuggaagaaaaagcaucacccuggacauucugaccgaaaucgcuucccucccuacauaccuuagcucucgggccaagcuggcucuggauaauauuguuaugcuccauaccacagagcgcggcgggagagccuaccagcacgcgcugaacgaacuucccgagucccuggagacgcucaugcugguggcccugcucggagcuaugaccgccggcaucuuucuuuucuuuaugcaggggaagggaaucggcaaacugagcaugggccugauuacaaucgcugucgccuccgggcuccuguggguggccgaaauucaaccucaguggaucgcugcgucuauuauccuugaguucuuucugaugguccuccugauccccgaaccugagaagcagcggaccccccaggacaaucaacugauuuaugugauccucacaauucuuaccaucauuggacugaucgccgcuaacgaaaugggccugauugagaaaacgaagaccgauuucggguuuuaccagguuaaaacagagaccacaauccucgacguggaucugcgcccggccagcgccuggacccuuuaugcugucgccacgacaauccugaccccuaugcucagacacacaauugaaaauaccuccgcgaaccugucucuggccgcuaucgccaaucaggcugccgugcucaugggacuuggcaagggguggccccugcaucggauggaccugggaguuccccuccuggcgaugggcuguuacagccaggugaacccuaccacacuuacggccucccuggucaugcuccuggugcacuaugcuauuaucggcccggggcugcaagccaaagcuaccagagaggcccagaagcgcacagcugccggaauuaugaagaaucccaccguggauggcaucacaguuaucgaccucgaaccuauuagcuacgaucccaaauucgagaagcagcuugggcaagucaugcugcuggugcucugcgcgggacagcugcuucugaugcggaccacgugggccuucugugaggugcucacacuggcuaccggcccuauccugacccucugggaagggaaccccggaagauuuuggaacacaaccauugccgucucuacagcuaauaucuuccgcggcuccuaucuugccggcgccgggcuggcguuuagccugauuaaaaacgcucagacgccucggagaggaaccggcacaaccggggagacacucggagaaaaguggaaacgccagcugaauucucuugaccggaaggaguucgaagaguacaagagauccggcauccuggagguugaccgcaccgaagccaaaagcgcucucaaggaugggucuaaaaucaagcaugccgugagccggggauccucuaaaauuagauggaucguggagcgcggcauggucaagccgaagggcaaagugguugaccuggggugcggacggggcggguggagcuacuauauggccacgcugaagaacgugaccgaagucagaggauacacaaaaggcgggcccggacacgaggaaccuauucccauggcuaccuauggcuggaaucucgugaagcuucauuccggcguugauguguuuuacaaaccuacagagcaagucgacacccugcugugugauaucggggagagcuccucuaaccccacaauugaagagggacgcacccucagagugcugaagaugguggaaccguggcuuagcuccaagccugaguucugcaucaaaguccugaaucccuauaugcccacgguuauugaagagcucgagaagcugcagcggaaacacggcgggaaccuggugcgcuguccucucucuagaaauagcacacacgaaauguacuggguguccggagccucuggcaacaucgucagcuccgugaauaccaccagcaagaugcuucugaaccgguuuacaacgagacaucggaaacccaccuaugagaaggacguugaucugggggcgggaacacgcucuguguccaccgaaacagagaaaccugacaugaccaucauuggcagacggcuccagcgccugcaggaggaacacaaggagacauggcauuacgaucaagaaaauccguacagaaccugggccuaucacggcagcuacgaggcucccucuacgggguccgccagcucuauggucaacggagugguuaagcuucugaccaaaccuugggacgugauccccauggucacacagcucgcuaugaccgauacaaccccuuucggccagcagcggguguuuaaggaaaaaguugacacgcgcacaccccaaccgaagccugggaccagaauggugaugacaaccacggccaauuggcugugggcgcugcucggaaaaaagaagaacccccggcugugcacccgcgaggaguucauuuccaaagucagaagcaaugccgcuaucggcgccguguuucaggaagagcagggguggacauccgcuagcgaagccgucaacgacucucgguucugggagcuuguggauaaggaacgcgcucugcaccaagagggcaaaugugagagcugcguuuauaacaugaugggaaagagagaaaaaaagcucggcgaguuugggcgggccaagggaucccgcgcgauuugguacauguggcugggcgccagauuccuugaauucgaggcucugggguuucucaaugaagaccauugguucggacgggagaacucuuggagcggcguggagggggaaggccugcacagacugggauauauccucgaggaaaucgauaaaaaggacggcgaucugauguacgccgacgauaccgcugggugggacacacgcauuaccgaggaugaccuucagaaugaggaacugaucacagagcagauggccccucaucacaaaauucucgccaaggcgaucuuuaaacugaccuaucagaacaaggucgugaaggugcuucggcccacgccuagaggagcuguuauggauauuaucucccgcaaagaccaacggggcucugggcaggugggaacauacggccugaauaccuucaccaacauggaaguccagcucaucagacagauggaggccgaaggggugauuacacaagaugacaugcagaaucccaagggccugaaagagcgcguugagaaguggcugcgggaaugcggaguggacagacucaaacgcauggccaucagcggcgaugacugugucgugaagccgcuggaugagcgguuugggaccucccuucuguuccucaacgacaugggaaaagucagaaaggauauuccucagugggaacccucuaagggcuggaaaaauuggcaggaggugcccuuuugcagccaucacuuccaccgcaucuuuaugaaggacgggcggucccugguugugccuuguagaaaccaagaugaacuuauuggacgggcuagaaucagccagggcgccggguggucucugcgcgagacagcuugccucggcaaagccuacgcgcagauguggucccugauguauuuccaucggagagaccugcgccucgccagcauggcuaucuguucugccgucccgacggagugguuucccaccuccagaacaaccuggagcauucacgcucaucaccaguggaugacaaccgaagauaugcugaagguguggaaucggguuuggaucgaggacaacccuaauaugauugauaaaacgcccgugcacuccugggaagacaucccuuaccuuggaaagcgcgaggaccuguggugcggcucucucauugggcugagcuccagagccaccugggcgaagaacauccauacagccauuacccaaguccggaaucuuaucggaaaagaagaguauguggauuacaugcccgugaugaagcgcuauagcgcuccuucugaguccgaaggcguucuguga

SEQ ID NO: 20992 - RNA, 9867 nt, Artificial Sequence
  derived and/or modified CDS sequence (opt5) from DENV-4__EU854300__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggaauggccgggagcugaagugcgggucuggaaucuucgucguugauaacgugcauacauggaccgaacaauacaaauuucagcccgaguccccugcgagacuggccagcgcuauucucaaugcccacaaggacggcgugugugggauccgcuccacaacgcggcuggagaacgucauguggaaacagauuaccaaugaacuuaacuaugugcugugggagggaggccacgaccucacaguuguggcuggcgaugucaagggggugcugaccaaaggaaagagagcccugacacccccugcgucugaccuuaaguacagcuggaaaaccuggggcaaggccaaaaucuucacgcccgaaacccggaauuccacauuucucaucgaugggccggacaccucugagugcccuaacgaacgcagagcuuggaauagcuucgagguugaggauuacggauucggcauguuuacaaccaacauuuggaugaaguuccgggaaggguccagcgaggugugugaccauagacugaugucugccgcuaucaaagaucagaaggccguccacgccgacaugggauauuggauugaauccagcaaaaaucaaacauggcagaucgagcgcgcuucucugauugaagugaagaccugccucuggcccaagacgcauacacugugguccaacggcguucuugagagccagaugcugaucccuaaaucuuacgcgggccccuuuagccagcacaacuaucggcaaggguacgccacccagaccgugggaccuuggcaccucggcaagcuggagaucgauuucggggaaugccccggaacaaccgucacgauucaggagaauugugaccauagaggcccgucccugcgcacaaccacagcuagcgggaaacuugugacccaguggugcuguagaucuugcacaaugccuccccuccgguuucugggagaagauggcuguugguauggcauggagauccgcccccuguccgagaaggaagagaacauggugaaaagccaagucaccgccgggcagggaacguccgaaaccuucucuaugggccuccugugccuuacacuguuuguugaggaaugucucagacggcgcgugaccagaaagcacaugauucuggccguggucaucacacugugcgcuauuauccuugggggacucaccuggauggaccugcugcgggcccucaucaugcugggcgauacgaugagcgggcgcauuggaggccagacacaucuugcgaucauggcuguguucaagauguccccuggcuacguucuggggguguuucucagaaaacugaccucucgggagacagcccugauggucauuggaauggccaugaccaccacacuuagcaucccgcacgaccugauggagcucauugacggcaucucccuggggcucauccugcuuaagauugugacgcaguucgauaauacccaaguuggaacacuggcucucucucugaccuuuauccgcagcacaaugucccuggugauggccuggagaaccauuauggcgguccuuuucguggucacgcugaucccccucugucggacaagcugccugcagaaacagucucauuggguggaaauuaccgcucucauccugggcgcccaagcccuuccuguuuaucugaugacccucaugaagggggcuuccagacgcagcuggccccugaacgagggaauuauggccgugggccuggucucucuucugggcuccgcucuccugaaaaaugacgugccucucgccgggcccaugguugcgggaggccugcuucuggccgcuuacgugaugagcgggucuuccgccgaucugagccucgaaaaggcugccaacguccagugggacgagauggccgauaucacaggauccagcccuaucauugaagugaagcaggacgaggauggcucuuuuagcauccgggacguggaggaaaccaauaugauuacacugcuuguuaaacuggcucucaucacggucuccgggcuguacccccucgcgauuccgaucaccaugacacugugguauauguggcaggugaagacccaaagaucuggagcccuuugggaugugccuagccccgcugccacacagaaagccgcucuguccgagggcgucuaccgcaucaugcagcggggccuguucgggaagacccaggugggaguuggcauucacaucgaagggguguuccacacgauguggcaugucaccagaggaucugugauuugucacgagacaggccgccucgaaccuagcugggccgacguucggaacgauaugaucuccuaugggggaggcuggagacugggcgacaaaugggauaaggaggaggacgugcaaguccuugcgauugaacccgggaagaauccgaaacaugugcagaccaagccuggacuguuuaaaacacucaccggcgagaucggggcuguuacacuggacuucaagcccggaacgucuggcagcccuaucauuaaccgcaaagggaaggugaucggccucuacggaaauggcgucgugaccaaauccggggauuaugugagcgccauuacacaggccgaacggaucggagagcccgacuacgaggucgaugaagacauuuuuagaaagaagcggcugaccaucauggaucuucaccccggcgcugggaaaaccaagcgcauucugccuucuaucguuagagaggcccugaaacggcgccucagaacacugauccuugcgccgacgcgggugguggcugccgaaauggaggaagcccugagaggacuccccauucgcuaucagaccccugcugucaaguccgagcauacaggccgggagaucguggaccugaugugccacgccaccuucacaaccagacuccugagcucuacgcgcguucccaacuacaaucuuauugugauggaugaagcucacuuuacagacccuuccagcgucgccgcgcggggguacaucuccaccagaguggagaugggcgaagccgcugccauuuucaugaccgcuacacccccuggagccaccgauccguuuccccaaucuaacagcccuaucgaggacaucgaacgcgagauucccgagcgguccuggaauacaggcuucgauuggaucaccgacuaucaggggaaaacgguuugguuugugccuagcauuaaggccggaaacgacaucgcuaacugccugagaaagucuggcaaaaaggucauucagcugucccgcaaaacauucgauaccgaauaccccaagacaaaacucaccgacugggauuuuguggucacgaccgacaucagcgagaugggggcgaauuucagagccggacgggugaucgauccgcgcagaugucugaagccuguuauucuuacagacggccccgaacgggugauccuggcugggcccauuccugugacccccgccucugccgcucaacgcagaggccggaucggaagaaaccucgcccaggaggaugaccaguaugucuucagcggcgauccucugaagaaugacgaagaucaugcgcacuggacagaggcuaaaaugcugcucgacaacauuuacaccccggaggggaucauucccacacuuuuuggaccugaacgcgagaagacccaggccaucgauggcgaauuccggcugagaggggagcaacgcaaaacguuuguugagcugaugcggagaggagaccuccccguguggcuguccuauaagguggccucugcuggcaucagcuacaaagaccgggaauggugcuucacaggcgagcgcaauaaccagauucuugaagagaauauggaagucgagaucuggaccagagagggggaaaagaagaaacugcggccuaaguggcucgaugcccgcguguaugcggaccccauggcccugaaagauuuuaaggaguucgcuuccggaagaaaaucuauuacccuggacauccucacagaaauugccagccuuccgaccuaccuguccagccgggcuaagcuggcccucgauaacaucguuaugcugcauacaacggagcgcggcgggagagcuuaccagcacgcccuuaaugaacugccugagucucucgagacccugaugcugguggcgcuccuuggagccaugacagcuggcaucuuucuguucuuuaugcaggggaagggaauuggcaaacuguccaugggccucaucaccauugccgucgcuagcgggcugcuuuggguggccgaaauccaaccccaguggauugccgcuuccaucauccuggaguucuuucucaugguccugcugauuccugaacccgagaagcagcggacaccucaggacaaccaacucaucuaugugauucuuaccauccugacgauuaucggacugauugcggccaaugaaaugggccucaucgagaaaaccaaggcugauuucggguuuuaccagguuaaaacagagaccacaauccuggacguggaucuucgccccgccucugccuggacccuguaugcugucgccacgacaauucucaccccgaugcugagacacacaaucgaaaacaccagcgcgaaucugucccucgccgcuauugccaaccaggcugccgugcuuaugggacugggcaagggguggccucugcaucggauggaccucggaguuccccugcuugcgaugggcuguuacucucaggugaaucccaccacacugacggccagccucgucaugcugcuggugcacuaugcuaucauuggcccugggcuccaagccaaagcuaccagagaggcccagaagcgcacagcugccggaaucaugaagaacccgaccguggauggcaucacaguuauugaccuugaacccaucuccuacgauccuaaauucgagaagcagcuggggcaagucaugcugcucgugcugugcgcgggacagcuucugcucaugcggaccacgugggccuucugugaggugcugacacuggcuaccggccccauucucacccuuugggaagggaacccuggaagauuuuggaauacaaccaucgccgucagcacagcuaacauuuuccgcggcucuuaucuggccggcgccgggcuggcguuuucccucaucaaaaaugcucagacgccccggagaggaaccggcacaaccggggagacacugggagaaaaguggaaacgccagcuuaacagccuggaccggaaggaguucgaagaguacaagagaucuggcauccucgagguugaccgcaccgaagccaaauccgcucugaaggaugggagcaaaauuaagcaugccgugucucggggaagcuccaaaaucagauggauuguggagcgcggcauggucaagccuaagggcaaagugguugaccuggggugcggacggggcggguggucuuacuauauggccacgcucaagaaugugaccgaagucaaaggauacacaaagggcgggccgggacacgaggaacccaucccuauggcuaccuauggcuggaaccuugugaaacugcauagcggcguugauguguuuuacaagcccacagagcaagucgacacccugcucugugauauuggggaguccagcuccaauccuacaaucgaagagggaagaacccugcgcgugcuuaagaugguggaacccuggcugucuagcaaaccggaguucugcauuaagguccucaacccuuauaugcccacgguuaucgaagagcuggagaaacugcagagaaagcacggcgggaaucucgugcgguguccccuuucccgcaacucuacacacgaaauguacugggugagcggagccuccggcaauaucgucucuagcgugaacaccaccuccaaaaugcugcugaauagauuuacaacgcggcauagaaagccuaccuaugagaaagacguugaucucggggcgggaacacggagcgugucuaccgaaacagagaagcccgacaugaccauuaucggccgcagacugcagcggcuucaggaggaacacaaggagacauggcauuacgaucaagaaaacccuuaccgcaccugggccuaucacggcuccuacgaggcuccgagcacggggucugccuccagcauggucaauggagugguuaaacugcucaccaagcccugggacgugauuccuauggucacacagcuggcuaugaccgauacaacccccuucggccagcagagaguguuuaaagaaaagguugacacgcggacaccucaacccaaaccggggacccgcauggugaugacaaccacggccaacuggcugugggcgcuccugggaaagaagaaaaauccuagacuuugcacccgggaggaguucaucucuaagguccgcuccaacgccgcuauuggcgccguguuucaggaagagcagggguggacaagcgcuuccgaagccgucaacgacagcagauucugggagcugguggauaaagaacgggcucuccaccaagagggcaagugugagucuugcguuuauaauaugaugggaaaacgcgaaaagaagcugggcgaguuugggagagccaaaggaagccgggcgaucugguacauguggcuuggcgcccgcuuccuggaauucgaggcucucggguuucugaacgaagaccauugguucggaagagagaauuccuggucuggcguggagggggaaggccugcaccggcucggauauauccuggaggaaauugauaagaaagacggcgaucuuauguacgccgacgauaccgcugggugggacacaagaaucaccgaggaugaccugcagaacgaggaacucauuacagagcagauggccccccaucacaagauccuggccaaagcgauuuuuaagcuuaccuaucagaauaaggucgugaaagugcugcgcccuacgccccggggagcuguuauggauaucaucagcagaaaggaccaacgcggcuccgggcaggugggaacauacggccucaacaccuucaccaauauggaaguccagcugauucggcagauggaggccgaaggggugaucacacaagaugacaugcagaacccuaaaggccugaaggagagaguugagaaauggcuccgcgaaugcggaguggaccggcugaagagaauggccauuucuggcgaugacugugucgugaaaccccuugaugagcgcuuugggaccagccugcucuuccugaaugacaugggaaagguccggaaggauaucccgcagugggaaccuuccaaaggcuggaagaacuggcaggaggugcccuuuugcucucaucacuuccacaaaauuuuuaugaaggacgggagaagccuuguugugcccugucgcaaucaagaugaacugaucggacgggcuagaaucucccagggcgccggguggagccuccgggagacagcuugccugggcaaagccuacgcgcagauguggucucugauguauuuccauagacgcgaccuccggcuggccuccauggcuauuuguagcgccgucccuacggagugguuuccgaccucuagaacaaccugguccauccacgcucaucaccaguggaugacaaccgaagauaugcuuaagguguggaaccgcguuuggauugaggacaaucccaacaugaucgauaagacgccugugcacagcugggaagacauucccuaccugggaaaaagagaggaccucuggugcggcucccugaucgggcuuucuagccgggccaccugggcgaagaauauucauacagccaucacccaaguccgcaaccugaucggaaaagaagaguauguggauuacaugccugugaugaagagauauuccgcucccagcgagucugaaggcguucucuga

SEQ ID NO: 20993 - RNA, 9867 nt, Artificial Sequence
  derived and/or modified CDS sequence (opt5) from DENV-4__FJ182017__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucugcgugggugauguaugggaccugcacacagagcggagagagacggcgcgaaaagagauccgucgcucucaccccccacucuggcauggggcuggagacacgggccgaaaccuggaugagcuccgagggagccuggaaacaugcucaacgcguggagucuuggauccuuagaaauccuggcuucgcccugcucgcuggcuuuauggccuacaugaucgggcagacgggaauucagcggacaguuuucuuugugcugaugaugcuugucgcgcccagcuauggcaugcgcuguguggggguuggaaacagagauuucguggaaggcgucuccgggggagccuggguggaccuggugcucgagcacggcggcugcgucaccacaauggcucaggggaagccuacccuggauuuugaacugaccaagacaacggccaaagagguugcucuccugcggaccuacuguaucgaagcccuuauuagcaauaucacaaccgcgacacgcugcccgacccaaggagagcccuaucugaaggaggaacaggaccagcaguacauuuguagacgggaugugguggaccgcggcugggggaacggaugcggccucuucgggaaaggaggcgucgugacgugcgccaaguuuucuuguuccggcaaaaucacagggaaucugguucaaauugagaaccuugaauauaccguggucgugaccguucauaauggagauacacacgcugugggcaacgacaccagcaaucacggggucacagccacgaucaccccuagaucucccuccguggaggucaagcugccugauuacggagaacucacacuggacugcgagccccggagcggcaucgacuucaacgagaugauucugaugaagaugaaaaagaaaaccuggcucgugcauaagcagugguuucuggaucuuccgcugccuuggacaaccggggcugacacgucugaaguucacuggaauuacaaagagagaauggugaccuucaaggucccccaugccaaacgccaggaugugacaguucucggcucccaggaaggagccaugcacagcgcucuggcgggcgccaccgagguggacuccggggauggaaaccacauguuugcuggccaucuuaaguguaagguccggauggaaaaacugagaaucaaggggaugucuuauacaaugugcagcggaaaauucuccauugacaaggagauggccgagacccaacacggcacgacaguggugaaaguuaaguacgaaggggccggcgcuccuuguaagguccccaucgagauucgcgaugugaauaaagaaaagguggucggacgggugaucagcgccaccccccucgcggagaacacaaacucuguuaccaauaucgagcuggaaccuccguucggcgacuccuauauugugaucggggucggaaacagcgcucugacccuccauugguuuagaaaaggcucuagcauugggaagauguucgaguccacauaccgcggagccaaacggauggccauccugggcgaaacggcuugggauuuugggucugugggcggacuuuucaccagccugggcaaggccguucaccagguguuuggguccgucuauacaaccauguucggaggcgugagcuggaugauuagaauccucaucggguuucugguucuguggauuggaacaaauucucgcaacaccuccauggcuaugacgugcaucgccgugggcgggauuacacuuuuccucggcuuuaccguccaggcggacaugggauguguggugagcuggucuggccgggagcugaagugcggguccggaaucuucgucguugauaaugugcauaccuggacagaacaauacaaauuucagcccgagagcccugccagacuggcuuccgccauucucaacgcucacaaggacggcgugugugggauccgcucuaccacacggcuggagaaugucauguggaaacagauuacgaacgaacuuaauuaugugcugugggagggaggccacgaccucaccguuguggccggcgaugucaagggggugcugacaaaaggaaagagagcgcugacccccccugccagcgaccuuaaguacuccuggaaaacauggggcaaggcuaaaaucuucacccccgaagcccggaacucuacguuucucaucgaugggccggacaccagcgagugcccuaaugaacgcagagcuuggaacuccuucgagguugaggauuacggauucggcauguuuacaaccaauauuuggaugaaguuccgggaagggagcucugaggugugugaccauagacugauguccgccgccaucaaagaucagaaggcuguccacgcggacaugggauauuggauugaaagcucuaaaaaccaaacauggcagaucgagcgcgccucccugauugaagugaagaccugccucuggcccaagacacauacccuguggagcaauggcguucuugagucucagaugcugaucccuaaaagcuacgcuggccccuuuucccagcacaacuaucggcaaggguacgccacgcagacagugggaccuuggcaccucggcaagcuggagaucgauuucggggaaugccccggaaccaccgucacaauucaggagaacugugaccauagaggcccgagccugcgcaccacgacagccucugggaaacuugugacccaguggugcuguagauccugcacaaugccuccccuccgguuucugggagaagauggcuguugguauggcauggagauccgcccccugagcgagaaggaagagaauauggugaaaucccaagucaccgcugggcagggaacaucugaaaccuucagcaugggccuccugugccuuacgcuguuuguugaggaaugucucagacggcgcgugaccagaaagcacaugauucuggccguggucaucacacugugcgcgauuauccuugggggacucaccuggauggaccugcugcgggcucucaucaugcugggcgauacaauguccgggcgcauuggaggccagacccaucuugccaucauggccguguucaagaugucuccuggcuacguucuggggguguuucucagaaaacugacgagccgggagacagcucugauggucauuggaauggccaugaccacaacccuuuccaucccgcacgaccugauggagcucauugacggcaucucucuggggcucauccugcuuaagauugugacccaguucgauaacacacaaguuggaacgcuggcgcucagccugaccuuuauccgcuccacaaugagccuggugauggcuuggagaaccauuauggccguccuuuucguggucacacugaucccccucugucggaccucuugccugcagaaacagucccauuggguggaaauuacggcccucauccugggcgcucaagcccuuccuguuuaucugaugacacucaugaagggggcuagcagacgcucuuggccccugaaugagggaauuauggccgugggccuggucucccuucugggcagcgcgcuccugaaaaacgacgugccucucgccgggcccaugguugcuggaggccugcuucuggccgcuuacgugaugucuggguccagcgccgaucugucccucgaaaaggccgcuaauguccagugggacgagauggcggauaucaccggaagcucuccuaucauugaagugaagcaggacgaggauggcagcuuuuccauccgggacguggaggaaaccaacaugauuacacugcuuguuaaacuggcccucaucaccgucucugggcuguacccccucgcuauuccgaucacaaugacgcugugguauauguggcaggugaagacccaaagaagcggagcccuuugggaugugccuucccccgccgcuacacagaaagccgcgcugucugagggcgucuaccgcaucaugcagcggggccuguucgggaagacccaggugggaguuggcauucacauggaagggguguuccacacaauguggcaugucaccagaggaagcgugaucugucacgagacgggccgccucgaaccuuccugggcugacguucggaaugauaugauuucuuaugggggaggcuggagacugggcgacaaaugggauaaggaggaggacgugcaaguccuugccaucgaacccgggaagaacccgaaacaugugcagaccaagccuggacuguuuaaaacacucaccggcgagauuggggccguuacacuggacuucaagcccggaaccagcggcuccccuaucaucaaucgcaaagggaaggugauuggccucuacggaaacggcgucgugacaaaaagcggggauuaugugucugcuaucacgcaggccgaacggauuggagagcccgacuacgaggucgaugaagacaucuuuagaaagaagcggcugaccauuauggaucuucaccccggcgcggggaaaacaaagcgcauccugccuuccauuguuagagaggcucugaaacggcgccucagaacccugauccuugccccgacccgggugguggccgcugaaauggaggaagcccugagaggacuccccauccgcuaucagacaccugcugucaagagcgagcauacgggccgggagauuguggaccugaugugccacgccaccuucacaaccagacuccugucuuccacacgcguucccaauuacaaccuuaucgugauggaugaagcgcacuuuaccgacccuagcuccgucgccgcucggggguacauuucuacgagaguggagaugggcgaagccgcugccaucuucaugacagccacccccccuggagcuaccgauccguuuccccaaagcaauuccccuauugaggacaucgaacgcgagauccccgagcggagcuggaacacaggcuucgauuggauuaccgacuaucaggggaaaacaguuugguuugugccuucuaucaaggcgggaaaugacauugccaacugccugagaaaguccggcaaaaaggucauccagcugagccgcaaaaccuucgauacggaauaccccaagacaaaacucaccgacugggauuuuguggucacaaccgacauuucugagaugggggcuaacuucagagccggacgggugaucgauccgcgcagaugucugaagccuguuauccuuacggacggccccgaacgggugauucuggccgggcccaucccugugacccccgcuagcgccgcgcaacgcagaggccggauuggaagaaauccugcucaggaggaugaccaguaugucuucuccggcgauccgcucaagaacgacgaagaucaugcccacuggacagaggccaaaaugcugcuggacaauaucuacacccccgaggggauuaucccuacacucuuuggacccgaacgcgagaagacccaggcuauugauggcgaauuccggcuuagaggggagcaacgcaaaacauuuguugagcugaugcggagaggagaccugccuguguggcucucuuauaagguggccagcgcgggcaucuccuacaaagaccgggaauggugcuucaccggcgagcgcaacaaucagauccuggaagagaacauggaagucgagauuuggacgagagagggggaaaagaagaaacuucggcccaaguggcuggaugcccgcguguaugcugacccgauggcccucaaagauuuuaaggaguucgcuucuggaagaaaaagcaucacacuggacauucugaccgaaaucgccucccucccuaccuaccuuagcucucgggcuaagcuggcccuggauaauauuguuaugcuccauacaaccgagcgcggcgggagagcguaccagcacgcccugaacgaacuucccgagucccuggagacacucaugcugguggcucugcucggagccaugacggcuggcaucuuucuuuucuuuaugcaggggaagggaaucggcaaacugagcaugggccugauuaccaucgccgucgccuccgggcuccuguggguggcugaaauucaaccucaguggaucgcggccucuauuauccuugaguucuuucugaugguccuccugauccccgaaccugagaagcagcggacaccccaggacaaucaacugauuuaugugauccucaccauucuuacaaucauuggacugaucgcugccaacgaaaugggccugauugagaaaaccaagacggauuucggguuuuaccagguuaaaaccgagacaaccauccucgacguggaucugcgcccggccagcgcuuggacacuuuaugccgucgcgaccacgauccugacaccuaugcucagacacaccauugaaaauacauccgccaaccugucucuggcugccaucgcuaaucaggccgcggugcucaugggacuuggcaagggguggccccugcaucggauggaccugggaguuccccuccuggccaugggcuguuacagccaggugaacccuaccacccuuacagcuucccuggucaugcuccuggugcacuaugccauuaucggcccggggcugcaagcuaaagccacgagagaggcucagaagcgcaccgccgcgggaauuaugaagaaucccacaguggauggcaucaccguuaucgaccucgaaccuauuagcuacgaucccaaauucgagaagcagcuugggcaagucaugcugcuggcccucugcgcuggacagcugcuucugaugcggacaaccugggccuucugugaggugcucacgcuggcuacaggcccuauccugacccucugggaagggaaccccggaagauuuuggaacaccacaauugccgugucuaccgccaauaucuuccgcggcuccuaucuugcgggcgcugggcuggccuuuagccugauuaaaaacgcucagacaccucggagaggaacgggcaccacaggggagacccucggagaaaaguggaaacgccagcugaauucucuugaccggaaggaguucgaagaguacaagagauccggcauccuggaggucgaccgcacagaagccaaaagcgcccucaaggaugggucuaaaaucaagcaugcuguuagccggggauccucuaaaauuagauggaucguggagcgcggcauggugaagccgaagggcaaagucguggaccuggggugcggacggggcggguggagcuacuauauggccacccugaagaacguuacggaagugaaaggauacaccaagggcgggcccggacacgaggaaccuauucccauggcgacauauggcuggaaucucgucaaacuucauuccggcguggauguuuuuuacaagccuaccgagcaaguggacacacugcugugugauaucggggagagcuccucuaaccccaccauugaagagggaagaacacuccgcguccugaagaugguggaaccguggcuuagcuccaaaccugaguucugcaucaaggugcugaaucccuauaugcccaccgucauugaagagcucgagaaacugcagagaaagcacggcgggaaccugguucgguguccucucucucgcaauagcacgcacgaaauguacuggguguccggagccucuggcaacaucgugagcuccgucaauacaaccagcaaaaugcuucugaacagauuuaccacacggcauagaaagcccacguaugagaaagacguggaucugggggcuggaacccggucuguuuccacagaaaccgagaagccugacaugacaaucauuggccgcagacuccagcggcugcaggaggaacacaaggagaccuggcauuacgaucaagaaaauccguaccgcacaugggccuaucacggcagcuacgaggcucccucuaccggguccgccagcucuauggugaacggagucgugaaacuucugacgaagccuugggacguuauccccauggugacccagcucgcgaugacagauaccacaccuuucggccagcagagagucuuuaaagaaaagguggacacccggacgccccaaccgaaaccugggacacgcaugguuaugaccacaaccgccaauuggcugugggcucugcucggaaagaagaaaaaccccagacugugcacgcgggaggaguucauuuccaaggugcgcagcaaugccgcuaucggcgccgucuuucaggaagagcagggguggaccuccgcuagcgaagccgugaacgacucuagauucugggagcuugucgauaaagaacgggcgcugcaccaagagggcaagugugagagcugcguguauaacaugaugggaaaacgcgaaaagaagcucggcgaguuugggagagccaaaggaucccgggcuauuugguacauguggcugggcgcccgcuuccuugaauucgaggcucugggguuucucaaugaagaccauugguucggaagagagaacucuuggagcggcguugagggggaaggccugcaccggcugggauauauccucgaggaaaucgauaagaaagacggcgaucugauguacgccgacgauacagccgggugggacaccagaauuacagaggaugaccuucagaaugaggaacugaucaccgagcagauggcgccucaucacaagauucucgcuaaagccaucuuuaagcugacauaucagaacaagguggucaaagugcuucgccccaccccucggggagccgugauggauauuaucuccagaaaggaccaacgcggcucugggcagguuggaacguacggccugaauacauucaccaacauggaagugcagcucauccggcagauggaggcugaaggggucauuacccaagaugacaugcagaaucccaaaggccugaaggagagaguggagaaauggcugcgcgaaugcggaguugaccggcucaagagaauggccaucagcggcgaugacuguguggucaaaccgcuggaugagcgcuuugggacaucccuucuguuccucaacgacaugggaaaggugcggaaggauauuccucagugggaacccucuaaaggcuggaagaauuggcaggagguccccuuuugcagccaucacuuccacaaaaucuuuaugaaggacgggagaucccuggugguuccuugucgcaaccaagaugaacuuauuggacgggcuagaaucagccagggcgccggguggucucugcgggagaccgcgugccucggcaaagccuacgcucagauguggucccugauguauuuccauagacgcgaccugcggcucgccagcauggcuaucuguucugccgugccgacagagugguuucccacguccagaaccacauggagcauucacgcgcaucaccaguggaugaccacagaagauaugcugaaggucuggaaucgcguguggaucgaggacaacccuaauaugauugauaagacccccguucacuccugggaagacaucccuuaccuuggaaaaagagaggaccuguggugcggcucucucauugggcugagcucccgggccacgugggcuaagaacauccauaccgccauuacacaagugcgcaaucuuaucggaaaagaagaguaugucgauuacaugcccgugaugaagagauauagcgcuccuucugaguccgaaggcgugcuguga

SEQ ID NO: 20994 - RNA, 9867 nt, Artificial Sequence
  derived and/or modified CDS sequence (opt5) from DENV-4__EU854301__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaccaucacaccuagaucccccagcguggaggucaagcuuccugauuacggagaacugacccucgacugcgagccccggucuggcaucgacuucaacgagaugauucugaugaagaugaaaaagaaaacauggcuggugcauaagcagugguuucucgaucugccgcuuccuuggaccacgggggccgacaccuccgaaguucacuggaauuacaaagagagaauggugacauucaaggucccccaugcuaaacgccaggaugugaccguucugggcagccaggaaggagccaugcacuccgcccucgcuggcgcgacagagguggacucuggggauggaaaccacauguuugccggccaucugaaguguaagguccggauggaaaaacuuagaaucaaggggaugagcuauaccaugugcuccggaaaauucagcauugacaaggagauggcugagacgcaacacggcacaaccguggugaaaguuaaguacgaaggggccggcgccccuuguaagguccccaucgagauucgcgaugugaauaaagaaaagguggucggacgggugaucucugcuacaccccuggccgagaacaccaacuccguuaccaauaucgagcucgaaccuccguucggcgacagcuauauugugaucggggucggaaacucugcgcugacacugcauugguuuagaaaaggcagcuccauugggaagauguucgagucuacguaccgcggagcuaaacggauggccauccucggcgaaaccgccugggauuuugggagcgugggcggacuguucacaucccuuggcaaggcuguucaccagauuuuugggagcguguauaccacaauguucggaggcgucucuuggaugaucagaauccugauuggguuucucgugcuguggaucggaaccaauucccgcaacacgagcauggccaugacaugcauugcuguuggcgggaucacccuguuccuuggcuuuaccgugcaggccgacaugggaugugucgugucuugguccggccgggagcucaagugcgggagcggaauuuucguggucgauaauguucauacauggaccgaacaauacaaauuucagcccgaguccccugcgagacuggccucugcuauccugaacgcccacaaggacggcgugugugggauucgcagcacaacgcggcucgagaaugugauguggaaacagaucaccaacgaacugaauuauguccuuugggagggaggccacgaccugacagugguugcuggcgaugugaaggggguccucaccaaaggaaagagagcccugacacccccugcguccgaccugaaguacucuuggaaaaccuggggcaaggccaaaaucuucacgcccgaagcucggaacagcaccuuucuuauugaugggccggacacauccgagugcccuaaugaacgcagagccuggaacagcuucgagguggaggauuacggauucggcauguuuaccacaaauaucuggaugaaguuccgggaagggucuuccgagguuugugaccauagacucaugagcgcugccauuaaagaucagaaggccgugcacgcugacaugggauauuggaucgaaucuuccaaaaaccaaaccuggcagauugagcgcgcgagccugaucgaagucaagacaugccuguggcccaagacccauacgcucuggucuaauggcgugcuggagagccagaugcuuaucccuaaauccuacgccggccccuuuagccagcacaacuaucggcaaggguacgcuacacagaccguuggaccuuggcaccugggcaagcucgagauugauuucggggaaugccccggaaccacagugaccauccaggagaacugugaccauagaggcccgucucugcgcacgacaaccgccuccgggaaacuggucacacaguggugcuguagaagcugcaccaugccuccccuucgguuucucggagaagauggcuguugguauggcauggagauucgcccccuguccgagaaggaagagaauauggugaaaucucaagugacagccgggcagggaaccagcgaaacguucuccaugggccugcucugccugacccuuuuugucgaggaaugucugagacggcgcguuacaagaaagcacaugauccucgcuguggugauuacccugugcgccaucauccuggggggacuuacauggauggaccuccugcgggcgcugauuaugcucggcgauaccaugucugggcgcaucggaggccagacgcaucuggcuauuauggccgucuucaagaugagcccuggcuacgugcuugggguuuuucugagaaaacucacaucccgggagaccgcccugauggugaucggaauggcuaugacaaccacccugucuauuccgcacgaccuuauggagcugaucgacggcaucagccucgggcugauucuccugaagaucgucacacaguucgauaacacgcaagugggaacccuugcccugucccucacauuuauucgcagcaccaugucucugguuauggcguggagaacaaucauggcugugcuguucgucgugacccuuauuccccugugucggacguccugccuccagaaacagagccauugggucgaaaucacagcccugauucucggcgcccaagcucugccuguguaucuuaugacccugaugaagggggccucuagacgcuccuggccccucaaugagggaaucauggcuguuggccuggugagccugcuuggcucugcccugcucaaaaacgacgucccucuggcggggcccaugguggccggaggccuccugcuugcugccuacguuauguccgggagcuccgcugaucugagccuggaaaaggccgccaaugugcagugggacgagauggcugauaucaccggaucuagcccuauuaucgaagucaagcaggacgaggauggcuccuuuucuauucgggacguggaggaaacaaacaugaucacccuccuggugaaacuugcgcugauuacaguuagcgggcucuacccccuggccaucccgaucacgaugacccucugguauauguggcaggucaagacacaaagauccggagcucugugggaugugccuucucccgccgccacccagaaagcugcccuuagcgagggcguguaccgcauuaugcagcggggccuguucgggaagacacaggucggagugggcauccacauggaagggguuuuccacaccauguggcaugugacgagaggauccgucauuugucacgagaccggccgccuggaaccuucuugggcggacgugcggaaugauaugaucagcuaugggggaggcuggagacucggcgacaaaugggauaaggaggaggacguucaagugcuggcuauugaacccgggaagaacccgaaacauguccagacaaagccuggacuuuuuaaaacccugacaggcgagaucggggccgugacccucgacuucaagcccggaacauccggcagcccuaucauuaaucgcaaagggaagguuaucggccuguacggaaacggcguggucacgaaaucuggggauuauguguccgccauuacccaggcugaacggaucggagagcccgacuacgagguggaugaagacauuuuuagaaagaagcggcucacaaucauggaucugcaccccggcgccgggaaaaccaagcgcauucuuccuagcaucgucagagaggcgcugaaacggcgccugagaacccucauccuggcuccgacacggguuguggccgccgaaauggaggaagcucuuagaggacugcccauucgcuaucagacgccugccgugaagucugagcauaccggccgggagaucgucgaccucaugugccacgcuacauucaccacaagacugcucuccagcacccgcgugcccaauuacaaccugauuguuauggaugaagcccacuuuacggacccuuccucuguggcggcccggggguacaucagcacaagagucgagaugggcgaagcugccgcuauuuucaugaccgccacccccccuggagccacagauccguuuccccaauccaauagcccuaucgaggacaucgaacgcgagauucccgagcggucuuggaacaccggcuucgauuggaucacagacuaucaggggaaaaccgugugguuuguuccuuccauuaaggcuggaaaugacaucgcgaacugccuuagaaagagcggcaaaaaggugauucagcugucucgcaaaacguucgauacagaauaccccaagaccaaacugacagacugggauuuugucgugaccacggacaucagcgagaugggggccaacuucagagcuggacgggucaucgauccgcgcagaugucucaagccugugauucugaccgacggccccgaacggguuauccuugccgggcccauuccugugacacccgccuccgcugcccaacgcagaggccggaucggaagaaauccugcgcaggaggaugaccaguauguguucucuggcgauccgcugaagaacgacgaagaucaugcucacuggaccgaggccaaaaugcuccuggacaauauuuacacacccgaggggaucauuccuacccuguuuggacccgaacgcgagaagacacaggccaucgauggcgaauuccggcucagaggggagcaacgcaaaaccuuugucgagcuuaugcggagaggagaccugccuguuuggcugagcuauaagguggcuuccgccggcaucucuuacaaagaccgggaauggugcuucacgggcgagcgcaacaaucagauucucgaagagaacauggaaguggagaucuggacaagagagggggaaaagaagaaacugcggcccaaguggcuugaugcgcgcgucuaugccgacccgauggcucugaaagauuuuaaggaguucgccagcggaagaaaauccauuacccucgacauccugaccgaaauugcuagccugccuacauaccucucuucccgggccaagcuugcucuggauaauaucgugaugcugcauaccacagagcgcggcgggagagccuaccagcacgcgcucaacgaacugcccgagagccuugagacgcugaugcucguugcccugcugggagcuaugaccgccggcaucuuucucuucuuuaugcaggggaagggaaugggcaaacuuuccaugggccugauuacaaucgcuguggccucugggcugcucugggucgccgaaauucaaccucaguggaucgcugcgagcauuauccuggaguucuuucuuauggugcugcucauccccgaaccugagaagcagcggaccccccaggacaaucaacugauuuaugucauccugacaauucucaccaucauuggacuuaucgccgcuaacgaaaugggccugauugagaaaacgaagaccgauuucggguuuuaccaggugaaaacagagaccacaauccuggacguugaucuccgcccggccuccgccuggacccuguaugcuguggccacgacaauccuuaccccuaugcugagacacacaauugaaaauaccucugcgaaccucagccuggccgcuaucgccaaucaggcugccguccugaugggacucggcaagggguggccccuucaucggauggaccugggagugccccugcucgcgaugggcuguuacucccagguuaacccuaccacacugacggccagccuugugaugcugcucguccacuaugcuauuaucggcccggggcugcaagccaaagcuaccagagaggcccagaagcgcacagcugccggaauuaugaagaaucccaccguggauggcaucacagugaucgaccuggaaccuauuucuuacgaucccaaauucgagaagcagcucgggcaaguuaugcuucugguccugugcgcgggacagcucuuccugaugcggaccacgugggccuuuugugaggugcuuacacuggcuaccggcccuauccucacccugugggaagggaaccccggaagauucuggaacacaaccauugccguguccacagcuaauaucuuucgcggcagcuaucuggccggcgccgggcucgcguucucucuuauuaaaaacgcucagacgccucggagaggaaccggcacaaccggggagacacugggagaaaaguggaaacgccagcugaauucccucgaccggaaggaguuugaagaguacaagagaagcggcauccuggaggucgaccgcaccgaagccaaaucugcucuuaaggaugggagcaaaaucaagcaugccguuucccggggaucuagcaaaauuagauggaucguggagcgcggcauggugaagccgaagggcaaagucguggaccuggggugcggacggggcgggugguccuacuauauggccacgcucaagaacguuaccgaagugaaaggauacacaaagggcgggcccggacacgaggaaccuauucccauggcuaccuauggcuggaaucuggucaaacugcauagcggcguggauguuuucuacaagccuacagagcaaguggacacccuccuuugugauaucggggaguccucuagcaaccccacaauugaagagggaagaacccugcgcguccugaagaugguggaaccguggcucuccucuaaaccugaguuuugcaucaaggugcugaaucccuauaugcccacggucauugaagagcuugagaaacugcagagaaagcacggcgggaaccucguucgguguccucugagccgcaauuccacacacgaaauguacugggugucuggagccagcggcaacaucguguccagcgucaauaccaccucuaaaaugcugcucaacagauucacaacgcggcauagaaagcccaccuaugagaaagacguggaucuuggggcgggaacacgguccguuagcaccgaaacagagaagccugacaugaccaucauuggccgcagacugcagcggcugcaggaggaacacaaggagacauggcauuacgaucaagaaaauccguaccgcaccugggccuaucacggcucuuacgaggcucccuccacggggagcgccucuuccauggugaacggagucgugaaacuccugaccaagccuugggacguuauccccauggugacacagcuugcuaugaccgauacaaccccuuuuggccagcagagagucuucaaagaaaagguggacacgcggacaccccaaccgaaaccugggacccgcaugguuaugacaaccacggccaauuggcugugggcgcuccugggaaagaagaaaaaccccagacugugcacccgggaggaguuuauuagcaaggugcgcuccaaugccgcuaucggcgccgucuuccaggaagagcagggguggacaagcgcuucugaagccgugaacgacagcagauuuugggagcucgucgauaaagaacgggcucugcaccaagagggcaagugugaguccugcguguauaacaugaugggaaaacgcgaaaagaagcuuggcgaguucgggagagccaaaggaucucgggcgauuugguacauguggcugggcgcccgcuuccucgaauuugaggcucugggguuccuuaaugaagaccauugguuuggaagagagaacagcugguccggcguugagggggaaggccugcaccggcucggauauauccuggaggaaaucgauaagaaagacggcgaucugauguacgccgacgauaccgcugggugggacacaagaauuaccgaggaugaccuccagaaugaggaacugaucacagagcagauggccccucaucacaagauucuugccaaagcgaucuucaagcugaccuaucagaacaagguggucaaagugcuccgccccacgccucggggagcugugauggauauuaucucuagaaaggaccaacgcggcagcgggcagguuggaacauacggccugaauaccuuuaccaacauggaagugcagcuuauccggcagauggaggccgaaggggucauuacacaagaugacaugcagaaucccaaaggccugaaggagagaguggagaaauggcuccgcgaaugcggaguugaccggcugaagagaauggccaucuccggcgaugacuguguggucaaaccgcuggaugagcgcuucgggaccucucuccuguuucuuaacgacaugggaaaggugcggaaggauauuccucagugggaacccagcaaaggcuggaagaauuggcaggagguccccuucugcucccaucacuuucacaaaaucuucaugaaggacgggagaagccuggugguuccuugucgcaaccaagaugaacucauuggacgggcuagaaucucucagggcgccggguggucccugcgggagacagcuugccuuggcaaagccuacgcgcagauguggagccugauguauuuucauagacgcgaccuccggcuggccucuauggcuaucuguuccgccgugccgacggagugguuccccaccagcagaacaaccugguccauucacgcucaucaccaguggaugacaaccgaagauaugcugaaggucuggaaucgcguguggaucgaggacaacccuaauaugauugauaagacgcccguucacucuugggaagacaucccuuaccucggaaaaagagaggaccuguggugcggcagccuuauugggcuguccagccgggccaccugggcgaagaacauccauacagccauuacccaagugcgcaaucucaucggaaaagaagaguaugucgauuacaugcccgcuaugaagagauauucugccccuuccgagagcgaaggcgugcuguga

SEQ ID NO: 20995 - RNA, 9867 nt, Artificial Sequence
  derived and/or modified CDS sequence (opt5) from DENV-4__FJ639736__SS-prME
agcaccaugacgcugcucugccugauccccacggccauggcuuuccaccuuuccaccagagacggagagccucugaugauuguggccaagcaugaacgggggagaccgcuccuguuuaaaaccaccgagggaaucaacaaguguacccuuauugcgauggaucugggcgaaaugugcgaggacaccgucacauacaaauguccccuccugguuaauaccgaaccugaggauaucgacugcugguguaaccugacgucuaccugggugauguaugggacaugcacccagagcggagagagacggcgcgaaaagagauccguggcucucacaccccacucuggcauggggcuggagacccgggccgaaacguggaugagcuccgagggagccuggaaacaugcucagcgcgucgagucuuggauucuuagaaauccuggcuucgcccugcucgcuggcuuuauggccuacaugaucgggcagacaggaauccagcggaccguguucuuuguucugaugaugcuuguggcgcccagcuauggcaugcgcugugucggggugggaaacagagauuucguugaaggcguguccgggggagccugggucgaccuggugcucgagcacggcggcugcgugacaaccauggcucaggggaagccuacccuggauuuugaacugacaaagacgaccgccaaagaggucgcucuccugcggacauacuguauugaagcccuuaucagcaauauuaccacagcgacccgcugcccgacgcaaggagagcccuaucugaaggaggaacaggaccagcaguacaucuguagacgggauguuguggaccgcggcugggggaacggaugcggccucuucgggaaaggaggcguggucacaugcgccaaguuuucuuguuccggcaaaauuaccgggaaucuggugcaaaucgagaaccuugaauauaccguuguggucacagugcauaauggagauacccacgcuguuggcaacgacacaagcaaucacggggugacggccaccauuacaccuagaucucccuccgucgaggugaagcugccugauuacggagaacucacccuggacugcgagccccggagcggcaucgacuucaacgagaugauccugaugaagaugaaaaagaaaacauggcucguccauaagcagugguuucuggaucuuccgcugccuuggaccgcuggggccgacacgucugaagugcacuggaauuacaaagagagaaugguuaccuucaaggugccccaugccaaacgccaggaugucacagugcucggcucccaggaaggagcuaugcacagcgcgcuggccggcgcuaccgagguugacuccggggauggaaaccacauguuugccggccaucuuaaguguaaggugcggauggaaaaacugagaauuaaggggaugucuuauacaaugugcagcggaaaauucuccaucgacaaggagauggccgagacccaacacggcacgacagucgugaaagugaaguacgaaggggcuggcgccccuuguaagguucccauugagauccgcgaugucaauaaagaaaagguggugggacgggucauuagcucuacaccccucgcggagaacacaaacuccgugaccaauaucgagcuggaaccuccguucggcgacagcuauaucguuauuggggugggaaacucugcucugacccuccauugguuuagaaaaggcagcuccaucgggaagauguucgagucuacauaccgcggagccaaacggauggccauucugggcgaaacggcuugggauuuugggagcgucggcggacuuuucaccucccugggcaaggccgugcaccagguuuuugggagcguguauacaaccauguucggaggcgucucuuggaugauccgcauucucaucggguuucuggugcuguggaucggaacaaauucccgcaacaccagcauggcuaugacgugcauugccguuggcgggaucacacuuuuccucggcuuuaccgugcaggcggacaugggaugugucgugucuugguccggccgggagcugaagugcgggagcggaauuuucguggucgauaauguucauaccuggacagaacaauacaaauuucagcccgaguccccugccagacuggcuucugccauccucaacgcucacaaggacggcgugugugggauucgcagcaccacacggcuggagaaugugauguggaaacagaucacgaacgaacuuaauuauguccugugggagggaggccacgaccucaccgugguugccggcgaugugaaggggguccugacaaaaggaaagagagcgcugacacccccuguguccgaccuuaaguacucuuggaaaacauggggcaaggccaaaauuuucacccccgaagcucggaacagcacguuucucaucgaugggccggacaccuccgagugcccuaaugaacgcagagccuggaacagccuggagguugaggauuacggauucggcauguucacaaccaauaucuggaugaaguuucgggaagggucuuccgaggugugugaccauagacugaugagcgcugccauuaaagaucagaaggccguccacgcugacaugggauauuggaucgaaucuuccaaaaaccaaacauggcagauugagcgcgcgagccucaucgaagugaagaccugccuguggcccaagacacauacccuuuggucuaauggcguucuggagagccagaugcucauuccuaaauccuacgccggccccuucagccagcacaacuaucggcaaggguacgcuacgcagacagugggaccuuggcaccugggcaagcuggagaucgauuuuggggaaugccccggaaccaccgucacaauccaggaggacugugaucauagaggcccgucucuucgcaccacgacagccuccgggaaacucgugacccaguggugcuguagaagcugcacaaugccuccccugcgguuccugggagaagacggcuguugguauggcauggagauucgcccccucuccgagaaggaagagaacauggugaaaucucaagucaccgccgggcagggaacaagcgaaaccuuuuccaugggccugcuuugccugacacucuucguugaggaaugucugagacggcgcgugaccagaaagcacaugauccuggcuguggucauuacacuuugcgccaucauucucgggggacugaccuggauggaucugcuccgggcgcugaucaugcuuggcgacacaaugucugggcgcaucggaggccagacccaucuggcuauuauggccguguuuaagaugagcccuggcuacguucucgggguguuccugagaaaacugacgucccgggagacagcccuuauggucaucggaauggcuaugaccacaacccugucuauuccgcacgaccucauggagcugaucgauggcauuagccucgggcugauccuucugaagaucgugacccaguuugacaauacacaaguuggaacgcucgcccugucccugaccuucauucgcagcacaaugucucuugugauggcguggagaaccaucauggcuguccuguuuguggucacacucauuccccugugucggaccuccugccuccagaaacagagccauuggguggaaaucacggcccugauucuuggcgcccaagcucugccuguuuaucucaugacacugaugaagggggccucuagacgcuccuggccccugaacgagggaaucauggcugugggccuugucagccugcucggcucugcccugcucaaaaaugaugugccucuggcggggcccaugguugccggaggccuucugcuggcugccuacgugauguccgggagcuccgcugaccucagccuggaaaaggccgccaacguccagugggaugagauggcugacauuaccggaucuagcccuaucaucgaagugaagcaggaugaggacggcuccuucucuauucgggauguggaggaaaccaauaugaucacacuucugguuaaacucgcgcugauuaccgucagcgggcucuacccccuggccaucccggugacaaugacgcuuugguauauguggcaagugaagacccaaagauccggagcucugugggacgucccuucucccgccgccacacagaaagcugcccugagcgagggcguguaccgcauuaugcagcggggccucuuugggaagacccagguuggagugggcauccacauggaaggggucuuccacacaauguggcaugugaccagaggauccguuaucugucacgagacgggccgccuggaaccuucuugggcggaugugcggaacgacaugauuagcuaugggggaggcuggagacuuggcgauaaaugggacaaggaggaggacguccaagugcuggcuaucgaacccgggaagaauccgaaacauguucagaccaagccuggacucuucaaaacacugaccggcgagauuggggccgugacacucgauuuuaagcccggaaccuccggcagcccuaucauuaaccgcaaagggaaggucaucggccuguacggaaauggcguggugacaaaaucuggggacuaugucuccgccaucacgcaggcugaacggauuggagagcccgauuacgagguugacgaagauaucuucagaaagaagcggcuuaccauuauggaccugcaccccggcgccgggaaaacaaagcgcauccugccuagcauugugagagaggcgcucaaacggcgccugagaacccuuauccuggcuccgacccggguggucgccgccgaaauggaggaagcucucagaggacugcccauucgcuaucagaccccugccgugaagucugagcauacgggccgggagaucguugaucucaugugccacgcuaccuuuacaaccagacugcuuuccagcacacgcgugcccaacuacaaucugaucgucauggacgaagcccacuucaccgauccuuccucuguggcggcccggggguacauuagcacgagaguugagaugggcgaagcugccgcuaucuuuaugacagccacacccccuggagccaccgacccguucccccaauccaacagcccuauugaggauaucgaacgcgagauucccgagcggucuuggaauacaggcuuugacuggaucaccgacuaucaggggaaaacagugugguucgucccuuccaucaaggcuggaaacgauauugcgaauugccugagaaagagcggcaaaaaggugauccagcucucucgcaaaaccuuugacacggaauaccccaagacaaaacugaccgauugggacuucgucgugacaaccgauauuagcgagaugggggccaacuuuagagcuggacggguuaucgacccgcgcagaugucuuaagccugugauucugacggauggccccgaacgggugauccucgccgggcccaucccugucacccccgccuccgcugcccaacgcagaggccggauuggaagaaacccugcgcaggaggacgaucaguauguuuucucuggcgacccgcugaagaaugaugaagaccaugcucacuggacagaggccaaaaugcugcucgauaacaucuacacccccgaggggauuaucccuacacuuuucggacccgaacgcgagaagacccaggccauugacggcgaauuucggcugagaggggagcaacgcaaaacauucguggagcugaugcggagaggagaccucccuguguggcugagcuauaaggucgcuuccgccggcaucucuuacaaagaucgggaauggugcuuuaccggcgagcgcaauaaccagauucuugaagagaauauggaaguggagaucuggacgagagagggggaaaagaagaaacugcggccccgcuggcucgacgcgagaguuuaugccgauccgauggcucugaaggacuucaaagaguuugccagcggacggaaguccaucacacuggauauucucaccgaaaucgcuagccuuccuaccuaccugucuucccgcgccaaacuggcucucgacaacauugugaugcugcauacaaccgagagaggcgggcgggccuaccagcacgcgcuuaaugaacugcccgagagccucgagacacugaugcuggucgcccuccuuggagcuaugacggccggcaucuuccuguuuuucaugcaggggaagggaauuggcaagcuguccaugggccucaucaccaucgcuguggccucugggcugcuuugggucgccgaaauucaaccucaguggaucgcugcgagcauuauccuggaguuuuuccucauggugcugcugauucccgaaccugagaaacagcgcacaccccaggauaaccaacucaucuauguuauccuuaccauucugacaaucauuggacugaucgccgcuaaugaaaugggccucauugagaagaccaaaacggacuuuggguucuaccaggugaagaccgagacaaccauccuggaugucgaccuuagaccggccuccgccuggacacuguaugcuguggccaccacgauucucacaccuaugcugcggcacaccaucgaaaacacaucugcgaaucugagccucgccgcuaucgccaaccaggcugccguucuuaugggacugggcaaaggguggccccugcauagaauggaucucggagugccccugcuugcgaugggcuguuacucccaggucaauccuaccacccugacagccagccucgugaugcugcuggugcacuaugcuauuaucggcccggggcuccaagccaaggcuacgcgcgaggcccagaaacggaccgcugccggaauuaugaagaaccccacaguugacggcaucaccgucauugaucuugaaccuaucucuuacgaccccaaguuugagaaacagcuggggcaagugaugcugcucgugcugugcgcgggacagcuucugcucaugagaacaaccugggccuucugugagguccugacgcuggcuacaggcccuauccucacccuuugggaagggaaucccggacgcuucuggaacaccacaauugccguuuccaccgcuaacaucuuucggggcagcuaucuggccggcgccgggcuggcguucucucucauuaagaaugcucagacaccuagacgcggaacgggcaccacaggggagacccugggagaaaaauggaagcggcagcuuaacucccuggacagaaaagaguuugaagaguacaagcgcagcggcauccucgagguggaucggacagaagccaagucugcucugaaagacgggagcaagauuaaacaugccguguccagaggaucuagcaagauccgcuggaucgucgagcggggcauggugaaaccgaagggcaagguuguggaucuggggugcggaagaggcgggugguccuacuauauggccacccucaaaaaugucacggaagugaagggauacaccaaaggcgggcccggacacgaggaaccuauucccauggcuacauauggcuggaaccuuguuaagcugcauagcggcguggacgucuucuacaaaccuaccgagcaaguggauacacugcucugugacaucggggaguccucuagcaaucccaccauugaagagggacgcacacugagagugcuuaagauggucgaaccguggcuguccucuaagccugaguuuugcaucaaaguucucaaccccuauaugcccaccgugauugaagaacuggagaagcugcagcggaaacacggcgggaaucucgugcgcuguccucuuagcagaaacuccacgcacgaaauguacugggucucuggagccagcggcaauaucguguccagcguuaacacaaccucuaagaugcugcugaaucgguucaccacaagacaucggaaacccacguaugagaaggauguggaccucggggcgggaacccgcuccgucagcacagaaaccgagaaaccugauaugacaauuaucggcagacggcugcagcgccuucaggaggaacacaaggagaccuggcauuacgaccaagaaaacccguacagaacaugggccuaucacggcucuuacgaggcucccuccaccgggagcgccucuuccauggugaauggaguugugaagcugcucacgaaaccuugggaugucauccccauggugacccagcuggcuaugacagacaccacaccuuuuggccagcagcggguuuucaaggaaaaaguggacacccgcacgccccaaccgaagccugggacaagaauggucaugaccacaaccgccaacuggcugugggcgcuccugggcaaaaagaagaauccccggcuuugcacgcgcgaggaguuuauuagcaaagugagauccaacgccgcuaucggcgccgucuuccaggaagaacagggguggaccagcgcuucugaagccgugaaugauagccgguuuugggagcugguugacaaggaacgcgcucuccaccaagagggcaaaugugaguccugcguguauaacaugaugggaaagagagagaaaaagcugggcgaguucgggcgggccaagggaucucgcgcgauuugguacauguggcuuggcgccagauuucuggaguucgaggcucucggguuccugaacgaagaucauugguuuggacgggagaauagcugguccggcgucgagggggaaggccugcacagacucggauauauccuggaggaaauugacaaaaaggauggcgaccuuauguacgccgaugacacagcugggugggauacccgcaucacagaggacgaucugcagaacgaggaacucaucaccgagcagauggccccucaucacaaaauucuggccaaggcgaucuucaaacuuacauaucagaauaagguggugaagguucugcggcccaccccuagaggagcugugauggacauuaucucucgcaaagaucaacggggcagcgggcaggucggaacguacggccucaacacauuuaccaauauggaagugcagcugauuagacagauggaggccgaagggguuaucacccaagacgacaugcagaaccccaagggccugaaagagcgcguggagaaguggcuccgggaaugcggagucgauagacugaaacgcauggccaucuccggcgacgauuguguggucaagccgcuugacgagcgguucgggacaucucugcucuuucugaaugauaugggaaaagugagaaaggacauuccucagugggaacccagcaagggcuggaaaaacuggcaggagguucccuucugcucccaucacuuucacaagaucuucaugaaagaugggcgcagccuuguggucccuugucggaaucaagacgaacugauuggcagagcucggaucucucagggagccggguggucccucagagagaccgcuugccugggcaaggccuacgcgcagauguggagccugauguauuuucaucgccgggaucucagacuggccucuauggcuauuuguuccgccgugccgacagagugguuccccacgagccgcaccacaugguccauccacgcucaucaccaguggaugaccacagaagacaugcuuaaaguuuggaacagaguguggaucgaggauaauccuaacaugauugacaagacccccguccacucuugggaagacaucccuuaccugggaaagcgggaggaucucuggugcggcagccugauugggcuuuccagccgcgccacgugggcgaaaaauauccauaccgccauuacacaagugagaaaccugaucggaaaggaagaguauguggacuacaugcccguuaugaaacgguauucugcuccuuccgagagcgaaggcguccucuga

SEQ ID NO: 20996 - RNA, 9867 nt, Artificial Sequence
  derived and/or modified CDS sequence (opt5) from DENV-4__FJ639737__SS-prME
agcaccaucacccugcucugccugauucccacggugauggccuuccaccuuuccacccgggacggagagccucugaugaucgucgcuaagcaugaacgggggcgcccgcuccuguuuaaaaccaccgagggaauuaacaaguguacccuuaucgccauggaucugggcgaaaugugcgaggacaccguuacguacaaauguccccuccugauuaauaccgaaccugaggauaucgacugcugguguaaccugacgucuaccugggugauguaugggacaugcacccagagcggagagagacggcgcgaaaagagauccguggcgcucacaccccacucuggcauggggcuggagacccgggcugaaacguggaugagcuccgagggagccuggaaacaugcccaacgcgucgagucuuggauccuuagaaauccuggcuucgcucugcucgccggcuuuauggcuuacaugauugggcagacaggaauccagcggaccguguucuuuguucugaugaugcuuguggcccccagcuauggcaugcgcugugucggggugggaaacagagauuucguugaaggcguguccgggggagcgugggucgaccuggugcucgagcacggcggcugcgugacaaccauggcccaggggaagccuacccuggauuuugaacugacaaagacgaccgcuaaagaggucgcccuccugcggacauacuguauugaagcucuuaucagcaauauuaccacagccacccgcugcccgacgcaaggagagcccuaucugaaggaggaacaggaccagcaguacaucuguagacgggauguuguggaccgcggcugggggaacggaugcggccucuucgggaaaggaggcguggucacaugcgcgaaguuuucuuguuccggcaaaauuaccgggaaucuggugcaaaucgagaaccuugaauauaccguuguggucacagugcauaauggagauacccacgccguuggcaacgacacaagcaaucacggggugacggcuaccaucacaccuagaucucccuccgucgaggugaagcugccugauuacggagaacucacccuggacugcgagccccggagcggcauugacuucaacgagaugauccugaugaagaugaaaaagaaaacauggcucguccauaagcagugguuucuggaucuuccgcugccuuggaccgccggggcugacacgucugaagugcacuggaauuacaaagagagaaugguuaccuucaaggugccccaugccaaacgccaggaugucacagugcucggcucccaggaaggagccaugcacagcgcucuggcgggcgccaccgagguugacuccggggauggaaaccacauguuugcuggccaucuuaaguguaaggugcggauggaaaaacugagaauuaaggggaugucuuauacaaugugcagcggaaaauucuccaucgacaaggagauggccgagacccaacacggcacgacagucgugaaagugaaguacgaaggggccggcgcuccuuguaagguucccauugagauccgcgaugucaauaaagaaaagguggugggacgggucaucagcucuacaccccucgccgagaacacaaacuccgugaccaauauugagcuggaaccuccguucggcgacagcuauaucguuauuggggugggaaacucugcgcugacccuccauugguuuagaaaaggcagcuccaucgggaagauguucgagucuacauaccgcggagcuaaacggauggccauucugggcgaaacggccugggauuuugggagcgucggcggacuuuucaccucccugggcaaggcugugcaccagguuuuugggagcguguauacaaccauguucggaggcgucucuuggaugaucagaauccucauuggguuucuggugcuguggaucggaacaaauucccgcaacaccagcauggccaugacgugcauugcuguuggcgggaucacacuuuuccucggcuuuaccgugcaggccgacaugggaugugucgugucuugguccggccgggagcugaagugcgggagcggaauuuucguggucgauaauguucauaccuggacagaacaauacaaauuucagcccgaguccccugcgagacuggccucugcuauccucaacgcccacaaggacggcgugugugggauucgcagcaccacacggcuggagaaugugauguggaaacagaucacgaacgaacuuaauuauguccugugggagggaggccacgaccucaccgugguugcuggcgaugugaaggggguccugacaaaaggaaagagagcccugacacccccuguguccgaccuuaaguacucuuggaaaacauggggcaaggcgaaaaucuucacccccgaagcccggaacagcacguuucucauugaugggccggacaccuccgagugcccuaaugaacgcagagcuuggaacagccuggagguugaggauuacggauucggcauguucacaaccaauaucuggaugaaguuucgggaagggucuuccgaggugugugaccauagacugaugagcgccgcuauuaaagaucagaaggccguccacgccgacaugggauauuggaucgaaucuuccaaaaaccaaacauggcagauugagcgcgcuagccucaucgaagugaagaccugccuguggcccaagacacauacccuuuggucuaauggcguucuggagagccagaugcucaucccuaaauccuacgcgggccccuucagccagcacaacuaucggcaaggguacgccacgcagacagugggaccuuggcaccugggcaagcuggagauugauuuuggggaaugccccggaaccaccgucacaauccaggaggacugugaucauagaggcccgucucuucgcaccacgacagcuuccgggaaacucgugacccaguggugcuguagaagcugcacaaugccuccccugcgguuccugggagaagacggcuguugguauggcauggagauucgcccccucuccgagaaggaagagaacauggugaaaucucaagucaccgccgggcagggaacaagcgaaaccuuuuccaugggccugcuuugccugacacucuucguugaggaaugucugagacggcgcgugaccagaaagcacaugauccuggccguggucauuacacuuugcgcuaucauccucgggggacugaccuggauggaucugcuccgggcccugauuaugcuuggcgacacaaugucugggcgcaucggaggccagacccaucuggcgauuauggcuguguuuaagaugagcccuggcuacguucucgggguguuccugagaaaacugacgucccgggagacagcccuuauggucaucggaauggccaugaccacaacccugucuauuccgcacgaccucauggagcugaucgauggcaucagccucgggcugauucuucugaagaucgugacccaguuugacgauacacaaguuggaacgcucgcucugucccugaccuucauucgcagcacaaugucucuugugauggccuggagaaccaucauggcgguccuguuuguggucacacucauuccccugugucggaccuccugccuccagaaacagagccauuggguggaaaucacggcucugauucuuggcgcccaagcccugccuguuuaucucaugacacugaugaagggggcuucuagacgcuccuggccccugaaugagggaaucauggccgugggccuugucagccugcucggcucugcucugcucaaaaacgacgugccucuggccgggcccaugguugcgggaggccuucugcuggccgcuuacgugauguccgggagcuccgccgaucucagccuggaaaaggcugccucuguccagugggacgagauggccgauaucaccggaagcuccccuauuaucgaagugaagcaggacgaggauggcucuuucagcauucgggacguggaggaaaccaauaugaucacacuucugguuaaacucgcucugauuaccgucuccgggcucuacccccuggcgaucccggugacaaugacgcuuugguauauguggcaagugaagacccaaagaucuggagcccugugggaugucccuagccccgcugccacacagaaagccgcucuguccgagggcguguaccgcaucaugcagcggggccucuuugggaagacccagguuggagugggcauucacaucgaaggggucuuccacacaauguggcaugugaccagaggaucuguuauuugucacgagacgggccgccuggaaccuagcugggccgacgugcggaacgauaugaucuccuaugggggaggcuggagacuuggcgacaaaugggacaaggaggaggauguccaagugcuggcgauugaacccgggaagaauccgaaacauguucagaccaagccuggacucuucaaaacacugaccggcgagaucggggcugugacacucgacuuuaagcccggaaccagcggcucuccuaucauuaaccgcaaagggaaggucaucggccuguacggaaauggcguggugacaaaauccggggauuaugucagcgccauuacgcaggccgaacggaucggagagcccgacuacgagguugaugaagacauuuucagaaagaagcggcuuaccaucauggaucugcaccccggcgcugggaaaacaaagcgcauucugccuucuaucgugagagaggcccucaaacggcgccugagaacccuuauccuggcgccgacccggguggucgcugccgaaauggaggaagcccucagaggacugcccauucgcuaucagaccccugcugugaaguccgagcauacgggccgggagaucguugaccucaugugccacgccaccuuuacaaccagacugcuuagcuccacacgcgugcccaacuacaaucugauugucauggaugaagcucacuucaccgacccuucuagcguggccgcgcggggguacaucuccacgagaguugagaugggcgaagccgcugccauuuuuaugacagcuacacccccuggagccaccgauccguucccccaaagcaacucuccuaucgaggacaucgaacgcgagauucccgagcgguccuggaauacaggcuuugacuggaucaccgauuaucaggggaaaacagugugguucgucccuagcauuaaggccggaaacgacaucgcuaauugccugagaaagucuggcaaaaaggugauucagcucagccgcaaaaccuuugauacggaauaccccaagacaaaacugaccgacugggauuucgucgugacaaccgacaucuccgagaugggggcgaacuuuagagccggacggguuaucgauccgcgcagaugucuuaagccugugauucugacggacggccccgaacgggugauccucgcugggcccauuccugucacccccgccucugccgcucaacgcagaggccggaucggaagaaauccugcccaggaggaugaccaguauguuuucagcggcgauccgcugaagaacgacgaagaucaugcgcacuggacagaggcuaaaaugcugcucgacaacauuuacacccccgaggggaucauuccuacacuuuucggacccgaacgcgagaagacccaggccaucgacggcgaauuucggcugagaggggagcaacgcaaaacauucguggagcugaugcggagaggagaucucccuguguggcuguccuauaaggucgccucugcuggcaucagcuacaaagaccgggaauggugcuuuaccggcgagcgcaauaaccagauucuugaagagaauauggaaguggagaucuggacgagagagggggaaaagaagaaacugcggccccgcuggcucgaugccagaguuuaugcggacccgauggcccugaaggauuucaaagaguuugcuuccggaagaaagagcauuacacuggacauccucaccgaaauugccucucuuccuaccuaccuguccagccgcgcuaaacuggcccucgauaacaucgugaugcugcauacaaccgagagaggcgggcgggcuuaccagcacgcccuuaaugaacugcccgagucccucgagacacugaugcuggucgcgcuccuuggagccaugacggcuggcaucuuccuguuuuucaugcaggggaagggaauuggcaagcugucuaugggccucaucaccauugccguggcuagcgggcugcuuugggucgccgaaauccaaccucaguggauugccgcuuccaucauccuggaguuuuuccucauggugcugcugauucccgaaccugagaaacagcgcacaccccaggacaaccaacucaucuauguuauucuuaccauccugacaauuaucggacugauugcggccaaugaaaugggccucaucgagaagaccaaaacggauuuuggguucuaccaggugaagaccgagacaaccauccuggacgucgaucuuagaccggcuucugccuggacacuguaugccguggcuaccacgauucucacaccuaugcugcggcacaccaucgaaaacacaagcgccaaucugucccucgcggccauugcuaaccaggccgcuguucuuaugggacugggcaaaggguggccccugcauagaauggaccucggagugccccugcuugccaugggcuguuacagccaggucaauccuaccacccugacagcgucucucgugaugcugcuggugcacuaugccaucauuggcccggggcuccaagcuaaggccacgcgcgaggcucagaaacggaccgccgcuggaaucaugaagaaccccacaguugauggcaucaccgucauugaccuugaaccuaucuccuacgaccccaaguuugagaaacagcuggggcaagugaugcugcucgugcugugcgccggacagcuucugcucaugagaacaaccugggcguucugugagguccugacgcuggccacaggcccuauucucacccuuugggaagggaaucccggacgcuucuggaacaccacaaucgcuguuagcaccgccaauauuuuucggggcucuuaucuggcuggcgccgggcuggccuucucccucaucaagaacgcgcagacaccuagacgcggaacgggcaccacaggggagacccugggagaaaaauggaagcggcagcuuaacagccuggauagaaaagaguuugaagaguacaagcgcucuggcauccucgagguggaccggacagaagcuaagagcgcccugaaagauggguccaagauuaaacaugcugugucuagaggaagcuccaagauccgcuggauugucgagcggggcauggugaaaccgaagggcaagguuguggaccuggggugcggaagaggcggguggagcuacuauauggccacccucaaaaaugucacggaagugaagggauacaccaaaggcgggcccggacacgaggaaccuauccccauggccacauauggcuggaaccuuguuaagcugcauuccggcguggaugucuucuacaaaccuauugagcaaguggacacccugcucugugauaucggggagucuagcuccaaucccacaauugaagagggacgcacccugagagugcuuaagauggucgaaccguggcugucuagcaagccugaguuuugcaucaaaguucucaaccccuauaugcccacagugaucgaagaacuggagaagcugcagcggaaacacggcgggaaucucgugcgcuguccucuuuccagaaacucuacccacgaaauguacugggucagcggagcuuccggcaauauugugagcucuguuaacacgacauccaagaugcugcugaaucgguucaccaccagacaucggaaacccacauaugagaaggacguggaucucggggccggaacgcgcagcgucucuaccgaaacagagaaaccugacaugaccaucauuggcagacggcugcagcgccuucaggaggaacacaaggagacauggcauuacgaucaagaaaacccguacagaaccugggcguaucacggcuccuacgaggcccccagcacagggucugcuuccagcauggugaauggaguugugaagcugcucaccaaaccuugggacgucauccccauggugacgcagcuggccaugaccgacacaaccccuuuuggccagcagcggguuuucaaggaaaaaguggauacacgcacaccccagccgaagccugggacgagaauggucaugacaaccacagcuaacuggcugugggcccuccugggcaaaaagaagaauccccggcuuugcacccgcgaggaguuuauuuccaaagugagaagcaacgcggccaucggcgcugucuuccaggaagaacagggguggacgucugccagcgaagcugugaaugacucccgguuuugggagcugguugauaaggaacgcgcccuccaccaagagggcaaaugugagucuugcguguauaacaugaugggaaagagagagaaaaagcugggcgaguucgggcgggcuaagggaagccgcgccaucugguacauguggcuuggcgcgagauuucuggaguucgaggcccucggguuccugaaugaagaccauugguuuggacgggagaacuccuggucuggcgucgagggggaaggccugcacagacucggauauauucuggaggaaaucgauaaaaaggacggcgaucuuauguacgcugacgauaccgccgggugggacacacgcauuaccgaggaugaccugcagaacgaggaacucaucacagagcagauggcuccucaucacaaaauucuggccaaggccaucuucaaacuuaccuaucagaauaagguggugaagguucugcggcccacaccuagaggagcggugauggauaucauuagccgcaaagaccaacggggcuccgggcaggucggaaccuacggccucaacacguuuacaaauauggaagugcagcugaucagacagauggaggcugaagggguuauuacccaagacgauaugcagaaccccaagggccugaaagagcgcguggagaaguggcuccgggaaugcggagucgacagacugaaacgcauggccaucucuggcgaugacuguguggucaagccgcuugaugagcgguucgggaccagccugcucuuucugaaugacaugggaaaagugagaaaggauauuccucagugggaacccuccaagggcuggaaaaacuggcaggagguucccuucugcagccaucacuuucacaagaucuucaugaaagacgggcgcucucuuguggucccuugucggaaucaagaugaacugaucggcagagcccggauuucccagggagcuggguggagccucagagagacagccugccugggcaaggcuuacgcccagauguggucucugauguauuuucaucgccgggaccucagacuggcguccauggccaucuguagcgcugugccgaccgagugguuccccacaucccgcacgaccuggucuauucacgcccaucaccaguggaugacaaccgaagauaugcuuaaaguuuggaacagaguguggaucgaggacaauccuaacaugauugacaagacacccguccacagcugggaagauaucccuuaccugggaaagcgggaggaccucuggugcggcucccugauugggcuuagcucucgcgcuaccugggccaaaaauauccauacggcgaucacccaagugagaaaccugauuggaaaggaagaguauguggauuacaugcccguuaugaaacgguauuccgccccuagcgagucugaaggcguccucuga

SEQ ID NO: 20997 - RNA, 9867 nt, Artificial Sequence
  derived and/or modified CDS sequence (opt5) from DENV-4__FJ639738__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccgccggggcugacacgucugaaguucacuggaauuacaaagagagaauggugaccuucaaggucccccaugccaaacgccaggaugugacaguucucggcucccaggaaggagccaugcacagcgcucuggcgggcgccaccgagguggacuccggggauggaaaccacauguuugcuggccaucuuaaguguaagguccggauggaaaaacugagaaucaaggggaugucuuauacaaugugcagcggaaaauucuccauugacaaggagauggccgagacccaacacggcacgacaguggugaaaguuaaguacgaaggggccggcgcuccuuguaagguccccaucgagauucgcgaugugaauaaagaaaagguggucggacgggugaucagcucuaccccccucgccgagaacacaaacuccguuaccaauaucgagcuggaaccuccguucggcgacagcuauauugugaucggggucggaaacucugcgcugacccuccauugguuuagaaaaggcagcuccauugggaagauguucgagucuacauaccgcggagcuaaacggauggccauccugggcgaaacggccugggauuuugggagcgugggcggacuuuucaccucccugggcaaggcuguucaccagguguuugggagcgucuauacaaccauguucggaggcgugucuuggaugauuagaauccucaucggguuucugguucuguggauuggaacaaauucccgcaacaccagcauggccaugacgugcaucgcugugggcgggauuacacuuuuccucggcuuuaccguccaggccgacaugggauguguggugucuugguccggccgggagcugaagugcgggagcggaaucuucgucguugauaaugugcauaccuggacagaacaauacaaauuucagcccgaguccccugcgagacuggccucugcuauucucaacgcccacaaggacggcgugugugggauccgcagcaccacacggcuggagaaugucauguggaaacagauuacgaacgaacuuaauuaugugcugugggagggaggccacgaccucaccguuguggcuggcgaugucaagggggugcugacaaaaggaaagagagcccugacccccccuguuuccgaccuuaaguacucuuggaaaacauggggcaaggcgaaaaucuucacccccgaagcccggaacagcacguuucucaucgaugggccggacaccuccgagugcccuaaugaacgcagagcuuggaacagccuggagguggaggauuacggauucggcauguucacaaccaauauuuggaugaaguuucgggaagggucuuccgaggucugugaccauagacugaugagcgccgcuaucaaagaucagaaggccgugcacgccgacaugggauauuggauugaaucuuccaaaaaccaaacauggcagaucgagcgcgcuagccucauugaaguuaagaccugccuguggcccaagacacauacccuuuggucuaauggcgugcuggagagccagaugcucaucccuaaauccuacgcgggccccuucagccagcacaacuaucggcaaggguacgccacgcagacagucggaccuuggcaccugggcaagcuggagaucgauuuuggggaaugccccggaaccaccgugacaauucaggaggacugugaucauagaggcccgucucuucgcaccacgacagcuuccgggaaacucgugacccaguggugcuguagaagcugcacaaugccuccccugcgguuccugggagaagacggcuguugguauggcauggagauccgcccccucuccgagaaggaagagaacauggucaaaucucaaguuaccgccgggcagggaacaagcgaaaccuuuuccaugggccugcuuugccugacgcucuucguggaggaaugucugagacggcgcgugaccagaaagcacaugauucuggccgucgugaucacacuuugcgcuauuauccucgggggacugaccuggauggaucugcuccgggcccugaucaugcuuggcgacacaaugucugggcgcauuggaggccagacccaucuggcgaucauggcuguuuuuaagaugagcccuggcuacgugcucggggucuuccugagacggcugacgucccgcgagacagcccuuauggugauuggaauggccaugaccacaacccugucuaucccgcacgaccucauggagcugauugauggcaucagccucgggcugauccuucugaaaauuguuacccaguuugacaauacacaagugggaacgcucgcucugucccugaccuucaucagaagcacaaugucucuugucauggccuggcggaccauuauggcggugcuguuugucgugacacucaucccccuguguagaaccuccugccuccagaagcagagccauuggguugaaauuacggcucugauccuuggcgcccaagcccugccuguguaucucaugacacugaugaaaggggcuucucgccgguccuggccccugaacgagggaauuauggccgucggccuugugagccugcucggcucugcucugcucaagaaugauguuccucuggccgggcccaugguggcgggaggccuucugcuggccgcuuacgucauguccgggagcuccgccgaccucagccuggaaaaagcugccaacgugcagugggaugagauggccgacaucaccggaucuagcccuaucauugaagugaagcaggaugaggacggcuccuucucuaucagagauguugaggaaaccaauaugauuacacuucuggucaagcucgcucugaucaccgugagcgggcucuacccccuggcgauuccggugacaaugacgcuuugguauauguggcaggucaaaacccaacgcuccggagcccugugggacgugccuucucccgcugccacacagaaggccgcucugagcgagggcguuuaccggaucaugcagagaggccucuuugggaaaacccaggugggagucggcauccacauggaagggguguuccacacaauguggcauguuacccgcggauccgugauuugucacgagacgggccggcuggaaccuucuugggccgaugucagaaacgacaugaucagcuaugggggaggcuggcgccuuggcgauaagugggacaaagaggaggacgugcaaguucuggcgguggaacccgggaagaauccgaagcauguccagaccaaaccuggacucuucaagacaauuaccggcgagaucggggcugugacacuggauuuuaaacccggaaccuccggcagcccuauuaucaaccggaaggggaaagugaucggccucuacggaaauggcgucguuacaaagucuggggacuauguguccgccauuacgcaggccgaaagaaucggagagcccgauuacgagguggacgaagauauuuuccggaaaaagcgccugaccaucauggaccuucaccccggcgcugggaagacaaaaagaauucugccuagcaucguccgggaggcccugaagcgcagacuccggacccugauucuugcgccgaccagagugguugcugccgaaauggaggaagcccugcgcggacuccccauccgguaucagacaccugcugugaaaucugagcauacgggcagagagaucgucgaucugaugugccacgccaccuuuacaacccgccuccuguccagcacacgggugcccaacuacaaucuuauuguuauggacgaagcucacuucaccgauccuuccucuguggccgcgagaggguacaucagcacgcgcgucgagaugggcgaagccgcugccauuuuuaugacagcuacccccccuggagccaccgacccguucccccaauccaacagcccuaucgaggauauugaacgggagauccccgagagaucuuggaauacaggcuuugacuggaucaccgacuaucaggggaagacagugugguucgucccuuccauuaaagccggaaacgauaucgcuaauugccugcgcaagagcggcaagaaagugauucagcugucuagaaagaccuuugacacggaauaccccaaaacaaagcucaccgauugggacuucguugugacaaccgauaucagcgagaugggggcgaacuuucgggccggacgcgugauugacccgagacggugucugaaaccugucauccuuacggauggccccgaacgcguuauccuggcugggcccauuccugugacccccgccuccgccgcucaaagacggggcagaaucggacgcaacccugcccaggaggacgaucaguauguguucucuggcgacccgcucaagaaugaugaagaccaugcgcacuggacagaggcuaagaugcugcuggauaacauuuacacccccgaggggaucauuccuacacucuucggacccgaacgggagaaaacccaggccaucgacggcgaauuuagacuucgcggggagcaacggaagacauucgucgagcugaugagacggggagaccugccuguguggcucagcuauaaaguugccuccgcuggcauuucuuacaaggaucgcgaauggugcuuuaccggcgagagaaauaaccagauccuggaagagaauauggaaguggagaucuggacgcgggagggggaaaaaaagaagcuucgccccagauggcuggacgcccgggucuaugcggauccgauggcccucaaagacuucaaggaguuugcuagcggacgcaaauccauuacacuggauauccugaccgaaauugccagccucccuaccuaccuuucuuccagagcuaagcuggcccuggacaacaucgugaugcuccauacaaccgagcggggcgggcgcgcuuaccagcacgcccugaaugaacuucccgagagccuggagacacucaugcuggucgcgcugcucggagccaugacggcuggcauuuuccuuuuuuucaugcaggggaaaggaaucggcaagcuguccaugggccugaucaccauugccguggcuucugggcuccuguggguugccgaaauccaaccucaguggauugccgcuagcaucauucuugaguuuuuccugauggugcuccugauccccgaaccugagaagcagagaacaccccaggauaaccaacugaucuaugucauucucaccauccuuacaauuaucggacugauugcggccaaugaaaugggccugaucgagaaaaccaagacggacuuuggguucuaccaggugaaaaccgagacaaccauucucgauguugaccugcggccggcuuccgccuggacacuuuaugccguggcuaccacgauccugacaccuaugcucagacacaccaucgaaaacacaucugccaaucugagccuggcggccauugcuaaccaggccgcuguccucaugggacuuggcaagggguggccccugcaucgcauggaucugggagugccccuccuggccaugggcuguuacucccaggugaauccuaccacccuuacagcgagccugguuaugcuccugguccacuaugccaucauuggcccggggcugcaagcuaaagccacgcgggaggcucagaagagaaccgccgcuggaaucaugaaaaaccccacaguggacggcauuaccgugaucgaucucgaaccuaucucuuacgaccccaaguuugagaagcagcuugggcaagucaugcugcugguucucugcgccggacagcugcuucugaugcgcacaaccugggcguucugugaggugcucacgcuggccacaggcccuauucugacccucugggaagggaaucccggacgguucuggaacaccacaaucgcuguguccaccgccaacauuuuuagaggcagcuaucuugcuggcgccgggcuggccuucucucugaucaaaaaugcgcagacaccucgccggggaacgggcaccacaggggagacccucggagaaaaguggaaaagacagcugaacucccuugaccgcaaggaguuugaagaguacaaacggagcggcauucuggaggucgauagaacagaagcuaagucugcccucaaggacgggagcaaaaucaagcaugcugugucccgcggaucuagcaaaauccgguggauuguugagagaggcauggugaagccgaaaggcaaggucguggaucuggggugcggacgcggcgggugguccuacuauauggccacccugaagaauguuacggaagugaaaggauacaccaagggcgggcccggacacgaggaaccuauccccauggccacauauggcuggaaccucgucaaacuucauagcggcguggacguguucuacaagccuaccgagcaagucgauacacugcugugugacauuggggaguccucuagcaaucccaccaucgaagagggaagaacacuccggguucugaaaaugguggaaccguggcuuuccucuaagccugaguuuugcauuaaggugcugaaccccuauaugcccaccgucaucgaagagcucgagaaacugcagcgcaagcacggcgggaaucuggugagauguccucucagccggaacuccacgcacgaaauguacuggguuucuggagcuagcggcaauauuguguccagcgucaacacaaccucuaaaaugcuucugaauagauucaccacacggcaucgcaagcccacguaugagaaagauguggaccugggggccggaaccagauccguuagcacagaaaccgagaagccugauaugacaaucaucggccggcgccuccagagacugcaggaggaacacaaagagaccuggcauuacgaccaagaaaacccguaccggacaugggcguaucacggcucuuacgaggcccccuccaccgggagcgcuucuuccauggugaauggagucgugaagcuucugacgaagccuugggauguuauucccauggugacccagcucgccaugacagacaccacaccuuuuggccagcagcgcgucuucaaagaaaagguggacaccagaacgccccaaccgaaaccugggacacggauggucaugaccacaaccgcuaacuggcugugggcccugcucggaaagaaaaagaauccccgccugugcacgagagaggaguuuaucagcaaggugcgguccaacgcggccauuggcgcuguuuuccaggaagagcagggguggaccagcgccucugaagcugugaaugauagccgcuuuugggagcuugucgacaaagaaagagcccugcaccaagagggcaagugugaguccugcguguauaacaugaugggaaaacgggaaaagaaacucggcgaguucgggcgcgcuaagggaucuagagccaucugguacauguggcugggcgcgcgguuucuugaauucgaggcccugggguuccucaacgaagaucauugguuuggaagagagaauagcugguccggcguggagggggaaggccugcaccgccugggauauauucucgaggaaaucgacaagaaagauggcgaccugauguacgcugaugacacagccgggugggauacccggaucacagaggacgaucuucagaacgaggaacugauuaccgagcagauggcuccucaucacaagauccucgccaaagccauuuucaagcugacauaucagaauaaaguugugaagguccuuagacccaccccucgcggagcggugauggacaucauuucucggaaggaucaaagaggcagcgggcagguuggaacguacggccugaacacauuuaccaauauggaagugcagcucauccgccagauggaggcugaaggggucaucacccaagacgacaugcagaaccccaaaggccugaaggagcggguggagaaauggcugagagaaugcggagucgaucgccucaagcggauggccauuuccggcgacgauugugugguuaaaccgcuggacgagagauucgggacaucucuucuguuucucaaugauaugggaaaggugcgcaaagacaucccucagugggaacccagcaagggcuggaagaacuggcaggagguccccuucugcucccaucacuuucacaaaauuuucaugaaggaugggcggagccuggugguuccuuguagaaaucaagacgaacuuaucggacgggccagaauuucucagggcgcuggguggucccugcgcgagaccgccugccucggcaaagcuuacgcccagauguggagccugauguauuuucaucggagagaucugcgccucgcgucuauggccaucuguuccgcugugccgacagagugguuccccacgagcagaaccacaugguccauccacgcccaucaccaguggaugaccacagaagacaugcugaaggucuggaaccggguguggauugaggauaauccuaacaugaucgacaaaacccccgugcacucuugggaagacauuccuuaccuuggaaagcgcgaggaucuguggugcggcagccucaucgggcuguccagcagagcuacgugggccaagaauauucauaccgcgaucacacaaguucggaaccuuauuggaaaagaagaguaugucgacuacaugcccgugaugaagcgcuauucugccccuuccgagagcgaaggcgugcuguga

SEQ ID NO: 20998 - RNA, 9867 nt, Artificial Sequence
  derived and/or modified CDS sequence (opt5) from DENV-4__FJ639739__SS-prME
agcaccaugacccugcucugccugauccccacggccauggcuuuccaccuuuccaccagagacggagagccucugaugauuguggccaagcaugaacgggggagaccgcuccuguuuaaaaccaccgaggggaucaacaaguguacccuuauugcgauggaucugggcgaaaugugcgaggacaccgucaccuacaaauguccccuccugguuaauaccgaaccugaggauaucgacugcugguguaaccugacgucuaccugggugauguaugggacgugcacccagagcggagagagacggcgcgaaaagagauccguggcucucacaccccacucuggcauggggcuggagacccgggccgaaacguggaugagcuccgagggagccuggaaacaugcucaacgcgucgagucuuggauucuuagaaauccuggcuucgcccugcucgcuggcuuuauggccuacaugaucgggcagacaggaauccagcggaccguguucuuuguucugaugaugcuuguggcgcccagcuauggcaugcgcugugucggggugggaaacagagauuucguugaaggcguguccgggggagccugggucgaccuggugcucgagcacggcggcugcgugacaaccauggcucaggggaagccuacccuggauuuugaacugacaaagacgaccgccaaagaggucgcucuccugcggacauacuguauugaagcccuuaucagcaauauuaccacagcgacccgcugcccgacgcaaggagagcccuaucugaaggaggaacaggaccagcaguacaucuguagacgggauguuguggaccgcggcugggggaacggaugcggccucuucgggaaaggaggcguggucacaugcgccaaguuuucuuguuccggcaaaauuaccgggaaucuggugcaaaucgagaaccuugaauauaccguuguggucacagugcauaauggagauacccacgcuguuggcaacgacacaagcaaucacggggugacggccaccauuacaccuagaucucccuccgucgaggugaagcugccugauuacggagaacucacccuggacugcgagccccggagcggcaucgacuucaacgagaugauccugaugaagaugaaaaagaaaacauggcucguccauaagcagugguuucuggaucuuccgcugccuuggaccgcuggggccgacacgucugaagugcacuggaauuacaaagagagaaugguuaccuucaaggugccccaugccaaacgccaggaugucacagugcucggcucccaggaaggagcuaugcacagcgcgcuggccggcgcuaccgagguugacuccggggauggaaaccacauguuugccggccaucuuaaguguaaggugcggauggaaaaacugagaauuaaggggaugucuuauacaaugugcagcggaaaauucuccaucgacaaggagauggccgagacccaacacggcacgacagucgugaaagugaaguacgaaggggcuggcgccccuuguaagguucccauugagauccgcgaugucaauaaagaaaagguggugggacgggucauuagcucuacaccccucgcggagaacacaaacuccgugaccaauaucgagcuggaaccuccguucggcgacagcuauaucguuauuggggugggaaacucugcucugacccuccauugguuuagaaaaggcagcuccaucgggaagauguucgagucuacauaccgcggagccaaacggauggccauucugggcgaaacggcuugggauuuugggagcgucggcggacuuuucaccucccugggcaaggccgugcaccagguuuuugggagcguguauacaaccauguucggaggcgucucuuggaugauccgcauucucaucggguuucuggugcuguggaucggaacaaauucccgcaacaccagcauggcuaugacgugcauugccguuggcgggaucacacuuuuccucggcuuuaccgugcaggcggacaugggaugugucgugucuugguccggccgggagcugaagugcgggagcggaauuuucguggucgauaauguucauaccuggacagaacaauacaaauuucagcccgaguccccugccagacuggcuucugccauccucaacgcucacaaggacggcgugugugggauucgcagcaccacacggcuggagaaugugauguggaaacagaucacgaacgaacuuaauuauguccugugggagggaggccacgaccucaccgugguugccggcgaugugaaggggguccugacaaaaggaaagagagcgcugacacccccuguguccgaccuuaaguacucuuggaaaacauggggcaaggccaaaauuuucacccccgaagcucggaacagcacguuucucaucgaugggccggacaccuccgagugcccuaaugaacgcagagccuggaacagccuggagguugaggauuacggauucggcauguucacaaccaauaucuggaugaaguuucgggaagggucuuccgaggugugugaccauagacugaugagcgcugccauuaaagaucagaaggccguccacgcugacaugggauauuggaucgaaucuuccaaaaaccaaacauggcagauugagcgcgcgagccucaucgaagugaagaccugccuguggcccaagacacauacccuuuggucuaauggcguucuggagagccagaugcucauuccuaaauccuacgccggccccuucagccagcacaacuaucggcaaggguacgcuacgcagacagugggaccuuggcaccugggcaagcuggagaucgauuuuggggaaugccccggaaccaccgucacaauccaggaggacugugaucauagaggcccgucucuucgcaccacgacagccuccgggaaacucgugacccaguggugcuguagaagcugcacaaugccuccccugcgguuccugggagaagacggcuguugguauggcauggagauucgcccccucuccgagaaggaagagaacauggugaaaucucaagucaccgccgggcagggaacaagcgaaaccuuuuccaugggccugcuuugccugacacucuucguugaggaaugucugagacggcgcgugaccagaaagcacaugauccuggcuguggucauuacacuuugcgccaucauucucgggggacugaccuggauggaucugcuccgggcgcugaucaugcuuggcgacacaaugucugggcgcaucggaggccagacccaucuggcuauuauggccguguuuaagaugagcccuggcuacguucucgggguguuccugagaaaacugacgucccgggagacagcccuuauggucaucggaauggcuaugaccacaacccugucuauuccgcacgaccucauggagcugaucgauggcauuagccucgggcugauccuucugaagaucgugacccaguuugacaauacacaaguuggaacgcucgcccugucccugaccuucauucgcagcacaaugucucuugugauggcguggagaaccaucauggcuguccuguuuguggucacacucauuccccugugucggaccuccugccuccagaaacagagccauuggguggaaaucacggcccugauucuuggcgcccaagcucugccuguuuaucucaugacacugaugaagggggccucuagacgcuccuggccccugaacgagggaaucauggcugugggccuugucagccugcucggcucugcccugcucaaaaaugaugugccucuggcggggcccaugguugccggaggccuucugcuggcugccuacgugauguccgggagcuccgcugaccucagccuggaaaaggccgccaacguccagugggaugagauggcugacauuaccggaucuagcccuaucaucgaagugaagcaggaugaggacggcuccuucucuauucgggauguggaggaaaccaauaugaucacacuucugguuaaacucgcgcugauuaccgucagcgggcucuacccccuggccaucccggugacaaugacgcuuugguauauguggcaagugaagacccaaagauccggagcucugugggacgucccuucucccgccgccacacagaaagcugcccugagcgagggcguguaccgcauuaugcagcggggccucuuugggaagacccagguuggagugggcauccacauggaaggggucuuccacacaauguggcaugugaccagaggauccguuaucugucacgagacgggccgccuggaaccuucuugggcggaugugcggaacgacaugauuagcuaugggggaggcuggagacuuggcgauaaaugggacaaggaggaggacguccaagugcuggcuaucgaacccgggaagaauccgaaacauguucagaccaagccuggacucuucaaaacacuggccggcgagauuggggccgugacccucgauuuuaagcccggaacauccggcagcccuaucauuaaccgcaaagggaaggucaucggccuguacggaaauggcguggugaccaaaucuggggacuaugucuccgcuaucacacaggccgaacggauuggagagcccgauuacgagguugacgaagauaucuucagaaagaagcggcuuacgauuauggaccugcaccccggcgcggggaaaaccaagcgcauccugccuagcauugugagagaggcucucaaacggcgccugagaacacuuauccuggccccgacccggguggucgccgcugaaauggaggaagcccucagaggacugcccauucgcuaucagaccccugcugugaagucugagcauacaggccgggagaucguugaucucaugugccacgccacguuuaccacaagacugcuuuccagcacccgcgugcccaacuacaaucugaucgucauggacgaagcgcacuucacagauccuuccucuguggccgcucggggguacauuagcaccagaguugagaugggcgaagccgcugccaucuuuaugacggccacacccccuggagcuaccgacccguucccccaauccaacagcccuauugaggauaucgaacgcgagauucccgagcggucuuggaauaccggcuuugacuggaucacagacuaucaggggaaaaccgugugguucgucccuuccaucaaggcgggaaacgauauugccaauugccugagaaagagcggcaaaaaggugauccagcucucucgcaaaacauuugacaccgaauaccccaagacgaaacugacagauugggacuucgucgugaccacagauauuagcgagaugggggcuaacuuuagagccggacggguuaucgacccgcgcagaugucuuaagccugugauucugaccgauggccccgaacgggugauccucgccgggcccaucccugucacgcccgcuuccgccgcgcaacgcagaggccggauuggaagaaacccugcucaggaggacgaucaguauguuuucucuggcgacccgcugaagaaugaugaagaccaugcccacuggaccgaggccaaaaugcugcucgauaacaucuacacacccgaggggauuaucccuacccuuuucggacccgaacgcgagaagacacaggcuauugacggcgaauuucggcugagaggggagcaacgcaaaaccuucguggagcugaugcggagaggagaccucccuguguggcugagcuauaaggucgccuccgcgggcaucucuuacaaagaucgggaauggugcuuuacaggcgagcgcaauaaccagauucuugaagagaauauggaaguggagaucuggaccagagagggggaaaagaagaaacugcggccccgcuggcucgacgccagaguuuaugcugauccgauggcccugaaggacuucaaagaguuugcuagcggacggaaguccaucacgcuggauauucucacagaaaucgccagccuuccuaccuaccugucuucccgcgcuaaacuggcccucgacaacauugugaugcugcauaccacagagagaggcgggcgggcguaccagcacgcccuuaaugaacugcccgagagccucgagacccugaugcuggucgcucuccuuggagccaugacagcuggcaucuuccuguuuuucaugcaggggaagggaauuggcaagcuguccaugggccucaucacgaucgccguggccucugggcugcuuugggucgcugaaauucaaccucaguggaucgcggccagcauuauccuggaguuuuuccucauggugcugcugauucccgaaccugagaaacagcgcacaccccaggauaaccaacucaucuauguuauccuuacaauucugaccaucauuggacugaucgcugccaaugaaaugggccucauugagaagacaaaaaccgacuuuggguucuaccaggugaagacggagaccacaauccuggaugucgaccuuagaccggccuccgcuuggacccuguaugccguggcgacaaccauucucacgccuaugcugcggcacacaaucgaaaacaccucugccaaucugagccucgcugccaucgcuaaccaggccgcgguucuuaugggacugggcaaaggguggccccugcauagaauggaucucggagugccccugcuugccaugggcuguuacucccaggucaauccuacaacccugaccgcuagccucgugaugcugcuggugcacuaugccauuaucggcccggggcuccaagcuaaggccacacgcgaggcucagaaacggacggccgcgggaauuaugaagaaccccaccguugacggcaucacagucauugaucuugaaccuaucucuuacgaccccaaguuugagaaacagcuggggcaagugaugcugcucgugcugugcgccggacagcuucugcucaugagaaccacaugggcuuucugugagguccugacccuggccacgggcccuauccucacacuuugggaagggaaucccggacgcuucuggaacaccaccauugcuguuuccacagccaacaucuuucggggcagcuaucuggccggcgcggggcuggcuuucucucucauuaagaaugcccagaccccuagacgcggaacaggcacgaccggggagacacugggagaaaaauggaagcggcagcuuaacucccuggacagaaaagaguuugaagaguacaagcgcagcggcauccucgagguggaucggaccgaagcuaagucugcccugaaagacgggagcaagauuaaacaugccguguccagaggaucuagcaagauccgcuggaucgucgagcggggcauggugaaaccgaagggcaagauuguugaucuggggugcggaagaggcgggugguccuacuauauggcuacacucaaaaaugugaccgaagucaagggauacacgaaaggcgggcccggacacgaggaaccuauccccauggccaccuauggcuggaaccuugugaagcugcauagcggcguugacguguucuacaaaccuacagagcaagucgauacccugcucugugacauuggggaguccucuagcaaucccacaaucgaagagggacgcacccugagagugcuuaagaugguggaaccguggcuguccucuaagccugaguuuugcauuaaaguccucaaccccuauaugcccacaguuaucgaagaacuggagaagcugcagcggaaacacggcgggaaucucgugcgcuguccucuuagcagaaacuccacccacgaaauguacugggugucuggagcgagcggcaauauugucuccagcgugaacacgacaucuaagaugcugcugaaucgguucaccaccagacaucggaaacccacauaugagaaggauguugaccucggggccggaacgcgcuccgugagcaccgaaacagagaaaccugauaugaccaucaucggcagacggcugcagcgccuucaggaggaacacaaggagacauggcauuacgaccaagaaaacccguacagaaccugggcuuaucacggcucuuacgaggcccccuccacagggagcgcuucuuccauggucaauggagugguuaagcugcucaccaaaccuugggaugugauucccauggucacgcagcuggccaugaccgacacaaccccuuuuggccagcagcggguguucaaggaaaaaguugacacacgcacaccccagccgaagccugggacgagaauggugaugacaaccacagcgaacuggcugugggcccuccugggcaaaaagaagaauccccggcuuugcacccgcgaggaguuuaucagcaaagucagauccaacgcugccauuggcgcuguguuccaggaagaacagggguggacgagcgccucugaagcugucaaugauagccgguuuugggagcugguggacaaggaacgcgcccuccaccaagagggcaaaugugaguccugcguuuauaacaugaugggaaagagagagaaaaagcugggcgaguucgggcgggcgaagggaucucgcgccaucugguacauguggcuuggcgcuagauuucuggaguucgaggcccucggguuccugaacgaagaucauugguuuggacgggagaauagcugguccggcguggagggggaaggccugcacagacucggauauauucuggaggaaaucgacaaaaaggauggcgaccuuauguacgcugaugacaccgccgggugggauacacgcaucaccgaggacgaucugcagaacgaggaacucauuacagagcagauggccccucaucacaaaauccuggcgaaggcuauuuucaaacuuaccuaucagaauaaggucgugaaggugcugcggcccacaccuagaggagccguuauggacaucauuucucgcaaagaucaacggggcagcggacaggugggaaccuacggccucaacacguuuacaaauauggaaguccagcugaucagacagauggaggccgaaggggugaucacccaagacgacaugcagaaccccaagggccugaaagagcgcguugagaaguggcuccgggaaugcggaguggauagacugaaacgcauggcuauuuccggcgacgauugugucgugaagccgcuugacgagcgguucgggaccucucugcucuuucugaaugauaugggaaaagucagaaaggacaucccucagugggaacccagcaagggcuggaaaaacuggcaggaggugcccuucugcucccaucacuuucacaagauuuucaugaaagaugggcgcagccuuguugugccuugucggaaucaagacgaacugaucggcagagcccggauuucucagggagcuggguggucccucagagagacagccugccugggcaaggcguacgcccagauguggagccugauguauuuucaucgccgggaucucagacuggcuucuauggccaucuguuccgcugucccgaccgaguggcuucccacaagccgcacgaccugguccauccacgcccaucaccaguggaugacaaccgaagacaugcugaaaguguggaacagaguuuggauugaggauaauccuaacaugaucgacaagacacccgugcacucuugggaagacauuccuuaccucggaaagcgggaggaucuguggugcggcagccuuaucgggcuguccagccgcgcgaccugggccaaaaauauucauacggcuaucacccaagucagaaaccucauuggaaaggaagaguauguggacuacaugcccgugaugaaacgguauucugccccuuccgagagcgaaggcguucuguga

SEQ ID NO: 20999 - RNA, 9867 nt, Artificial Sequence
  derived and/or modified CDS sequence (opt5) from DENV-4__JN819409__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacggcgaccugggugauguaugggacaugcacccagucuggagagagacggcgcgaaaagagaagcgucgcucucacaccccacuccggcauggggcuggagacccgggccgaaacguggaugucuagcgagggagccuggaaacaugcucaacgcguggaguccuggauccuuagaaauccuggcuucgcccugcucgcuggcuuuauggccuacaugaucgggcagacaggaauucagcggaccguuuucuuugugcugaugaugcuugucgcgcccucuuauggcaugcgcuguguggggguuggaaacagagauuucguggaaggcgucagcgggggagccuggguggaccuggugcucgagcacggcggcugcgucacaaccauggcucaggggaagccuacccuggauuuugaacugacaaagacgaccgccaaagagguugcucuccugcggacauacuguaucgaagcccuuauuuccaauaucaccacagcgacccgcugcccgacgcaaggagagcccuaucugaaggaggaacaggaccagcaguacauuuguagacgggaugugguggaccgcggcugggggaacggaugcggccucuucgggaaaggaggcgucgugacaugcgccaaguuuagcuguucuggcaaaaucaccgggaaucugguucaaauugagaaccuugaauauaccguggucgugacaguucauaauggagauacccacgcugugggcaacgacacauccaaucacggggucacggccaccaucacaccuagaagccccucuguggaggucaagcugccugauuacggagaacucacccuggacugcgagccccgguccggcaucgacuucaacgagaugauucugaugaagaugaaaaagaaaacauggcucgugcauaagcagugguuucuggaucuuccgcugccuuggaccgcuggggccgacacgagcgaaguucacuggaauuacaaagagagaauggugaccuucaaggucccccaugccaaacgccaggaugugacaguucucggcucucaggaaggagcuaugcacuccgcgcuggccggcgcuaccgagguggacagcggggauggaaaccacauguuugccggccaucuuaaguguaagguccggauggaaaaacugagaaucaaggggauguccuauacaaugugcucuggaaaauucagcauugacaaggagauggccgagacccaacacggcacgacaguggugaaaguuaaguacgaaggggcuggcgccccuuguaagguccccaucgagauucgcgaugugaauaaagaaaagguggucggacgggugaucuccagcaccccccucgcggagaacacaaacggcguuaccaauaucgagcuggaaccuccguucggggacucuuauauugugaucggagucggcaacuccgcucugacccuccauugguuuagaaaagggagcucuauuggaaagauguucgagagcacauaccgcggcgccaaacggauggccauccugggggaaacggcuugggauuuuggcuccgugggaggccuuuucaccucucuggggaaggccguucaccagguguuuggaagcgucuauacaaccauguucggcgggguguccuggaugauuagaauccucaucggauuucugguucuguggauuggcacaaauagccgcaacaccucuauggcuaugacgugcaucgccguggggggcauuacacuuuuccucggauuuaccguccaggcggacaugggcugugugguguccuggagcgggcgggagcugaagugcggaucuggcaucuucgucguugauaaugugcauaccuggacagaacaauacaaauuucagcccgaguccccugccagacuggcuagcgccauucucaacgcucacaaggacgggguguguggaauccgcuccaccacacggcuggagaaugucauguggaaacagauuacgaacgaacuuaauuaugugcugugggagggcggccacgaccucaccguuguggccggggaugucaagggagugcugacaaaaggcaagagagcgcugacccccccuguuucugaccuuaaguacagcuggaaaacaugggggaaggccaaaaucuucacccccgaagcucggaacuccacguuucucaucgauggaccggacaccucugagugcccuaaugaacgcagagccuggaacagccuggagguggaggauuacggcuucgggauguucacaaccaauauuuggaugaaguuucgggaaggauccagcgaggucugugaccauagacugaugucugcugccaucaaagaucagaaggccgugcacgcugacaugggcuauuggauugaauccagcaaaaaccaaacauggcagaucgagcgcgcgucucucauugaaguuaagaccugccuguggcccaagacacauacccuuugguccaauggcgugcuggagagccagaugcucaucccuaaaucuuacgccgggcccuucagccagcacaacuaucggcaaggauacgcuacgcagacagucggcccuuggcaccuggggaagcuggagaucgauuuuggagaaugccccggcaccaccgugacaauucaggaggacugugaucauagagggccgucccuucgcaccacgacagccagcggaaaacucgugacccaguggugcuguagaucuugcacaaugccuccccugcgguuccugggcgaagacggcuguugguaugggauggagauccgcccccucuccgagaaggaagagaacauggucaaaagccaaguuaccgccggacagggcacauccgaaaccuuuucuauggggcugcuuugccugacgcucuucguggaggaaugucugagacggcgcgugaccagaaagcacaugauucuggcugucaucauuacacuuugcgccaucauccucggaggccugaccuggauggaucugcuccgggcgcugauuaugcuuggggacacaaugagcggacgcaucggcggccagacccaucuggcuauuauggccguguuuaagauguccccuggguacguucucggaguguuccugagaaaacugacgucucgggagacagcccuuauggucaucggcauggcuaugaccacaacccugagcauuccgcacgaccucauggagcugaucgaugggaucucccucggacugauucuucugaagaucgugacccaguuugacaauacacaaguuggcacgcucgcccugucucugaccuucauucgcagcacaaugucccuugugauggcguggagaaccaucauggcuguccuguuuguggucacacucauuccccugugucggaccagcugccuccagaaacagucucauuggguggaaaucacggcccugauucuuggggcccaagcucugccuguuuaucucaugacacugaugaagggagccuccagacgcagcuggccccugaacgagggcaucauggcugugggccuugucucucugcucggguccgcccugcucaaaaaugaugugccucuggcgggacccaugguugccggcgggcuucugcuggcugccuacgugaugagcggaucuuccgcugaccucagccuggaaaaggccgccaacguccagugggaugagauggcugacaucaccggcuccagcccuauuaucgaagugaagcaggaugaggacgggucuuucagcauucgggauguggaggaaaccaauaugaucacacuucugguuaaacucgcgcugauuaccgucuccggacucuacccccuggccaucccggugacaaugacgcuuugguauauguggcaggugaagacccaaagaucuggcgcucugugggacgucccuagccccgccgccacacagaaagcugcccuguccgagggcguguaccgcaucaugcagcgggggcucuuuggaaagacccagguuggcguggggauucacauggaaggagucuuccacacaauguggcaugugaccagaggcucuguuaucugucacgagacggggcgccuggaaccuagcugggcggaugugcggaacgacaugauuuccuauggaggcggcuggagacuuggggauaaaugggacaaggaggaggacguccaagugcuggcuaucgaacccggaaagaauccgaaacauguucagaccaagccuggccucuucaaaacacugaccggggagauuggagccgugacacucgauuuuaagcccggcaccucugggagcccuaucaucaaccgcaaaggcaaggucauuggacuguacggcaaugggguggugacaaaauccggagacuaugucagcgccaucacgcaggcugaacggauuggcgagcccgauuacgagguugacgaagauaucuucagaaagaagcggcuuaccauuauggaccugcaccccggggccggaaaaacaaagcgcauccugccuucuauugugagagaggcgcucaaacggcgccugagaacccuuauccuggcuccgacccggguggucgccgccgaaauggaggaagcucucagaggccugcccauccgcuaucagacaccugccgugaaguccgagcauacggggcgggagauuguugaucucaugugccacgcuaccuuuacaaccagacugcuuagcucuacacgcgugcccaacuacaaucugaucgucauggacgaagcccacuucaccgauccuuccagcguggcggcccggggcuacauuuccacgagaguugagaugggagaagcugccgcuaucuuuaugacagccacccccccuggcgccaccgacccguucccccaaucuaacagcccuauugaggauaucgaacgcgagauccccgagcgguccuggaauacaggguuugacuggauuaccgacuaucagggaaaaacagugugguucgucccuagcaucaaggcuggcaacgauauugcgaauugccugagaaagucugggaaaaaggugauccagcucucccgcaaaaccuuugacacggaauaccccaagacaaaacugaccgauugggacuucgucgugacaaccgauauuagcgagaugggagccaacuuuagagcuggccggguuaucgacccgcgcagaugucuuaagccugugauccugacggaugggcccgaacgggugauucucgccggccccaucccugucacccccgccucugcugcccaacgcagaggacggauuggcagaaacccugcgcaggaggacgaucaguauguuuucagcggggacccgcugaagaaugaugaagaccaugcucacuggacagaggccaaaaugcugcucgauaacaucuacacccccgagggaauuaucccuacacuuuucggccccgaacgcgagaagacccaggccauugacggggaauuucggcugagaggagagcaacgcaaaacauucguggagcugaugcggagaggcgaccucccuguguggcuguccuauaaggucgcuucugccggcaucagcuacaaagaucgggaauggugcuuuaccggggagcgcaauaaccagauccuugaagagaauauggaaguggagauuuggacgagagagggagaaaagaagaaacugcggccccgcuggcucgacgcgagaguuuaugccgauccgauggcucugaaggacuucaaagaguuugccuccggccggaagucuaucacacuggauauucucaccgaaaucgcuagccuuccuaccuaccuguccagccgcgccaaacuggcucucgacaacauugugaugcugcauacaaccgagagagggggacgggccuaccagcacgcgcuuaaugaacugcccgagucucucgagacacugaugcuggucgcccuccuuggcgcuaugacggccgggaucuuccuguuuuucaugcagggaaagggcaucggcaagcuguccauggggcucauuaccaucgcuguggccagcggacugcuuugggucgccgaaauucaaccucaguggaucgcugcguccauuauccuggaguuuuuccucauggugcugcugauccccgaaccugagaaacagcgcacaccccaggauaaccaacucauuuauguuauccuuaccauucugacaaucauuggccugaucgccgcuaaugaaauggggcucauugagaagaccaaaacggacuuuggauucuaccaggugaagaccgagacaaccauccuggaugucgaccuuagaccggccucugccuggacacuguaugcuguggccaccacgauccucacaccuaugcugcggcacaccauugaaaacacaagcgcgaaucugucccucgccgcuaucgccaaccaggcugccguucuuaugggccuggggaaaggauggccccugcauagaauggaucucggcgugccccugcuugcgaugggcuguuacucucaggucaauccuaccacccugacagccagccucgugaugcugcuggugcacuaugcuauuaucgggccgggacuccaagccaaggcuacgcgcgaggcccagaaacggaccgcugccggcauuaugaagaaccccacaguugacgggaucaccgucaucgaucuugaaccuauuuccuacgaccccaaguuugagaaacagcugggacaagugaugcugcucgugcugugcgcgggccagcuucugcucaugagaacaaccugggccuucugugagguccugacgcuggcuacagggccuauccucacccuuugggaaggaaaucccggccgcuucuggaacaccacaauugccguuagcaccgcuaacaucuuucggggcucuuaucuggccggggccggacuggcguucucccucauuaagaaugcucagacaccuagacgcggcacggggaccacaggagagacccugggcgaaaaauggaagcggcagcuuaacagccuggacagaaaagaguuugaagaguacaagcgcucugggauccucgagguggaucggacagaagccaaguccgcucugaaagacggaagcaagaucaaacaugccgugucuagaggcagcuccaagauucgcuggaucgucgagcggggcauggugaaaccgaaggggaagguuguggaucugggaugcggcagagggggauggucuuacuauauggccacccucaaaaaugucacggaagugaagggcuacaccaaagggggacccggccacgaggaaccuauucccauggcuacauauggcuggaaccuuguuaagcugcauagcgggguggacgucuucuacaaaccuaccgagcaaguggauacacugcucugugacaucggagaguccagcuccaaucccaccauugaagagggccgcacacugagagugcuuaagauggucgaaccguggcugucuagcaagccugaguuuugcaucaaaguucucaaccccuauaugcccaccgugauugaagagcuggagaagcugcagcggaaacacgggggaaaucucgugcgcuguccucuuuccagaaacucuacgcacgaaauguacugggucagcggcgccuccgggaauaucgugucuagcguuaacacaaccuccaagaugcugcugaaucgguucaccacaagacaucggaaacccacguaugagaaggauguggaccucggagcgggcacccgcagcgucucuacagaaaccgagaaaccugauaugacaaucauuggcagacggcugcagcgccuucaggaggaacacaaggagaccuggcauuacgaccaagaaaacccguacagaacaugggccuaucacggguccuacgaggcucccagcaccggaucugccuccagcauggugaauggcguugugaagcugcucacgaaaccuugggaugucauccccauggugacccagcuggcuaugacagacaccacaccuuuugggcagcagcggguuuucaaggaaaaaguggacacccgcacgccccaaccgaagccuggaacaagaauggucaugaccacaaccgccaacuggcugugggcgcuccugggcaaaaagaagaauccccggcuuugcacgaaagaggaguuuauuucuaaggugcgcuccaacgccgcuaucggggccgucuuccaggaagagcagggcuggaccagcgcuuccgaagccgugaaugauagcagauuuugggagcugguugacaaagaacgggcucuccaccaagagggaaagugugagucuugcguguauaacaugaugggcaaacgcgaaaagaagcugggggaguucggaagagccaaaggcagccgggcgauuugguacauguggcuuggggcccgcuuucuggaauucgaggcucucggauuccugaacgaagaucauugguuuggcagagagaauuccuggucuggggucgagggcgaaggacugcaccggcucggcuauauccuggaggaaaucgacaagaaagauggggaccuuauguacgccgaugacacagcuggaugggauaccagaauuacagaggacgaucugcagaacgaggaacucaucaccgagcagauggccccucaucacaagauucuggccaaagcgaucuucaagcuuacauaucagaauaagguggugaaaguucugcgccccaccccucggggcgcugugauggacauuaucagcagaaaggaucaacgcggguccggacaggucggcacguacgggcucaacacauuuaccaauauggaagugcagcugauccggcagauggaggccgaaggcguuauuacccaagacgacaugcagaaccccaaaggacugaaggagagaguggagaaauggcuccgcgaaugcggcgucgaucggcugaagagaauggccaucucuggggacgauuguguggucaaaccgcuugacgagcgcuucggaacaagccugcucuuucugaaugauaugggcaaggugcggaaggacauuccucagugggaacccuccaaaggguggaagaacuggcaggagguucccuucugcucucaucacuuucacaaaaucuucaugaaggauggaagaagccuuguggucccuugucgcaaucaagacgaacugauuggccgggcuagaaucucccagggggccggcuggagccuccgggagaccgcuugccugggaaaagccuacgcgcagauguggucucugauguauuuucauagacgcgaucuccggcuggccuccauggcuaucuguagcgccgugccgacagagugguuccccacgucuagaaccacaugguccauucacgcucaucaccaguggaugaccacagaagacaugcuuaagguuuggaaccgcguguggaucgaggauaauccuaacaugaccgacaagacgcccauucacagcugggaagacaucccuuaccugggcaaaagagaggaucucuggugcgggucccugauuggacuuucuagccgggccaccugggcgaagaauauccauacagccauuacccaaguccgcaaccugaucggcaaagaagaguauguggacuacaugcccgugaugaagagauauuccgcuccuagcgagucugaagggguucucuga

SEQ ID NO: 21000 - RNA, 9867 nt, Artificial Sequence
  derived and/or modified CDS sequence (opt5) from DENV-4__FJ639742__SS-prME
agcaccaugacgcugcucugccugauccccacggccauggcuuuccaccuuuccacccgggacggagagccucugaugauuguggccaagcaugaacgggggcgcccgcuccuguuuaaaaccaccgaggggaucaacaaguguacccuuauugcgauggaucugggcgaaaugugcgaggacaccgucacauacaaauguccccuccugguuaauaccgaaccugaggauaucgacugcugguguaaccugacgucuaccugggugauguaugggacaugcacccagagcggagagagacggcgcgaaaagagauccguggcucucacaccccacucuggcauggggcuggagacccgggccgaaacguggaugagcuccgagggagccuggaaacaugcucaacgcgucgagucuuggauucuuagaaauccuggcuucgcccugcucgcuggcuuuauggccuacaugguggggcagacaggaauccagcggaccguuuucuuugugcugaugaugcuugucgcgcccagcuauggcaugcgcuguguggggguuggaaacagagauuucguggaaggcgucuccgggggagccuggguggaccuggugcucgagcacggcggcugcgucacaaccauggcucaggggaagccuacccuggauuuugaacugacaaagacgaccgccaaagagguugcucuccugcggacauacuguaucgaagcccuuauuagcaauaucaccacagcgacccgcugcccgacgcaaggagagcccuaucugaaggaggaacaggaccagcaguacauuuguagacgggaugugguggaccgcggcugggggaacggaugcggccucuucgggaaaggaggcgucgugacaugcgccaaguuuucuuguuccggcaaaaucaccgggaaucugguucaaauugagaaccuugaauauaccguggucgugacaguucauaauggagauacccacgcugugggcaacgacacaagcaaucacggggucacggccaccaucacaccuagaucucccuccguggaggucaagcugccugauuacggagaacucacccuggacugcgagccccggagcggcauugacuucaacgagaugauccugaugaagaugaaaaagaaaacauggcucgugcauaagcagugguuucuggaucuuccgcugccuuggaccgcuggggccgacacgucugaaguucacuggaauuacaaagagagaauggugaccuucaaggucccccaugccaaacgccaggaugugacaguucucggcucccaggaaggagcuaugcacagcgcgcuggccggcgcuaccgagguggacuccggggauggaaaccacauguuugccggccaucuuaaguguaagguccggauggaaaaacugagaaucaaggggaugucuuauacaaugugcagcggaaaauucuccauugacaaggagauggccgagacccaacacggcacgacaguggugaaaguuaaguacgaaggggcuggcgccccuuguaagguccccaucgagauucgcgaugugaauaaagaaaagguggucggacgggugaucagcucuacaccccucgcggagaacacaaacuccguuaccaauauugagcuggaaccuccguucggcgacagcuauaucgugaucggggucggaaacucugcucugacccuccauugguuuagaaaaggcagcuccauugggaagauguucgagucuacauaccgcggagccaaacggauggccauccugggcgaaacggcuugggauuuugggagcgugggcggacuuuucaccucccugggcaaggccguucaccagguguuugggagcgucuauacaaccauguucggaggcgugucuuggaugauuagaauccucauuggguuucugguucuguggaucggaacaaauucccgcaacaccagcauggcuaugacgugcaucgccgugggcgggauuacacuuuuccucggcuuuaccguccaggcggacaugggauguguggugucuugguccggccgggagcugaagugcgggagcggaaucuucgucguugauaaugugcauaccuggacagaacaauacaaauuucagcccgaguccccugccagacuggcuucugccauucucaacgcucacaaggacggcgugugugggauccgcagcaccacacggcuggagaaugucauguggaaacagauuacgaacgaacuuaauuaugugcugugggagggaggccacgaccucaccguuguggccggcgaugucaagggggugcugacaaaaggaaagagagcgcugacacccccuguuuccgaccuuaaguacucuuggaaaacauggggcaaggccaaaaucuucacccccgaagcucggaacagcacguuucucauugaugggccggacaccuccgagugcccuaaugaacgcagagccuggaacagccuggagguggaggauuacggauucggcauguucacaaccaauaucuggaugaaguuucgggaagggucuuccgaggucugugaccauagacugaugagcgcugccaucaaagaucagaaggccgugcacgcugacaugggauauuggauugaaucuuccaaaaaccaaacauggcagaucgagcgcgcgagccucauugaaguuaagaccugccuguggcccaagacacauacccuuuggucuaauggcgugcuggagagccagaugcucaucccuaaauccuacgccggccccuucagccagcacaacuaucggcaaggguacgcuacgcagacagucggaccuuggcaccugggcaagcuggagauugauuuuggggaaugccccggaaccaccgugacaauccaggaggacugugaucauagaggcccgucucuucgcaccacgacagccuccgggaaacucgugacccaguggugcuguagaagcugcacaaugccuccccugcgguuccugggagaagacggcuguugguauggcauggagauccgcccccucuccgagaaggaagagaacauggucaaaucucaaguuaccgccgggcagggaacaagcgaaaccuuuuccaugggccugcuuugccugacacucuucguggaggaaugucugagacggcgcgugaccagaaagcacaugauucuggcugucgugaucacacuuugcgccauuauccucgggggacugaccuggauggaucugcuccgggcgcugauuaugcuuggcgacacaaugucugggcgcaucggaggccagacccaucuggcuaucauggccguuuuuaagaugagcccuggcuacgugcucggggucuuccugagaaaacugacgucccgggagacagcccuuauggugauuggaauggcuaugaccacaacccugucuaucccgcacgaccucauggagcugauugauggcaucagccucgggcugauucuucugaagaucguuacccaguuugacaauacacaagugggaacgcucgcccugucccugaccuucauccgcagcacaaugucucuugucauggcguggagaaccauuauggcugugcuguuugucgugacacucaucccccugugucggaccuccugccuccagaaacagagccauuggguugaaauuacggcccugauccuuggcgcccaagcucugccuguguaucucaugacacugaugaagggggccucuagacgcuccuggccccugaacgagggaauuauggcugucggccuugugagccugcucggcucugcccugcucaaaaaugauguuccucuggcggggcccaugguggccggaggccuucugcuggcugccuacgucauguccgggagcuccgcugaccucagccuggaaaaggccgccucugugcagugggaugagauggcugacaucaccggaagcuccccuauuaucgaagugaagcaggaugaggacggcucuuucagcauccgggauguugaggaaaccaacaugauuacacuucuggucaaacucgcgcugaucaccguguccgggcucuacccccuggccauuccggugacaaugacgcuuugguauauguggcaggucaagacccaaagaucuggagcucugugggacgugccuagccccgccgccacacagaaagcugcccuguccgagggcguuuaccgcaucaugcagcggggccucuuugggaagacccaggugggagucggcauucacauggaagggguguuccacacaauguggcauguuaccagaggaucugugaucugucacgagacgggccgccuggaaccuagcugggcggauguccggaaugacaugaucuccuaugggggaggcuggagacuuggcgauaaaugggacaaggaggaggacgugcaaguucuggcuauugaacccgggaagaacccgaaacaugugcagaccaagccuggacucuucaaaacacugaccggcgagaucggggccgucacacucgauuuuaagcccggaaccagcggcucuccuauuaucaaucgcaaagggaaggugauuggccuguacggaaacggcguggucacaaaauccggggacuauguuagcgccaucacgcaggcugaacggaucggagagcccgauuacgagguggacgaagauauuuucagaaagaagcggcuuaccaucauggaccugcaccccggcgccgggaaaacaaagcgcauucugccuucuaucgugagagaggcgcucaaacggcgccugagaacccuuauucuggcuccgacccgggucguggccgccgaaauggaggaagcucucagaggacugcccauccgcuaucagaccccugccguuaaguccgagcauacgggccgggagauuguggaucucaugugccacgcuaccuuuacaaccagacugcuuagcuccacacgcguccccaauuacaaccugaucgugauggacgaagcccacuucaccgauccuucuagcguugcggcccggggguacaucuccacgagaguggagaugggcgaagcugccgcuauuuuuaugacagccacacccccuggagccaccgacccguucccccaaagcaauucuccuaucgaggauauugaacgcgagauccccgagcgguccuggaacacaggcuuugacuggauuaccgacuaucaggggaaaacagucugguucgugccuagcaucaaggcuggaaaugauaucgcgaacugccugagaaagucuggcaaaaaggucauucagcucagccgcaaaaccuuugacacggaauaccccaagacaaaacugaccgauugggacuucgugguuacaaccgauaucuccgagaugggggccaauuuuagagcuggacgggugauugacccgcgcagaugucuuaagccugugauccugacggauggccccgaacgggucauucucgccgggcccaucccuguuacccccgccucugcugcccaacgcagaggccggaucggaagaaacccugcgcaggaggacgaucaguauguguucagcggcgacccgcugaagaacgaugaagaccaugcucacuggacagaggccaaaaugcugcucgauaauauuuacacccccgaggggaucauuccuacacuuuucggacccgaacgcgagaagacccaggccaucgacggcgaauuucggcugagaggggagcaacgcaaaacauucguggagcugaugcggagaggagaccucccugucuggcuguccuauaagguggcuucugccggcauuagcuacaaagaucgggaauggugcuuuaccggcgagcgcaacaaucagauccuugaagagaacauggaaguugagauuuggacgagagagggggaaaagaagaaacugcggccccgcuggcucgacgcgagaguguaugccgauccgauggcucugaaggacuucaaagaguuugccuccggaagaaagagcaucacacuggauauccucaccgaaauugcuucucuuccuaccuaccuguccagccgcgccaaacuggcucucgacaauaucgucaugcugcauacaaccgagagaggcgggcgggccuaccagcacgcgcuuaacgaacugcccgagucccucgagacacugaugcugguggcccuccuuggagcuaugacggccggcauuuuccuguuuuucaugcaggggaagggaaucggcaagcugucuaugggccucauuaccaucgcugucgccagcgggcugcuuuggguggccgaaauccaaccucaguggauugcugcguccaucauucuggaguuuuuccucaugguucugcugauccccgaaccugagaaacagcgcacaccccaggauaaucaacucauuuaugugauccuuaccauccugacaauuaucggacugauugccgcuaacgaaaugggccucaucgagaagaccaaaacggacuuuggguucuaccaggucaagaccgagacaaccauucuggauguggaccuuagaccggccucugccuggacacuguaugcuguugccaccacgauccucacaccuaugcugcggcacaccauugaaaauacaagcgcgaaccugucccucgccgcuaucgccaaucaggcugccgugcuuaugggacugggcaaaggguggccccugcauagaauggaucucggagucccccugcuugcgaugggcuguuacagccaggugaacccuaccacccugacagccucucucgugaugcugcugguucacuaugcuaucauuggcccggggcuccaagccaaggcuacgcgcgaggcccagaaacggaccgcugccggaaucaugaagaaucccacagucgacggcauuaccgugaucgaucuugaaccuauuuccuacgaccccaaguuugagaaacagcuggggcaagugaugcugcucguccugugcgcgggacagcuucugcucaugagaacaaccugggccuucugugagguucugacgcuggcuacaggcccuauccucacccuuugggaagggaaccccggacgcuucuggaauaccacaaucgccgugagcaccgcuaacauuuuucggggcucuuaucuggccggcgccgggcuggcguucucccucaucaagaacgcucagacaccuagacgcggaacgggcaccacaggggagacccugggagaaaaauggaagcggcagcuuaauagccuggacagaaaagaguuugaagaguacaagcgcucuggcauucucgagguggaucggacagaagccaagagcgcucugaaagacggguccaagaucaaacaugccgucucuagaggaagcuccaagauucgcuggaucguggagcggggcaugguuaaaccgaagggcaagguggucgaucuggggugcggaagaggcggguggagcuacuauauggccacccucaaaaacgugacggaaguuaagggauacaccaaaggcgggcccggacacgaggaaccuauccccauggcuacauauggcuggaaucuugugaagcugcauuccggcgucgacguguucuacaaaccuaccgagcaaguggauacacugcucugugacauuggggagucuagcuccaaccccaccaucgaagagggacgcacacugagaguccuuaagaugguugaaccguggcugucuagcaagccugaguuuugcauuaaagugcucaaucccuauaugcccaccgugaucgaagaacuggagaagcugcagcggaaacacggcgggaaccucguccgcuguccucuuuccagaaauucuacgcacgaaauguacugggugagcggagccuccggcaacauuguuagcucugugaauacaaccuccaagaugcugcugaaccgguucaccacaagacaucggaaacccacguaugagaaggaugucgaccucggggcgggaacccgcagcgugucuacagaaaccgagaaaccugauaugacaaucauuggcagacggcugcagcgccuucaggaggaacacaaggagaccuggcauuacgaccaagaaaauccguacagaacaugggccuaucacggcuccuacgaggcucccagcaccgggucugccuccagcaugguuaacggaguggucaagcugcucacgaaaccuugggaugugauccccaugguuacccagcuggcuaugacagacaccacaccuuuuggccagcagcggguguucaaggaaaaagucgacacccgcacgccccaaccgaagccugggacaagaauggugaugaccacaaccgccaauuggcugugggcgcuccugggcaaaaagaagaacccccggcuuugcacgcgcgaggaguuuaucuccaaagucagaagcaaugccgcuauuggcgccguguuccaggaagaacagggguggaccucugcuagcgaagccguuaacgauucccgguuuugggagcugguggacaaggaacgcgcucuccaccaagagggcaaaugugagucuugcgucuauaauaugaugggaaagagagagaaaaagcugggcgaguucgggcgggccaagggaagccgcgcgaucugguacauguggcuuggcgccagauuucuggaguucgaggcucucggguuccugaacgaagaucauugguuuggacgggagaacuccuggucuggcguggagggggaaggccugcacagacucggauauauucuggaggaaaucgacaaaaaggauggcgaccuuauguacgccgaugacacagcugggugggauacccgcauuacagaggacgaucugcagaaugaggaacucaucaccgagcagauggccccucaucacaaaauccuggccaaggcgauuuucaaacuuacauaucagaacaaggugguuaaggugcugcggcccaccccuagaggagcugucauggacaucauuagccgcaaagaucaacggggcuccggacaggugggaacguacggccucaauacauuuaccaacauggaaguucagcugaucagacagauggaggccgaaggggugauuacccaagacgacaugcagaaucccaagggccugaaagagcgcgucgagaaguggcuccgggaaugcggaguggauagacugaaacgcauggccaucucuggcgacgauugugucgugaagccgcuugacgagcgguucgggacaagccugcucuuucugaacgauaugggaaaaguuagaaaggacaucccucagugggaacccuccaagggcuggaaaaauuggcaggaggugcccuucugcagccaucacuuucacaagauuuucaugaaagaugggcgcucucuugucgugccuugucggaaccaagacgaacugaucggcagagcucggauuucccagggagccggguggagccucagagagaccgcuugccugggcaaggccuacgcgcagauguggucucugauguauuuucaucgccgggaucucagacuggccuccauggcuaucuguagcgccguuccgacagagugguuccccacgucccgcaccacauggucuauucacgcucaucaccaguggaugaccacagaagacaugcuuaaaguguggaauagagucuggaucgaggauaacccuaauaugaucgacaagacccccgugcacagcugggaagacauuccuuaccugggaaagcgggaggaucucuggugcggcucccugaucgggcuuagcucucgcgccacgugggcgaaaaacauucauaccgccaucacacaagugagaaaucugauuggaaaggaagaguauguugacuacaugcccgucaugaaacgguauuccgcuccuagcgagucugaaggcgugcucuga

SEQ ID NO: 21001 - RNA, 9867 nt, Artificial Sequence
  derived and/or modified CDS sequence (opt5) from DENV-4__FJ639745__SS-prME
agcaccaugacacugcucugccugauccccacggccauggcuuuccaccuuuccaccagagacggcgagccucugaugauuguggccaagcaugaacgggggcgcccgcuccuguuuaaaacaaccgagggaaucaacaaguguacacuuauugcgauggaucugggcgaaaugugcgaggacaccgucacauacaaauguccccuccugguuaauaccgaaccugaggauaucgacugcugguguaaccugacgucuaccugggugauguaugggacaugcacccagagcggagagagacggcgcgaaaagagauccguggcucucacaccccacucuggcauggggcuggagacccgggccgaaacguggaugagcuccgagggagccuggaaacaugcucaacgcgucgagucuuggauucuuagaaauccuggcuucgcccugcucgcuggcuuuauggccuacaugaucgggcagacaggaauccagcggaccguguucuuuguucugaugaugcuuguggcgcccagcuauggcaugcgcugugucggggugggaaacagagauuucguugaaggcguguccgggggagccugggucgaccuggugcucgagcacggcggcugcgugacaaccauggcucaggggaagccuacccuggauuuugaacugacaaagacgaccgccaaagaggucgcucuccugcggacauacuguauugaagcccuuaucagcaauauuaccacagcgacccgcugcccgacgcaaggagagcccuaucugaaggaggaacaggaccagcaguacaucuguagacgggauguuguggaccgcggcugggggaacggaugcggccucuucgggaaaggaggcguggucacaugcgccaaguuuucuuguuccggcaaaauuaccgggaaucuggugcaaaucgagaaccuugaauauaccguuguggucacagugcauaauggagauacccacgcuguuggcaacgacacaagcaaucacggggugacggccaccauuacaccuagaucucccuccgucgaggugaagcugccugauuacggagaacucacccuggacugcgagccccggagcggcaucgacuucaacgagaugauccugaugaagaugaaaaagaaaacauggcucguccauaagcagugguuucuggaucuuccgcugccuuggaccgcuggggccgacacgucugaagugcacuggaauuacaaagagagaaugguuaccuucaaggugccccaugccaaacgccaggaugucacagugcucggcucccaggaaggagcuaugcacagcgcgcuggccggcgcuaccgagguugacuccggggauggaaaccacauguuugccggccaucuuaaguguaaggugcggauggaaaaacugagaauuaaggggaugucuuauacaaugugcagcggaaaauucuccaucgacaaggagauggccgagacccaacacggcacgacagucgugaaagugaaguacgaaggggcuggcgccccuuguaagguucccauugagauccgcgaugucaauaaagaaaagguggugggacgggucauuagcucuaccccccucgcggagaacacaaacuccgugaccaauaucgagcuggaaccuccguucggcgacagcuauaucguuauuggggugggaaacucugcucugacccuccauugguuuagaaaaggcagcuccaucgggaagauguucgagucuacauaccgcggagccaaacggauggccauucugggcgaaacggcuugggauuuugggagcgucggcggacuuuucaccucccugggcaaggccgugcaccagguuuuugggagcguguauacaaccauguucggaggcgucucuuggaugaucagaauucucaucgggcugcuggugcuuuggaucggaacaaauucccgcaacaccagcauggcuaugacgugcauugccguuggcgggaucacacucuuucugggcuucaccgugcaggcggacaugggaugugucgugucuugguccggccgggagcugaagugcgggagcggaauuuuuguggucgauaauguucauaccuggacagaacaauacaaauuccagcccgaguccccugccagacucgcuucugccauccugaacgcucacaaggacggcgugugugggauucgcagcaccacacggcuugagaaugugauguggaaacagaucacgaacgaacugaauuauguccucugggagggaggccacgaccugaccgugguugccggcgaugugaaggggguccugacaaaaggaaagagagcgcuuacccccccuguguccgaccucaaguacucuuggaaaacauggggcaaggccaaaauuuuuacccccgaagcucggaacagcacguuccugaucgaugggccggacaccuccgagugcccuaaugaacgcagagccuggaacagccuggagguugaggauuacggauuuggcauguucacaaccaauaucuggaugaaguuccgggaagggucuuccgaggugugugaccauagacucaugagcgcugccauuaaagaucagaaggccguccacgcugacaugggauauuggaucgaaucuuccaaaaaccaaacauggcagauugagcgcgcgagccugaucgaagugaagaccugccuuuggcccaagacacauacccuguggucuaauggcguucucgagagccagaugcugauuccuaaauccuacgccggccccuuuagccagcacaacuaucggcaaggguacgcuacgcagacagugggaccuuggcaccugggcaagcuugagaucgauuucggggaaugccccggaaccaccgucacaauccaggaggacugugaucauagaggcccgucucuccgcaccacgacagccuccgggaaacuggugacccaguggugcuguagaagcugcacaaugccuccccugcgguuucucggagaagacggcuguugguauggcauggagauucgcccccuguccgagaaggaagagaacauggugaaaucucaagucaccgccgggcagggaacaagcgaaaccuucuccaugggccuucugugccucacgcuguuuguugaggaaugucugagacggcgcgugaccagaaagcacaugauccuugcuguggucauuacacucugcgccaucauucuggggggacugaccuggauggaucuccugcgggcgcuuaucaugcugggcgacacaaugucugggcgcaucggaggccagacccaucucgcuauuauggccguguucaagaugagcccuggcuacguucuggggguguuucugagaaaacuuacgucccgggagacagcccugauggucaucggaauggcuaugaccacaacccucucuauuccgcacgaccugauggagcucaucgauggcauuagccuggggcuuauccugcucaagaucgugacccaguucgacaauacacaaguuggaacgcuggcccugucccuuaccuuuauucgcagcacaaugucucuggugauggcguggagaaccaucauggcuguccucuucguggucacacugauuccccucugucggaccuccugccugcagaaacagagccauuggguggaaaucacggcccuuauucugggcgcccaagcucucccuguuuaucugaugacacugaugaagggggccucuagacgcuccuggccccuuaacgagggaaucauggcugugggccuggucagccuccugggcucugcccuccugaaaaaugaugugccucuugcggggcccaugguugccggaggccugcugcucgcugccuacgugauguccgggagcuccgcugaccugagccuugaaaaggccgccaacguccagugggaugagauggcugacauuaccggaucuagcccuaucaucgaagugaagcaggaugaggacggcuccuuuucuauucgggauguggaggaaaccaauaugaucacacugcucguuaaacuggcgcucauuaccgucagcgggcuguacccccuugccaucccggugacaaugacgcugugguauauguggcaggugaagacccaaagauccggagcucugugggacgucccuucucccgccgccacacagaaagcugcccucagcgagggcguguaccgcauuaugcagcggggccuguucgggaagacccagguuggagugggcauccacauggaaggggucuuucacacaauguggcaugugaccagaggauccguuaucugucacgagacgggccgccuugaaccuucuugggcggaugugcggaacgacaugauuagcuaugggggaggcuggagacugggcgauaaaugggacaaggaggaggacguccaagugcucgcuaucgaacccgggaagaauccgaaacauguucagaccaagccuggacuguucaaaacacucaccggcgagauuggggccgugacacuggauuucaagcccggaaccuccggcagcccuaucauuaaccgcaaagggaaggucaucggccuuuacggaaauggcguggugacaaaaucuggggacuaugucuccgccaucacgcaggcugaacggauuggagagcccgauuacgagguugacgaagauaucuuuagaaagaagcggcugaccauuauggaccugcaccccggcgccgggaaaacaaagcgcauccucccuagcauugugagagaggcgcugaaacggcgccuuagaacccugauccucgcuccgacccggguggucgccgccgaaauggaggaagcucugagaggacuccccauucgcuaucagacaccugccgugaagucugagcauacgggccgggagaucguugaucugaugugccacgcuaccuucacaaccagacuucuguccagcacacgcgugcccaacuacaaucugaucgucauggacgaagcccacuuuaccgauccuuccucuguggcggcccggggguacauuagcacgagaguugagaugggcgaagcugccgcuaucuucaugacagccacccccccuggagccaccgacccguuuccccaauccaacagcccuauugaggauaucgaacgcgagauucccgagcggucuuggaauacaggcuucgacuggaucaccgacuaucaggggaaaacagugugguuugucccuuccaucaaggcuggaaacgauauugcgaauugccucagaaagagcggcaaaaaggugauccagcugucucgcaaaaccuucgacacggaauaccccaagacaaaacuuaccgauugggacuuugucgugacaaccgauauuagcgagaugggggccaacuucagagcuggacggguuaucgacccgcgcagaugucugaagccugugauucucacggauggccccgaacgggugauccuggccgggcccaucccugucacccccgccuccgcugcccaacgcagaggccggauuggaagaaacccugcgcaggaggacgaucaguauguuuuuucuggcgacccgcugaagaaugaugaagaccaugcucacuggacagaggccaaaaugcuccuugauaacaucuacacccccgaggggauuaucccuacacuguucggacccgaacgcgagaagacccaggccauugacggcgaauuccggcugagaggggagcaacgcaaaacauuuguggagcucaugcggagaggagaccugccuguguggcuuagcuauaaggucgcuuccgccggcaucucuuacaaagaucgggaauggugcuucaccggcgagcgcaauaaccagauucuggaagagaauauggaaguggagaucuggacgagagagggggaaaagaagaaacuccggccccgcuggcuggacgcgagaguuuaugccgauccgauggcucugaaggacuuuaaagaguucgccagcggacggaaguccaucacacucgauauucuuaccgaaaucgcuagccugccuaccuaccugucuucccgcgccaaacucgcucuggacaacauugugaugcuucauacaaccgagagaggcgggcgggccuaccagcacgcgcugaaugaacuccccgagagccuggagacacugaugcucgucgcccuucugggagcuaugacggccggcaucuuucuguucuuuaugcaggggaagggaauuggcaagcucuccaugggccugaucaccaucgcuguggccucugggcuucugugggucgccgaaauucaaccucaguggaucgcugcgagcauuauccucgaguucuuucugauggugcugcucauucccgaaccugagaaacagcgcacaccccaggauaaccaacuuaucuauguuauccugaccauucugacaaucauuggacucaucgccgcuaaugaaaugggccugauugagaagaccaaaacggacuucggguuuuaccaggugaagaccgagacaaccauccuugaugucgaccugagaccggccuccgccuggacacucuaugcuguggccaccacgauucugacaccuaugcugcggcacaccaucgaaaacacaucugcgaaucucagccuugccgcuaucgccaaccaggcugccguucugaugggacugggcaaaggguggccccuccauagaauggaucugggagugccccuucuggcgaugggcuguuacucccaggucaauccuaccacccucacagccagccuggugaugcugcucgugcacuaugcuauuaucggcccggggcuucaagccaaggcuacgcgcgaggcccagaaacggaccgcugccggaauuaugaagaaccccacaguugacggcaucaccgucauugaucuggaaccuaucucuuacgaccccaaguucgagaaacagcuggggcaagugaugcuccuggugcuuugcgcgggacagcugcuccugaugagaacaaccugggccuuuugugagguccugacgcucgcuacaggcccuauccuuacccugugggaagggaaucccggacgcuucuggaacaccacaauugccguuuccaccgcuaacaucuuccggggcagcuaucuggccggcgccgggcucgcguuuucucugauuaagaaugcucagacaccuagacgcggaacgggcaccacaggggagacccuuggagaaaaauggaagcggcagcugaacucccucgacagaaaagaguucgaagaguacaagcgcagcggcauccuggagguggaucggacagaagccaagucugcucugaaagacgggagcaagauuaaacaugccguguccagaggaucuagcaagauccgcuggaucgucgagcggggcauggugaaaccgaagggcaagguuguggaucucgggugcggaagaggcgggugguccuacuauauggccacccuuaaaaaugucacggaagugaagggauacaccaaaggcgggcccggacacgaggaaccuauucccauggcuacauauggcuggaaccugguuaagcugcauagcggcguggacgucuuuuacaaaccuaccgagcaaguggauacacuccugugugacaucggggaguccucuagcaaucccaccauugaagagggacgcacacuuagagugcugaagauggucgaaccguggcucuccucuaagccugaguucugcaucaaaguucugaaccccuauaugcccaccgugauugaagagcuggagaagcuccagcggaaacacggcgggaaucuugugcgcuguccucugagcagaaacuccacgcacgaaauguacugggucucuggagccagcggcaauaucguguccagcguuaacacaaccucuaagaugcugcucaaucgguuuaccacaagacaucggaaacccacguaugagaaggauguggaccugggggcgggaacccgcuccgucagcacagaaaccgagaaaccugauaugacaauuaucggcagacggcuucagcgccugcaggaggaacacaaggagaccuggcauuacgaccaagaaaacccguacagaacaugggccuaucacggcucuuacgaggcucccuccaccgggagcgccucuuccauggugaauggaguugugaagcuccugacgaaaccuugggaugucauccccauggugacccagcuggcuaugacagacaccacaccuuucggccagcagcggguuuuuaaggaaaaaguggacacccgcacgccccaaccgaagccugggacaagaauggucaugaccacaaccgccaacuggcucugggcgcugcuuggaaaaaagaagaauccccggcugugcacgcgcgaggaguucauuagcaaagugagauccaacgccgcuaucggcgccgucuuucaggaagagcagggguggaccagcgcuucugaagccgugaaugauagccgguucugggagcucguugacaaggaacgcgcucugcaccaagagggcaaaugugaguccugcguguauaacaugaugggaaagagagaaaaaaagcuuggcgaguuugggcgggccaagggaucucgcgcgauuugguacauguggcugggcgccagauuccucgaauuugaggcucugggguuccugaacgaagaucauugguucggacgggagaauagcugguccggcgucgagggggaaggccuccacagacugggauauauccuugaggaaauugacaaaaaggauggcgaccugauguacgccgaugacacagcugggugggauacccgcaucacagaggacgaucuccagaacgaggaacugaucaccgagcagauggccccucaucacaaaauucuugccaaggcgaucuuuaaacugacauaucagaauaagguggugaagguucuccggcccaccccuagaggagcugugauggacauuaucucucgcaaagaucaacggggcagcgggcaggucggaacguacggccugaacacauucaccaauauggaagugcagcugauuagacagauggaggccgaagggguuaucacccaagacgacaugcagaaccccaagggccucaaagagcgcguggagaaguggcugcgggaaugcggagucgauagacuuaaacgcauggccaucuccggcgacgauuguguggucaagccgcuggacgagcgguuugcuacaucucuccuguuccuuaaugauauggggaaagugagaaaggacauuccucagugggaacccagcaagggauggaaaaacuggcaggagguucccuuuugcucccaucacuuccacaagaucuuuaugaaagauggccgcagccugguggucccuugucggaaucaagacgaacucauugggagagcccggaucucucagggagcuggcuggucccugagagagaccgccugccuggggaaggcguacgcccagauguggagccucauguauuuccaucgccgggaucugagacuugcuucuauggccauuuguuccgcugugccgacagagugguuucccacgagccgcaccacaugguccauccacgcccaucaccaguggaugaccacagaagacaugcugaaaguuuggaacagaguguggaucgaggauaauccuaacaugauugacaagacccccguccacucuugggaagacaucccuuaccucggcaagcgggaggaucuguggugcggaagccuuauuggccuguccagccgcgcgacgugggccaaaaauauccauaccgcuauuacacaagugagaaaccucaucgggaaggaagaguauguggacuacaugcccguuaugaaacgguauucugccccuuccgagagcgaaggaguccuguga

SEQ ID NO: 21002 - RNA, 9867 nt, Artificial Sequence
  derived and/or modified CDS sequence (opt5) from DENV-4__FJ850095__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggucuggccgggagcugaagugcggguccggaaucuucgucguugauaaugugcauacauggaccgaacaauacaaauuucagcccgagagcccugcgagacuggccuccgcuauucucaacgcccacaaggacggcgugugugggauccgcucuacaacgcggcuggagaaugucauguggaaacagauuaccaacgaacuuaauuaugugcugugggagggaggccacgaccucacaguuguggcuggcgaugucaagggggugcugaccaaaggaaagagagcccugacacccccugcgagcgaccuuaaguacuccuggaaaaccuggggcaaggccaaaaucuucacgcccgaagcucggaacucuaccuuucucaucgaugggccggacacaagcgagugcccuaaugaacgcagagccuggaacuccuucgagguugaggauuacggauucggcauguuuaccacaaauauuuggaugaaguuccgggaagggagcucugaggugugugaccauagacugauguccgcugccaucaaagaucagaaggccguccacgcugacaugggauauuggauugaaagcucuaaaaaccaaaccuggcagaucgagcgcgcgucccugauugaagugaagacaugccucuggcccaagacccauacgcuguggagcaauggcguucuugagucucagaugcugaucccuaaaagcuacgccggccccuuuucccagcacaacuaucggcaaggguacgcuacacagaccgugggaccuuggcaccucggcaagcuggagaucgauuucggggaaugccccggaaccacagucaccauucaggaggacugugaucauagaggcccgagccugcgcacgacaaccgccucugggaaacuugugacacaguggugcuguagauccugcaccaugccuccccuccgguuucugggagaagacggcuguugguauggcauggagauccgcccccugagcgagaaggaagagaacauggugaaaucccaagucacagccgggcagggaaccucugaaacguucagcaugggccuccugugccuuacccuguuuguugaggaaugucucagacggcgcgugacaagaaagcacaugauucuggcuguggucaucacccugugcgccauuauccuugggggacucacauggauggaucugcugcgggcgcucaucaugcugggcgacaccauguccgggcgcauuggaggccagacgcaucuugcuaucauggccguguucaagaugucuccuggcuacguucuggggguguuucucagaaaacugacaagccgggagaccgcccugauggucauuggaauggcuaugacaaccacccuuuccaucccgcacgaccugauggagcucauugauggcaucucucuggggcucauccugcuuaagauugugacacaguucgacaauacgcaaguuggaacccuggcccucagccugacauuuauccgcuccaccaugagccuggugauggcguggagaacaauuauggcuguccuuuucguggucacccugaucccccucugucggacgucuugccugcagaaacagucccauuggguggaaauuacagcccucauccugggcgcccaagcucuuccuguuuaucugaugacccucaugaagggggccagcagacgcucuuggccccugaacgagggaauuauggcugugggccuggucucccuucugggcagcgcccuccugaaaaaugaugugccucucgcggggcccaugguugccggaggccugcuucuggcugccuacgugaugucuggguccagcgcugaccugucccucgaaaaggccgccaacguccagugggaugagauggcugacaucaccggaagcucuccuaucauugaagugaagcaggaugaggacggcagcuuuuccauccgggauguggaggaaacaaauaugauuacccugcuuguuaaacuggcgcucaucacagucucugggcuguacccccucgccauuccggugacgaugacccugugguauauguggcaggugaagacacaaagaagcggagcucuuugggacgucccuucccccgccgccacccagaaagcugcccugucugagggcguguaccgcaucaugcagcggggccuguucgggaagacacagguuggagugggcauccacauggaaggggucuuccacaccauguggcaugugacgagaggaagcguuauuugucacgagaccggccgccucgaaccuuccugggcggaugugcggaacgacaugaucucuuaugggggaggcuggagacugggcgauaaaugggacaaggaggaggacguccaagugcuugcuauugaacccgggaagaauccgaaacauguucagacaaagccuggacuguuuaaaacccucacaggcgagaucggggccgugacccuggauuucaagcccggaacaagcggcuccccuauuaucaaccgcaaagggaaggucaucggccucuacggaaauggcguggugacgaaaagcggggacuaugucucugccauuacccaggcugaacggaucggagagcccgauuacgagguugacgaagauauuuuuagaaagaagcggcugacaaucauggaccuucaccccggcgccgggaaaaccaagcgcauucugccuuccaucgugagagaggcgcugaaacggcgccucagaacccugauucuugcuccgacacggguggucgccgccgaaauggaggaagcucugagaggacuccccauccgcuaucagacgccugccgugaagagcgagcauaccggccgggagaucguugaucugaugugccacgcuacauucaccacaagacuccugucuuccacccgcgugcccaacuacaaucuuauugucauggacgaagcccacuuuacggauccuagcuccguggcggcccggggguacaucucuacaagaguugagaugggcgaagcugccgcuauuuucaugaccgccacccccccuggagccacagacccguuuccccaaagcaacuccccuaucgaggauauugaacgcgagauccccgagcggagcuggaauaccggcuucgacuggaucacagacuaucaggggaaaaccgugugguuugucccuucuauuaaggcuggaaacgauaucgcgaauugccugagaaaguccggcaaaaaggugauucagcugagccgcaaaacguucgacacagaauaccccaagaccaaacucacagauugggacuuugucgugaccacggauaucucugagaugggggccaacuucagagcuggacggguuauugacccgcgcagaugucugaagccugugauccuuaccgauggccccgaacgggugauccuggccgggcccauuccugucacacccgccagcgcugcccaacgcagaggccggaucggaagaaacccugcgcaggaggacgaucaguauguuuucuccggcgacccgcucaagaaugaugaagaccaugcucacuggaccgaggccaaaaugcugcuggauaacauuuacacacccgaggggaucauuccuacccucuuuggacccgaacgcgagaagacacaggccaucgacggcgaauuccggcuuagaggggagcaacgcaaaaccuuuguggagcugaugcggagaggagaccugccuguguggcucucuuauaaggucgcuagcgccggcauuuccuacaaagaucgggaauggugcuucacgggcgagcgcaauaaccagauccuggaagagaauauggaaguggagaucuggacaagagagggggaaaagaagaaacuucggcccaaguggcuggacgcgcgcguuuaugccgauccgauggcucucaaagacuuuaaggaguucgccucuggaagaaaaagcauuacccuggauauccugaccgaaauugcuucccucccuacauaccuuagcucucgggccaagcuggcucuggacaacaucgugaugcuccauaccacagagcgcggcgggagagccuaccagcacgcgcugaaugaacuucccgagucccuggagacgcucaugcuggucgcccugcucggagcuaugaccgccggcauuuuucuuuucuuuaugcaggggaagggaaucggcaaacugagcaugggccugaucacaauugcuguggccuccgggcuccugugggucgccgaaauccaaccucaguggauugcugcgucuaucauucuugaguucuuucugauggugcuccugauccccgaaccugagaagcagcggaccccccaggauaaccaacugaucuauguuauucucacaauccuuaccauuaucggacugauugccgcuaaugaaaugggccugaucgagaaaacgaagaccgacuucggguuuuaccaggugaaaacagagaccacaauucucgaugucgaccugcgcccggccagcgccuggacccuuuaugcuguggccacgacaauccugaccccuaugcucagacacacaaucgaaaacaccuccgcgaaucugucucuggccgcuauugccaaccaggcugccguucucaugggacuuggcaagggguggccccugcaucggauggaucugggagugccccuccuggcgaugggcuguuacagccaggucaauccuaccacacuuacggccucccuggugaugcuccuggugcacuaugcuaucauuggcccggggcugcaagccaaagcuaccagagaggcccagaagcgcacagcugccggaaucaugaagaaccccaccguugacggcauuacagucaucgaucucgaaccuaucagcuacgaccccaaauucgagaagcagcuugggcaagugaugcugcuggugcucugcgcgggacagcugcuucugaugcggaccacgugggccuucugugagguccucacacuggcuaccggcccuauucugacccucugggaagggaaucccggaagauuuuggaacacaaccaucgccguuucuacagcuaacauuuuccgcggcuccuaucuugccggcgccgggcuggcguuuagccugaucaaaaaugcucagacgccucggagaggaaccggcacaaccggggagacacucggagaaaaguggaaacgccagcugaacucucuugaccggaaggaguucgaagaguacaagagauccggcauucuggagguggaucgcaccgaagccaaaagcgcucucaaggacgggucuaaaaucaagcaugccgugagccggggauccucuaaaaucagauggauugucgagcgcggcauggugaagccgaagggcaaaguuguggaucuggggugcggacggggcggguggagcuacuauauggccacgcugaagaaugucaccgaagugaaaggauacacaaagggcgggcccggacacgaggaaccuauccccauggcuaccuauggcuggaaccucguuaaacuucauuccggcguggacgucuuuuacaagccuacagagcaaguggauacccugcugugugacauuggggagagcuccucuaaucccacaaucgaagagggaagaacccuccgcgugcugaagauggucgaaccguggcuuagcuccaaaccugaguucugcauuaagguucugaaccccuauaugcccacggugaucgaagagcucgagaaacugcagagaaagcacggcgggaaucuggugcgguguccucucucucgcaacagcacacacgaaauguacugggucuccggagccucuggcaauauugugagcuccguuaacaccaccagcaaaaugcuucugaauagauuuacaacgcggcauagaaagcccaccuaugagaaagauguggaccugggggcgggaacacggucugucuccaccgaaacagagaagccugauaugaccaucaucggccgcagacuccagcggcugcaggaggaacacaaggagacauggcauuacgaccaagaaaacccguaccgcaccugggccuaucacggcagcuacgaggcucccucuacgggguccgccagcucuauggugaauggaguugugaaacuucugaccaagccuugggaugucauucccauggugacacagcucgcuaugaccgacacaaccccuuucggccagcagagaguuuuuaaagaaaagguggacacgcggacaccccaaccgaaaccugggacccgcauggucaugacaaccacggccaacuggcugugggcgcugcucggaaagaagaaaaaucccagacugugcacccgggaggaguucaucuccaaggugcgcagcaacgccgcuauuggcgccgucuuucaggaagagcagggguggacauccgcuagcgaagccgugaaugauucuagauucugggagcuuguugacaaagaacgggcucugcaccaagagggcaagugugagagcugcguguauaacaugaugggaaaacgcgaaaagaagcucggcgaguuugggagagccaaaggaucccgggcgaucugguacauguggcugggcgcccgcuuccuugaauucgaggcucugggguuucucaacgaagaucauugguucggaagagagaauucuuggagcggcgucgagggggaaggccugcaccggcugggauauauucucgaggaaaucgacaagaaagauggcgaccugauguacgccgaugacaccgcugggugggauacaagaaucaccgaggacgaucuucagaacgaggaacugauuacagagcagauggccccucaucacaagauccucgccaaagcgauuuuuaagcugaccuaucagaauaagguggugaaaguucuucgccccacgccucggggagcugugauggacaucauuuccagaaaggaucaacgcggcucugggcaggucggaacauacggccugaacaccuucaccaauauggaagugcagcucauccggcagauggaggccgaagggguuaucacacaagacgacaugcagaaccccaaaggccugaaggagagaguggagaaauggcugcgcgaaugcggagucgaucggcucaagagaauggccauuagcggcgacgauuguguggucaaaccgcuggacgagcgcuuugggaccucccuucuguuccucaaugauaugggaaaggugcggaaggacaucccucagugggaacccucuaaaggcuggaagaacuggcaggagguucccuuuugcagccaucacuuccacaaaauuuuuaugaaggaugggagaucccugguggucccuugucgcaaucaagacgaacuuaucggacgggcuagaauuagccagggcgccggguggucucugcgggagacagcuugccucggcaaagccuacgcgcagauguggucccugauguauuuccauagacgcgaucugcggcucgccagcauggcuaucuguucugccgugccgacggagugguuucccaccuccagaacaaccuggagcauccacgcucaucaccaguggaugacaaccgaagacaugcugaagguuuggaaccgcguguggauugaggauaauccuaacaugaucgacaagacgcccguccacuccugggaagacauuccuuaccuuggaaaaagagaggaucuguggugcggcucucucaucgggcugagcucccgggccaccugggcgaagaauauucauacagccaucacccaagugcgcaaccuuauuggaaaagaagaguauguggacuacaugcccguuaugaagagauauagcgcuccuucugaguccgaaggcguccuguga

SEQ ID NO: 21003 - RNA, 9867 nt, Artificial Sequence
  derived and/or modified CDS sequence (opt5) from DENV-4__FJ639748__SS-prME
agcaccaugacacugcucugccugauccccacggccauggcuuuccaccuuuccaccagagacggcgagccucugaugauuguggccaagcaugaacgggggagaccgcuccuguuuaaaaccaccgaggggaucaacaaguguacccuuauugccauggaucugggcgaaaugugcgaggacaccgugacauacaaauguccccuccugguuaauaccgaaccugaggauaucgacugcugguguaaccugacgucuaccugggugauguaugggacaugcacccagagcggagagagacggagagaaaagagauccguggcucucacaccccacucuggcauggggcuggagacccgggccgaaacguggaugagcuccgagggagccuggaaacaugcucaacgcgucgagucuuggauucuuagaaauccuggcuucgcccugcucgcuggcuuuauggccuacaugaucgggcagacaggaauccagcggaccguguucuuuguucugaugaugcuuguggcgcccagcuauggcaugcgcugugucggggugggaaacagagauuucguugaaggcguguccgggggagccugggucgaccuggugcucgagcacggcggcugcgugacaaccauggcucaggggaagccuacccuggauuuugaacugacaaagacgaccgccaaagaggucgcucuccugcggacauacuguauugaagcccuuaucagcaauauuaccacagcgacccgcugcccgacgcaaggagagcccuaucugaaggaggaacaggaccagcaguacaucuguagacgggauguuguggaccgcggcugggggaacggaugcggccucuucgggaaaggaggcguggucacaugcgccaaguuuucuuguuccggcaaaauuaccgggaaucuggugcaaaucgagaaccuugaauauaccguuguggucacagugcauaauggagauacccacgcuguuggcaacgacacaagcaaucacggggugacggccaccauuacaccuagaucucccuccgucgaggugcagcugccugauuacggagaacucacccuggacugcgagccccggagcggcaucgacuucaacgagaugauccugaugaagaugaagaaaaagacauggcucguccauaaacagugguuucuggaucuuccgcugccuuggaccgcuggggccgacacgucugaagugcacuggaauuacaaggagagaaugguuaccuucaaagugccccaugccaagcgccaggaugucacagugcucggcucccaagaaggagcuaugcacagcgcgcuggccggcgcuaccgagguugacuccggggauggaaaccacauguuugccggccaucuuaaauguaaggugcggauggaaaagcugagaauuaaagggaugucuuauacaaugugcagcggaaaguucuccaucgacaaagagauggccgagacccagcacggcacgacagucgugaaggugaaauacgaaggggcuggcgccccuuguaagguucccauugagauccgcgaugucaauaaggaaaaaguggugggacgggucauuagcucuacaccccuggcggagaacacaaacuccgugaccaauaucgagcuggaaccuccguucggcgacagcuauaucguuauuggggugggaaacucugcucugacccuccauugguuuagaaagggcagcuccaucgggaaaauguucgagucuacauaccgcggagccaagcggauggccauucugggcgaaacggcuugggauuuugggagcgucggcggacuuuucaccucccugggcaaagccgugcaccagguuuuugggagcguguauacaaccauguucggaggcgucucuuggaugauccgcauucucaucgggcugcuggugcuuuggaucggaacaaauucccgcaacaccagcauggcuaugacgugcauugccguuggcgggaucacacucuuucugggcuucaccgugcaagcggacgucggauguguggugucuugguccggccgggagcugaagugcgggagcggaauuuuugucguugauaaugugcauaccuggacagaacaguacaaguuccagcccgaguccccugccagacucgcuucugccauccugaacgcucacaaagacggcgugugugggauucgcagcaccacacggcuugagaaugucauguggaagcagaucacgaacgaacugaauuaugugcucugggagggaggccacgaccugaccguuguggccggcgaugucaaaggggugcugacaaagggaaaaagagcgcuuacacccccuguuuccgaccucaaguacucuuggaagacauggggcaaagccaagauuuuuacccccgaagcucggaacagcacguuccugaucgaugggccggacaccuccgagugcccuaaugaacgcagagccuggaacagccuggagguggaggauuacggauuuggcauguucacaaccaauaucuggaugaaauuccgggaagggucuuccgaggucugugaccauagacucaugagcgcugccauuaaggaucaaaaagccgugcacgcugacaugggauauuggaucgaaucuuccaagaaccagacauggcagauugagcgcgcgagccugaucgaaguuaaaaccugccuuuggcccaagacacauacccuguggucuaauggcgugcucgagagccagaugcugauuccuaaguccuacgccggccccuuuagccaacacaacuaucggcagggguacgcuacgcagacagucggaccuuggcaccugggcaaacuugagaucgauuucggggaaugccccggaaccaccgugacaauccaggaggacugugaucauagaggcccgucucuccgcaccacgacagccuccgggaagcuggugacccaauggugcuguagaagcugcacaaugccuccccugcgguuucucggagaagacggcuguugguauggcauggagauucgcccccuguccgagaaagaagagaacauggucaagucucagguuaccgccgggcagggaacaagcgaaaccuucuccaugggccuucugugccucacgcuguuuguggaggaaugucugagacggcgcgugaccagaaaacacaugauccuugcugucgugauuacacucugcgccaucauucucggcgggcugaccuggauggaucuccugcgggcgcuuaucaugcugggggacacaaugucugggcgcaucggaggccagacccaucucgcuauuauggccguuuucaagaugagcccuggcuacgugcugggggucuuucugagaaaacuuacgucccgggagacagcccugauggugaucggaauggcuaugaccacaacccucucuauuccgcacgaccugauggagcucaucgauggcauuagccuggggcuuauccugcucaaaaucguuacccaauucgacaauacacaggugggaacgcuggcccugucccuuaccuuuauucgcagcacaaugucucuggucauggcguggagaaccaucauggcuguccucuucgucgugacacugauuccccucugucggaccuccugccugcagaagcaaagccauuggguugaaaucacggcccuuauucugggcgcccaggcucucccuguguaucugaugacacugaugaaaggggccucuagacgcuccuggccccuuaacgagggaaucauggcugucggccuggugagccuccugggcucugcccuccugaagaaugauguuccucuugcggggcccaugguggccggaggccugcugcucgcugccuacgucauguccgggagcuccgcugaccugagccuugaaaaagccgccaacgugcagugggaugagauggcugacauuaccggaucuagcccuaucaucgaagugaagcaggaugaggacggcuccuuuucuauucgggauguugaggaaaccaauaugaucacacugcucgucaagcuggcgcucauuaccgugagcgggcuguacccccuugccaucccggugacaaugacgcugugguauauguggcaagucaaaacccagagauccggagcucugugggacgugccuucucccgccgccacacagaaggcugcccucagcgagggcguuuaccgcauuaugcagcggggccuguucgggaaaacccaagugggagucggcauccacauggaagggguguuucacacaauguggcauguuaccagaggauccgugaucugucacgagacgggccgccuugaaccuucuugggcggauguccggaacgacaugauuagcuaugggggaggcuggagacugggcgauaagugggacaaagaggaggacgugcagguucucgcuaucgaacccgggaagaauccgaagcaugugcagaccaaaccuggacuguucaagacacucaccggcgagauuggggccgucacacuggauuucaaacccggaaccuccggcagcccuaucauuaaccgcaaggggaaagugaucggccuuuacggaaauggcguggucacaaagucuggggacuauguuuccgccaucacgcaggcugaacggauuggagagcccgauuacgagguggacgaagauaucuuucgcaagaagcggcugaccauuauggaccugcaccccggcgccgggaagacaaaacgcauccucccuagcauugugagagaggcgcugaagcggcgccuuagaacccugauccucgcuccgacccgggucguggccgccgaaauggaggaagcucugagaggacuccccauucgcuaucaaaccccugccguuaaaucugagcauacgggccgggagaucguggaucugaugugccacgcuaccuucacaaccagacuucuguccagcacacgcguccccaacuacaaucugaucgugauggacgaagcccacuuuaccgauccuuccucuguugcggcccggggguacauuagcacgagaguggagaugggcgaagcugccgcuaucuucaugacagccacacccccuggagccaccgacccguuuccccaguccaacagcccuauugaggauaucgaacgcgagauucccgagcggucuuggaauacaggcuucgacuggaucaccgacuaucaggggaagacagucugguuugugccuuccaucaaagcuggaaacgauauugcgaauugccucagaaagagcggcaagaaagucauccaacugucucgcaagaccuucgacacggaauaccccaaaacaaaacuuaccgauugggacuuugugguuacaaccgauauuagcgagaugggggccaacuucagagcuggacgggugaucgacccgcgcagaugucugaaaccugugauucucacggauggccccgaacgggucauccuggccgggcccaucccuguuacccccgccuccgcugcccagcgcagaggccggauuggaagaaacccugcgcaggaggacgaucaguauguguuuucuggcgacccgcugaagaaugaugaagaccaugcucacuggacagaggccaagaugcuccuugauaacaucuacacccccgaggggauuaucccuacacuguucggacccgaacgcgagaaaacccaagccauugacggcgaguuccggcugagaggggagcagcgcaagacauuuguggagcucaugcggagaggagaccugccugucuggcuuagcuauaaaguggcuuccgccggcaucucuuacaaggaucgggaauggugcuucaccggcgagcgcaauaaccagauucuggaagagaauauggaaguugagaucuggacgagagagggggagaagaagaagcuccggccccgcuggcuggacgcgagaguguaugccgauccgauggcucugaaagacuuuaaggaguucgccagcggacggaaauccaucacacucgauauucuuaccgaaaucgcuagccugccuaccuaccugucuucccgcgccaagcucgcucuggacaacauugucaugcuucauacaaccgagagaggcgggcgggccuaccagcacgcgcugaaugaacuccccgagagccuggagacacugaugcucguggcccuucugggagcuaugacggccggcaucuuucuguucuuuaugcaagggaaaggaauuggcaagcucuccaugggccugaucaccaucgcugucgccucugggcuucuguggguggccgaaauucagccucaguggaucgcugcgagcauuauccucgaguucuuucugaugguucugcucauucccgaaccugagaagcagcgcacaccccaagauaaccagcuuaucuaugugauccugaccauucugacaaucauuggacucaucgccgcuaaugaaaugggccugauugagaaaaccaagacggacuucggguuuuaccaggucaaaaccgagacaaccauccuugauguggaccugagaccggccuccgccuggacacucuaugcuguugccaccacgauucugacaccuaugcugcggcacaccaucgaaaacacaucugcgaaucucagccuugccgcuaucgccaaccaggcugccgugcugaugggacugggcaagggguggccccuccauagaauggaucugggagucccccuucuggcgaugggcuguuacucccaagugaauccuaccacccucacagccagccuggugaugcugcucguucacuaugcuauuaucggcccggggcuucaggccaaagcuacgcgcgaggcccagaagcggaccgcugccggaauuaugaaaaaccccacagucgacggcaucaccgugauugaucuggaaccuaucucuuacgaccccaaguucgagaagcaacugggacaggugaugcuccugguccuuugcgcgggacagcugcuccugaugagaacaaccugggccuuuugugagguucugacgcucgcuacaggcccuauccuuacccugugggaagggaaucccggacgcuucuggaacaccacaauugccguguccaccgcuaacaucuuccggggcagcuaucuggccggcgccgggcucgcguuuucucugauuaaaaaugcucagacaccuagacgcggaacgggcaccacaggggagacccuuggagaaaaguggaaacggcaacugaacucccucgacagaaaggaguucgaagaguacaaacgcagcggcauccuggagguggaucggacagaagccaagucugcucugaaggacgggagcaaaauuaagcaugccgucuccagaggaucuagcaaaauccgcuggaucguggagcggggcaugguuaagccgaaaggcaagguggucgaucucgggugcggaagaggcgggugguccuacuauauggccacccuuaagaaugugacggaaguuaaaggauacaccaagggcgggcccggacacgaggaaccuauucccauggcuacauauggcuggaaccuggugaaacugcauagcggcgucgacguguuuuacaagccuaccgaacagguggauacacuccugugugacaucggggaguccucuagcaaucccaccauugaagagggacgcacacuuagaguccugaaaaugguugaaccguggcucuccucuaagccugaguucugcaucaaggugcugaaccccuauaugcccaccgugauugaggaacuggagaaacuccagcggaagcacggcgggaaucuuguccgcuguccucugagcagaaacuccacgcacgaaauguacugggugucuggagccagcggcaauaucguuuccagcgugaacacaaccucuaaaaugcugcucaaucgguuuaccacaagacaucggaagcccacguaugagaaagaugucgaccugggggcgggaacccgcuccgugagcacagaaaccgagaagccugauaugacaauuaucggcagacggcuucagcgccugcaagaggaacacaaagagaccuggcauuacgaccaggaaaacccguacagaacaugggccuaucacggcucuuacgaggcucccuccaccgggagcgccucuuccaugguuaauggaguggucaagcuccugacgaagccuugggaugugauccccaugguuacccagcuggcuaugacagacaccacaccuuucggccagcaacggguguuuaaagaaaaggucgacacccgcacgccccagagcaaaccggggacaagaauggugaugaccacaaccgccaacuggcucugggcgcugcuuggaaagaaaaagaauccucggcugugcacgcgcgaggaguucauuuccaaggucagaagcaacgccgcuaucggcgccguguuucaggaggaacaaggguggaccucugcuagcgaagccguuaaugauucccgguucugggagcucguggacaaagaacgcgcucugcaccaggagggcaagugugagucuugcgucuauaacaugaugggaaaaagagaaaagaaacuuggcgaguuugggcgggccaagggaagccgcgcgauuugguacauguggcugggcgccagauuccucgaauuugaggcucugggguuccugaacgaagaucauugguucggacgggaaaauuccuggucuggcguggagggggaaggccuccacagacugggauauauccuugaggaaauugacaagaaagauggcgaccugauguacgccgaugacacagcugggugggauacccgcaucacagaggacgaucuccagaacgaggaacugaucaccgagcagauggcgccccaucacaagauucuugccaaagcgaucuuuaagcugacauaucaaaauaaagugguuaaggugcuccggccuacccccagaggagcugucauggacauuaucagccgcaaggaucagcggggcuccggacaggugggaacguacggccugaacacauucaccaauauggaaguucagcugauuagacaaauggaggccgaaggggugaucacccaggacgacaugcagaacccuaaaggccucaaggagcgcgucgagaaauggcugcgggaaugcggaguggauagacuuaagcgcauggccaucucuggcgacgauugugucgugaaaccccuggacgagcgguuugcuacaagccuccuguuccuuaaugauauggggaagguuagaaaagacauuccgcagugggaaccuuccaagggauggaagaacuggcaagaggugcccuuuugcagccaucacuuccacaaaaucuuuaugaaggauggccgcucucuggucgugcccugucggaaucaggacgaacucauugggagagcccggaucucccagggagcuggcuggagccugagagagaccgccugccuggggaaagcguacgcccagauguggucucucauguauuuccaucgccgggaucugagacuugcuuccauggccauuuguagcgcuguuccuacagagugguuuccgacgucccgcaccacauggucuauccacgcccaucaccaauggaugaccacagaagacaugcugaagguguggaacagagucuggaucgaggauaaucccaacaugauugacaaaaccccugugcacagcugggaagacauccccuaccucggcaagcgggaggaucuguggugcggaucccuuauuggccugagcucucgcgcgacgugggccaagaauauccauaccgcuauuacacaggugagaaaccucaucgggaaagaagaguauguugacuacaugccugucaugaagcgguauuccgcccccagcgagaaugaaggagugcuguga

SEQ ID NO: 21004 - RNA, 9867 nt, Artificial Sequence
  derived and/or modified CDS sequence (opt5) from DENV-4__FJ639764__SS-prME
agcaccaucacccugcucugccugauucccacggugauggccuuccaccuuuccaccagagacggcgagccucugaugaucgucgcuaagcaugaacgggggagaccgcuccuguuuaagaccaccgagggaaccaacaaguguacccuuauugccauggaucugggcgaaaugugcgaggacacaguuaccuacaaauguccccuccuggugaauacggaaccugaggauaucgacugcugguguaaccugaccucuacaugggugauguaugggaccugcacacagagcggagagagacggcgcgaaaagagauccgucgcgcucacaccccacucuggcauggggcuggagacgcgggcugaaacauggaugagcuccgagggagccuggaaacaugcccaacgcguggagucuuggauucuuagaaauccuggcuucgcucugcucgccggcuuuauggcuuacaugaucgggcagaccggaauccagcggacaguuuucuuugugcugaugaugcuugucgcccccagcuauggcaugcgcuguguggggguuggaaacagagauuucguggaaggcgucuccgggggagcguggguggaccuggugcucgagcacggcggcugcgucaccaccauggcccaggggaagccuacacuggauuuugaacugacgaagaccacagcuaaagagguugcccuccugcggaccuacuguauugaagcucuuaucagcaauauuacaaccgccacgcgcugcccgacacaaggagagcccuaucugaaggaggaacaggaccagcaguacaucuguagacgggaugugguggaccgcggcugggggaacggaugcggccucuucgggaaaggaggcgucgugaccugcgcgaaguuuucuuguuccggcaaaauuaccgggaaucugguucaaaucgagaaccuugaauauacaguggucgugaccguucauaauggagauacacacgccgugggcaacgacacgagcaaucacggggucaccgcuacaauuaccccuagaucucccuccguggaggucaagcugccugauuacggagaacucacacuggacugcgagccccggagcggcaucgacuucaacgagaugauccugaugaagaugaaaaagaaaaccuggcucgugcauaagcagugguuucuggaucuuccgcugccuuggacggccggggcugacaccucugaaguucacuggaauuacaaagagagaauggugacauucaaggucccccaugccaaacgccaggaugugaccguucucggcucccaggaaggagccaugcacagcgcucuggcgggcgccacagagguggacuccggggauggaaaccacauguuugcuggccaucuuaaguguaagguccggauggaaaaacugagaauuaaggggaugucuuauaccaugugcagcggaaaauucuccaucgacaaggagauggccgagacgcaacacggcacaaccguggugaaaguuaaguacgaaggggccggcgcuccuuguaagguccccauugagauccgcgaugugaauaaagaaaagguggucggacgggugauuagcucuacaccccucgccgagaacaccaacuccguuaccaauaucgagcuggaaccuccguucggcgacagcuauaucgugauuggggucggaaacucugcgcugacacuccauugguuuagaaaaggcagcuccaucgggaagauguucgagucuacguaccgcggagcuaaacggauggccauucugggcgaaaccgccugggauuuugggagcgugggcggacuuuucacaucccugggcaaggcuguucaccagguguuugggagcgucuauaccacaauguucggaggcgugucuuggaugauccgcauucucaucggguuucugguucuguggaucggaaccaauuccagaaacacgagcauggccaugacaugcauugcugugggcgggaucacccuuuuccucggcuuuaccguccaggccgacaugggauguguggugucuugguccggccgggagcugaagugcgggagcggaauuuucgucguugauaaugugcauacauggaucgaacaauacaaauuucagcccgaguccccugcgagacuggccucugcuauucucaacgcccacaaggacggcgugugugggauccgcagcaccacacggcuggagaaugucauguggaaacagauuacgaacgaacuuaauuaugugcugugggagggaggccacgaccucaccguuguggcuggcgaugucaagggggugcugacaaaaggaaagagaacccugacacccccuguuuccgaccuuaaguacucuuggaaaaccuggggcaaggccaaaaucuucacgcccgaagcgcggaacagcaccuuucucaucgaugggccggacacauccgagugcccuaaugaacgcagagccuggaacagccuggagguggaggauuacggauucggcauguucaccacaaauauuuggaugaaguuucgggaagggucuuccgaggucugugaccauagacugaugagcgcugccaucaaagaucagaaggcugugcacgccgacaugggauauuggauugaaucuuccaaaaaccaaaccuggcagaucgagcgcgccagccucauugaaguuaagacaugccuguggcccaagacccauacgcuuuggucuaauggcgugcuggagagccagaugcucaucccuaaauccuacgcuggccccuucagccagcacaacuaucggcaaggguacgcgacacagaccgucggaccuuggcaccugggcaagcuggagaucgauuuuggggaaugccccggaaccacagugaccauucaggaggacugugaucauagaggcccgucucuucgcacgacaaccgccuccgggaaacucgugacacaguggugcuguagaagcugcaccaugccuccccugcgguuccugggagaagacggcuguugguauggcauggagauccgcccccucuccgagaaggaagagaacauggucaaaucucaaguuacagcugggcagggaaccagcgaaacguuuuccaugggccugcuuugccugacccucuucguggaggaaugucugagacggcgcgugacaagaaagcacaugauucuggccgucgugaucacccuuugcgccauuauccucgggggacugacauggauggaucugcuccgggcucugaucaugcuuggcgacaccaugucugggcgcauuggaggccagacgcaucuggccaucauggcgguuuuuaagaugagcccuggcuacgugcucggggucuuccugagacggcugacaucccgcgagaccgcucuuauggugauuggaauggccaugacaaccacccugucuaucccgcacgaccucauggagcugauugauggcaucagccucgggcugauccuucugaaaauuguuacacaguuugacaauacgcaagugggaacccucgcccugucccugacauucaucagaagcaccaugucucuugucauggcuuggcggacaauuauggccgugcuguuugucgugacccucaucccccuguguagaacguccugccuccagaagcagagccauuggguugaaauuacagcgcugauccuuggcgcucaagcccugccuguguaucucaugacccugaugaaaggggccucucgccgguccuggccccugaacgagggaauuauggcugucggccuugugagccugcucggcucugcccugcucaagaaugauguuccucuggcugggcccaugguggccggaggccuucugcuggcggccuacgucauguccgggagcuccgcugaccucagccuggaaaaagccgcuaacgugcagugggaugagauggccgacaucaccggaucuagcccuaucauugaagugaagcaggaugaggacggcuccuucucuaucagagauguugaggaaacaaauaugauuacccuucuggucaagcucgcccugaucacagugagcgggcucuacccccuggcuauuccggugacgaugacccuuugguauauguggcaggucaaaacacaacgcuccggagcgcugugggacgugccuucucccgccgcuacccagaaggccgcccugagcgagggcguuuaccggaucaugcagagaggccucuuugggaaaacacaggugggagucggcauccacauggaagggguguuccacaccauguggcauguuacgcgcggauccgugauuugucacgagaccggccggcuggaaccuucuugggcugaugucagaaacgacaugaucagcuaugggggaggcuggcgccuuggcgauaagugggacaaagaggaggacgugcaaguucuggccguggaacccgggaagaauccgaagcauguccagacaaaaccuggacucuucaagaccauuacaggcgagaucggggcggugacccuggauuuuaaacccggaacauccggcagcccuauuaucaaccggaaggggaaagugaucggccucuacggaaauggcgucguuacgaagucuggggacuauguguccgcuauuacccaggccgaaagaaucggagagcccgauuacgagguggacgaagauauuuuccggaaaaagcgccugacaaucauggaccuucaccccggcgccgggaagaccaaacgcauucugccuagcaucguccgggaggcucugaagcgcagacuccggacccugauucuugccccgacaagagugguugcggcugaaauggaggaagcccugcgcggacuccccauccgguaucagacgccugccgugaaaucugagcauaccggcagagagaucgucgaucugaugugccacgcuacauuuaccacacgccuccuguccagcacccgggugcccaacuacaaucuuauuguuauggacgaagcccacuucacggauccuuccucuguggcugccagaggguacaucagcacacgcgucgagaugggcgaagcggccgcuauuuuuaugaccgccacacccccuggagcuacagacccguucccccaauccaacagcccuaucgaggauauugaacgggagauccccgagagaucuuggaauaccggcuuugacuggaucacagacuaucaggggaagaccgugugguucgucccuuccauuaaagccggaaacgauaucgccaauugccugcgcaagagcggcaagaaagugauucagcugucuagaaagacguuugacacagaauaccccaaaaccaagcucacagauugggacuucguugugaccacggauaucagcgagaugggggcuaacuuucgggcgggacgcgugauugacccgagacggugucugaaaccugucauccuuaccgauggccccgaacgcguuauccuggccgggcccauuccugugacacccgcuuccgccgcccaaagacggggcagaaucggacgcaacccugcucaggaggacgaucaguauguguucucuggcgacccgcucaagaaugaugaagaccaugcccacuggaccgaggcgaagaugcugcuggauaacauuuacacacccgaggggaucauuccuacccucuucggacccgaacgggagaaaacacaggcuaucgacggcgaauuuagacuucgcggggagcaacggaagaccuucgucgagcugaugagacggggagaccugccuguguggcucagcuauaaaguugccuccgccggcauuucuuacaaggaucgcgaauggugcuuuacgggcgagagaaauaaccagauccuggaagagaauauggaaguggagaucuggacacgggagggggagaagaagaaacuucgccccagauggcuggacgcucgggucuaugccgauccgauggcgcucaaagacuucaaggaguuugccagcggacgcaaauccauuacccuggauauccugaccgaaauugcuagccucccuacauaccuuucuuccagagccaagcuggcucuggacaacaucgugaugcuccauaccacagagcggggcgggcgcgccuaccagcacgcucugaaugaacuucccgagagccuggagacgcucaugcuggucgcccugcucggagcgaugaccgccggcauuuuccucuuuuucaugcaggggaaaggaaucggcaagcuguccaugggccugaucacaauugcuguggccucugggcuccuguggguugcugaaauccaaccucaguggauugccgccagcaucauucuugaguuuuuccugauggugcuccugauccccgaaccugagaagcagagaacaccccaggauaaccaacugaucuaugucauucucacaauccuuaccauuaucggacugauugcugcgaaugaaaugggccugaucgagaaaacgaagaccgacuuuggguucuaccaggugaaaacagagaccacaauucucgauguugaccugcggccggccuccgcuuggacccuuuaugccguggccacgacaauccugaccccuaugcucagacacacaaucgaaaacaccucugcuaaucugagccuggccgcgauugccaaccaggcugccguccucaugggacuuggcaagggguggccccugcaucgcauggaucugggagugccccuccuggcuaugggcuguuacucccaggugaauccuaccacacuuacggccagccugguuaugcuccugguccacuaugcgaucauuggcccggggcugcaagccaaagcuacccgggaggcccagaagagaacagcugccggaaucaugaaaaaccccaccguggacggcauuacagugaucgaucucgaaccuaucucuuacgaccccaaguuugagaagcagcuugggcaagucaugcugcugguucucugcgcuggacagcugcuucugaugcgcaccacgugggccuucugugaggugcucacacuggcgaccggcccuauucugacccucugggaagggaaucccggacgguucuggaacacaaccaucgccguguccacagcuaacauuuuuagaggcagcuaucuugccggcgcugggcuggccuucucucugaucaaaaaugcccagacgccucgccggggaaccggcacaaccggggagacacucggagaaaaguggaaaagacagcugaacucccuugaccgcaaggaguuugaagaguacaaacggagcggcauucuggaggucgauagaaccgaagcgaagucugcucucaaggacgggagcaaaaucaagcaugccgugucccgcggaucuagcaaaauccgguggauuguugagagaggcauggugaagccgaaaggcaaggucguggaucuggggugcggacgcggcgggugguccuacuauauggcuacgcugaagaauguuaccgaagugaaaggauacacaaagggcgggcccggacacgaggaaccuauccccauggccaccuauggcuggaaccucgucaaacuucauagcggcguggacguguucuacaagccuacagagcaagucgauacccugcugugugacauuggggaguccucuagcaaucccacaaucgaagagggaagaacccuccggguucugaaaaugguggaaccguggcuuuccucuaagccugaguuuugcauuaaggugcugaaccccuauaugcccacggucaucgaagaacuugagaaacugcagcgcaagcacggcgggaaucuggugagauguccucucagccggaacuccacacacgaaauguacuggguuucuggagccagcggcaauauuguguccagcgucaacaccaccucuaaaaugcuucugaauagauucacaacgcggcaucgcaagcccaccuaugagaaagauguggaccugggggcuggaacaagauccguuagcaccgaaacagagaagccugauaugaccaucaucggccggcgccuccagagacugcaggaggaacacaaagagacauggcauuacgaccaagaaaacccguaccggaccugggccuaucacggcucuuacgaggcgcccuccacggggagcgccucuuccauggugaauggagucgugaaacuucugaccaagccuugggauguuauucccauggugacacagcucgcuaugaccgacacaaccccuuuuggccagcagcgcgucuucaaagaaaagguggacacgagaacaccccaaccgaaaccugggacccggauggucaugacaaccacggccaacuggcugugggcucugcucggaaagaaaaagaauccccgccugugcaccagagaggaguuuaucagcaaggugcgguccaacgccgcgauuggcgccguuuuccaggaagaacagggguggacaagcgcuucugaagccgugaaugauagccgcuuuugggagcuugucgacaaagaaagagcucugcaccaagagggcaagugugaguccugcguguauaacaugaugggaaaacgggaaaagaaacucggcgaguucgggcgcgccaagggaucuagagcuaucugguacauguggcugggcgcccgguuucuugaguucgaggcgcugggguuccucaacgaagaucauugguuuggaagagagaauagcugguccggcguggagggggaaggccugcaccgccugggauauauucucgaggaaaucgacaagaaagauggcgaccugauguacgccgaugacaccgcugggugggauacacggaucaccgaggacgaucuucagaacgaggaacugauuacagagcagauggccccucaucacaagauccucgcuaaagccauuuucaagcugaccuaucagaauaaaguugugaagguccuuagacccacgccucgcggagccgugauggacaucauuucucggaaggaucaaagaggcagcgggcagguuggaacauacggccugaacaccuuuaccaauauggaagugcagcucauccgccagauggaggcggaaggggucaucacacaagacgacaugcagaaccccaaaggccugaaggagcggguggagaaauggcugagagaaugcggagucgaucgccucaagcggauggcuauuuccggcgacgauugugugguuaaaccgcuggacgagagauucgggaccucucuucuguuucucaaugauaugggaaaggugcgcaaagacaucccucagugggaacccagcaagggcuggaagaacuggcaggagguccccuucugcucccaucacuuucacaaaauuuucaugaaggaugggcggagccuggugguuccuuguagaaaucaagacgaacuuaucggacgggccagaauuucucagggcgccggguggucccugcgcgagacagcuugccucggcaaagccuacgcucagauguggagccugauguauuuucaucggagagaucugcgccucgccucuauggcgaucuguuccgccgugccgacggagugguuccccaccagcagaacaaccugguccauccacgcucaucaccaguggaugacaaccgaagacaugcugaaggucuggaaccggguguggauugaggauaauccuaacaugaucgacaaaacgcccgugcacucuugggaagacauuccuuaccuuggaaagcgcgaggaucuguggugcggcagccucaucgggcuguccagcagagccaccugggcuaagaauauucauacagccaucacccaaguucggaaccuuauuggaaaagaagaguaugucgacuacaugcccgugaugaagcgcuauucugcgccuuccgagagcgaaggcgugcuguga

SEQ ID NO: 21005 - RNA, 9867 nt, Artificial Sequence
  derived and/or modified CDS sequence (opt5) from DENV-4__FJ639773__SS-prME
agcaccaucacccugcucugccugauucccacggugauggccuuccaccuuuccaccagagacggagaaccucugaugaucgucgcuaagcaugaacgggggagaccgcuccuguuuaagacaaccgaaggaauuaacaaguguacacuuaucgccauggaucugggagaaaugugcgaggacaccguuacauacaaguguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaagacugcgcaucaaagggaugucuuauaccaugugcagcggaaaguucuccauugacaaagagauggcugagacgcaacacggcacaaccguggugaagguuaaauacgaaggggccggcgccccuuguaagguccccaucgagauucgggaugugaauaaggaaaaaguggucggaagagugaucagcgcuacaccccucgccgagaacaccaacucuguuaccaauaucgagcuggaaccuccguucggcgacuccuauauugugaucggggucggaaacagcgcgcugacacuccauugguuucgcaagggcucuagcauugggaaaauguucgaguccacguaccggggagcuaagagaauggccauccugggcgaaaccgccugggauuuugggucugugggcggacuuuucacaagccugggcaaagcuguucaccagguguuuggguccgucuauaccacaauguucggaggcgugagcuggaugauucgcauccucaucggguuucugguucuguggauuggaaccaauucucggaacacguccauggccaugacaugcaucgcugugggcgggauuacccuuuuccucggcuuuaccguccaggccgacaugggauguguggugagcuggucuggcagagagcugaagugcggguccggaaucuucgucguugauaaugugcauacauggaccgaacaauacaaguuucagcccgagagcccugcgcgccuggccuccgcuauucucaacgcccacaaagacggcgugugugggauccggucuacaacgagacuggagaaugucauguggaagcagauuaccaacgaacuuaauuaugugcugugggagggaggccacgaccucacaguuguggcuggcgaugucaaaggggugcugaccaagggaaaacgggcccugacacccccugcgagcgaccuuaaguacuccuggaagaccuggggcaaagccaagaucuucacgcccgaagcucgcaacucuaccuuucucaucgaugggccggacacaagcgagugcccuaaugaaagacgggccuggaacuccuucgagguugaggauuacggauucggcauguuuaccacaaauauuuggaugaaauucagagaagggagcucugaggugugugaccaucgccugauguccgcugccaucaaggaucagaaagccguccacgcugacaugggauauuggauugaaagcucuaagaaccaaaccuggcagaucgagcgggcgucccugauugaagugaaaacaugccucuggcccaagacccauacgcuguggagcaauggcguucuugagucucagaugcugaucccuaagagcuacgccggccccuuuucccagcacaacuauagacaaggguacgcuacacagaccgugggaccuuggcaccucggcaaacuggagaucgauuucggggaaugccccggaaccacagucaccauucaggaggacugugaucaucgcggcccgagccugagaacgacaaccgccucugggaaacuugugacacaguggugcugucgguccugcaccaugccuccccuccgcuuucugggagaagacggcuguugguauggcauggagaucagaccccugagcgagaaagaagagaacauggugaagucccaagucacagccgggcagggaaccucugaaacguucagcaugggccuccugugccuuacccuguuuguugaggaaugucuccggcgcagagugacacggaaacacaugauucuggcuguggucaucacccugugcgccauuauccuugggggacucacauggauggaucugcugcgcgcgcucaucaugcugggcgacaccauguccgggagaauuggaggccagacgcaucuugcuaucauggccguguucaagaugucuccuggcuacguucuggggguguuucuccggaagcugacaagccgcgagaccgcccugauggucauuggaauggcuaugacaaccacccuuuccaucccgcacgaccugauggagcucauugauggcaucucucuggggcucauccugcuuaaaauugugacacaguucgacaauacgcaaguuggaacccuggcccucagccugacauuuaucagauccaccaugagccuggugauggcguggcggacaauuauggcuguccuuuucguggucacccugaucccccucuguagaacgucuugccugcagaagcagucccauuggguggaaauuacagcccucauccugggcgcccaagcccuuccuguuuaucugaugacccucaugaaaggggccagccgccggucuuggccccugaacgagggaauuauggcugugggccuggucucccuucugggcagcgcccuccugaagaaugaugugccucucgcggggcccaugguugccggaggccugcuucuggcugccuacgugaugucuggguccagcgcugaccugucccucgaaaaagccgccaacguccagugggaugagauggcugacaucaccggaagcucuccuaucauugaagugaagcaggaugaggacggcagcuuuuccaucagagauguggaggaaacaaauaugauuacccugcuuguuaagcuggcgcucaucacagucucugggcuguacccccucgccauuccggugacgaugacccugugguauauguggcaagugaaaacacaacgcagcggagcucuuugggacgucccuucccccgccaccacacagaaggccgcucugucugagggcguguaccggaucaugcagagaggccuguucgggaaaacccagguuggagugggcauccacauggaaggggucuuccacacgauguggcaugugacccgcggaagcguuauuugucacgagacaggccggcucgaaccuuccugggccgaugugagaaacgacaugaucucuuaugggggaggcuggcgccugggcgauaagugggacaaagaggaggacguccaagugcuugcgauugaacccgggaagaauccgaagcauguucagaccaaaccuggacuguuuaagacacucaccggcgagaucggggcugugacacuggauuucaaacccggaacgagcggcuccccuauuaucaaccggaaggggaaagucaucggccucuacggaaauggcguggugaccaagagcggggacuaugucucugccauuacacaggccgaaagaaucggagagcccgauuacgagguugacgaagauauuuuucggaaaaagcgccugaccaucauggaccuucaccccggcgcugggaagaccaaacgcauucugccuuccaucgugcgggaggcccugaagcgcagacuccggacacugauucuugcgccgacgagaguggucgcugccgaaauggaggaagcccugcgcggacuccccauccgguaucagaccccugcugugaaaagcgagcauacaggcagagagaucguugaucugaugugccacgccaccuucacaacccgccuccugucuuccacgcgggugcccaacuacaaucuuauugucauggacgaagcucacuuuacagauccuagcuccguggccgcgagaggguacaucucuacccgcguugagaugggcgaagccgcugccauuuucaugaccgcuacacccccuggagccaccgacccguuuccccaaagcaacuccccuaucgaggauauugaacgggagauccccgagagaagcuggaauacaggcuucgacuggaucaccgacuaucaggggaagacggugugguuugucccuucuauuaaagccggaaacgauaucgcuaauugccugcgcaaguccggcaagaaagugauucagcugagcagaaagacauucgacaccgaauaccccaaaacaaagcucaccgauugggacuuugucgugacgaccgauaucucugagaugggggcgaacuuccgggccggacgcguuauugacccgagacggugucugaaaccugugauccuuacagauggccccgaacgcgugauccuggcugggcccauuccugucacccccgccagcgccgcucaaagacggggcagaaucggacgcaacccugcccaggaggacgaucaguauguuuucuccggcgacccgcucaagaaugaugaagaccaugcgcacuggacagaggcuaagaugcugcuggauaacauuuacacccccgaggggaucauuccuacacucuuuggacccgaacgggagaaaacccaggccaucgacggcgaguucagacuucgcggggagcaacggaagacguuuguggagcugaugagacggggagaccugccuguguggcucucuuauaaagucgccagcgcuggcauuuccuacaaggaucgcgaauggugcuucacaggcgagagaaauaaccagauccuggaagagaauauggaaguggagaucuggacccgggagggggagaagaagaaacuucgccccaaauggcuggacgccagaguuuaugcggauccgauggcccucaaggacuuuaaagaguucgcuucuggaagaaagagcauuacccuggauauccugacagaaauugccucccucccuaccuaccuuagcucucgcgcuaaacuggcccuggacaacaucgugaugcuccauacaacggagagaggcgggcgggcuuaccagcacgcccugaaugaacuucccgagucccuggagacccucaugcuggucgcgcugcucggagccaugacagcuggcauuuuucuuuucuuuaugcaggggaagggaaucggcaagcugagcaugggccugaucaccauugccguggcuuccgggcuccugugggucgccgaaauccaaccucaguggauugccgcuucuaucauucuugaguucuuucugauggugcuccugauccccgaaccugagaaacagcgcacaccccaggauaaccaacugaucuauguuauucucaccauccuuacgauuaucggacugauugcggccaaugaaaugggccugaucgagaagaccaaaacagacuucggguuuuaccaggagaagaccgaaacaaccauucucgauguggaccugagaccggcuagcgccuggacgcuuuaugccgucgcuacaaccauccugacaccuaugcuccggcacaccaucgagaacaccuccgccaaucugucucuggcggccauugcuaaccaggccgcugugcucaugggacuuggcaaaggguggccccugcauagaauggaucugggaguuccccuccuggccaugggcuguuacagccaggugaauccuacaacgcuuaccgcgucccuggucaugcuccuggugcacuaugccaucauuggcccggggcugcaagcuaaggccacacgcgaagcucagaaacggaccgccgcuggaaucaugaagaaccccacaguggacggcauuaccguuaucgaucucgagccuaucagcuacgaccccaaguucgagaaacagcuugggcaagucaugcugcuggugcucugcgccggacagcugcuucugaugagaacgacaugggcguucugugaagugcucacccuggccaccggcccuauucugacacucugggaggggaaucccggacgcuuuuggaacaccacaaucgcugucucuacggccaacauuuuccggggcuccuaucuugcuggcgccgggcuggccuuuagccugaucaagaaugcgcagaccccuagacgcggaacaggcaccacaggggaaacccucggagagaaauggaagcggcagcugaacucucuugacagaaaagaguucgaggaguacaagcgcuccggcauucuggaaguugaucggacggaggcuaagagcgcccucaaagacgggucuaagaucaaacaugcugugagcagaggauccucuaagauccgcuggauuguggaacggggcauggucaaaccgaagggcaaggugguugaucuggggugcggaagaggcggguggagcuacuauauggccacccugaaaaaugugacagaggucaagggauacaccaaaggcgggcccggacacgaagaaccuauccccauggccacauauggcuggaaccucgugaaacuucauuccggcguugacguguuuuacaaaccuaccgagcaagucgauacacugcugugugacauuggggaaagcuccucuaaucccaccaucgaggaaggacgcacgcucagagugcugaagaugguggagccguggcuuagcuccaagccugaguucugcauuaaaguccugaaccccuauaugcccacaguuaucgaggagcucgaaaagcugcagcggaaacacggcgggaaucuggugcgcuguccucucucuagaaacagcacccacgagauguacuggguguccggagcuucuggcaauauugucagcuccgugaacaccacaagcaagaugcuucugaaucgguuuacgaccagacaucggaaacccacauaugaaaaggauguugaccugggggccggaacccgcucuguguccacagagaccgagaaaccugauaugacaaucaucggcagacggcuccagcgccugcaggaagaacacaaggaaaccuggcauuacgaccaagagaacccguacagaacgugggcguaucacggcagcuacgaagcccccucuaccggguccgcuagcucuauggucaauggagugguuaaacuucugacaaaaccuugggaugugauucccauggucacccagcucgccaugacagacaccacgccuuucggccagcagcggguguuuaaggagaaaguugacacacgcacaccccagccgaagccugggacaagaauggugaugaccacgaccgcuaacuggcugugggcccugcucggcaagaagaagaauccccggcugugcacacgcgaggaguucaucuccaaagucagaagcaacgcggccauuggcgcuguguuucaggaggaacagggguggaccuccgccagcgaggcugucaaugauucucgguucugggaacuuguggacaaggagcgcgcccugcaccaagagggcaaaugugaaagcugcguuuauaacaugaugggaaagagagagaaaaagcucggcgaauuugggcgggcuaagggaucccgcgccaucugguacauguggcugggcgcgagauuccuugaguucgaagcccugggguuucucaacgaggaucauugguucggacgggaaaauucuuggagcggcguggaaggggagggccugcacagacugggauauauucucgaagagaucgacaaaaaggauggcgaccugauguacgcugaugacacagccgggugggauacccgcaucacagaggacgaucuucagaacgaggaacugauuaccgaacagauggcuccucaucacaaaauccucgccaaggccauuuuuaaacugacguaucagaauaaggucgugaaggugcuucggcccacaccuagaggagcgguuauggacaucauuucccgcaaagaucaacggggcucuggacaggugggaaccuacggccugaacaccuucacaaauauggagguccagcucaucagacagauggaagcugagggggugaucacccaagacgacaugcagaaccccaagggccugaaagagcgcguugaaaaguggcugcgggagugcggaguggauagacucaaacgcauggccauuagcggcgacgauugugucgugaagccgcuggacgaacgguuugggacaucccuucuguuccucaaugauaugggaaaagucagaaaggacaucccucagugggagcccucuaagggcuggaaaaacuggcaggaagugcccuuuugcagccaucacuuccacaagauuuuuaugaaagaugggcgcucccugguugugccuugucggaaucaagacgagcuuaucgggcgggcucggauuagccagggcgcuggguggucucugagagagacggccugccucggcaaggcuuacgcccagauguggucccugauguauuuccaucgccgggaucugagacucgcgagcauggccaucuguucugcugucccgaccgaaugguuucccacaucccgcaccacauggagcauccacgcccaucaccaguggaugaccacggaggacaugcugaaaguguggaacagaguuuggauugaagauaauccuaacaugaucgacaagacccccgugcacuccugggaggacauuccuuaccuuggaaagcgggaagaucuguggugcggcucucucaucgggcugagcucccgcgcuacaugggccaaaaauauucauaccgcgaucacacaagucagaaaccuuauuggaaaggaggaguauguggacuacaugcccgugaugaaacgguauagcgccccuucugaauccgagggcguucuguga

SEQ ID NO: 21006 - RNA, 9867 nt, Artificial Sequence
  derived and/or modified CDS sequence (opt5) from DENV-4__FJ882580__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaacggguggucggaagagugaucagcgcuacaccccucgccgagaacaccaacucuguuaccaauaucgagcuggaaccuccguucggcgacuccuauauugugaucggggucggaaacagcgcgcugacacuccauugguuucgcaagggcucuagcauugggaaaauguucgaguccacguaccggggagcuaagagaauggccauccugggcgaaaccgccugggauuuugggucugugggcggacuuuucacaagccugggcaaagcuguucaccagguguuuggguccgucuauaccacaauguucggaggcgugagcuggaugauucgcauccucaucggguuucugguucuguggauuggaaccaauucucggaacacguccauggccaugacaugcaucgcugugggcgggauuacccuuuuccucggcuuuaccguccaggccgacaugggauguguggugagcuggucuggcagagagcugaagugcggguccggaaucuucgucguugauaaugugcauacauggaccgaacaauacaaguuucagcccgagagcccugcgcgccuggccuccgcuauucucaacgcccacaaagacggcgugugugggauccggucuacaacgagacuggagaaugucauguggaagcagauuaccaacgaacuuaauuaugugcugugggagggaggccacgaccucacaaucguugcuggcgaugugaaagggguccugaccaagggaaaacgggcccugacacccccugcgagcgaccuuaaguacuccuggaagaccuggggcaaagccaagaucuucacgcccgaagcucgcaacucuaccuuucucauugaugggccggacacaagcgagugcccuaaugaaagacgggccuggaacuccuucgagguggaggauuacggauucggcauguuuaccacaaauaucuggaugaaauucagagaagggagcucugagguuugugaccaucgccugauguccgcugccauuaaggaucagaaagccgugcacgcugacaugggauauuggaucgaaagcucuaagaaccaaaccuggcagauugagcgggcgucccugaucgaagucaaaacaugccucuggcccaagacccauacgcuguggagcaauggcgugcuugagucucagaugcugaucccuaagagcuacgccggccccuuuucccagcacaacuauagacaaggguacgcuacacagaccguuggaccuuggcaccucggcaaacuggagauugauuucggggaaugccccggaaccacagugaccauccaggagaacugugaccaucgcggcccgagccugagaacgacaaccgccucugggaagcuugucacacaguggugcugucgguccugcaccaugccuccccuccgcuuucugggagaagauggcuguugguauggcauggagauuagaccccugagcgagaaagaagagaauauggugaagucccaagugacagccgggcagggaaccucugaaacguucagcaugggccuccugugccuuacccuguuugucgaggaaugucuccggcgcagaguuacacggaaacacaugauccuggcuguggugauuacccugugcgccaucauccuugggggacucacauggauggaccugcugcgcgcgcucauuaugcugggcgauaccauguccgggagaaucggaggccagacgcaucuugcuauuauggccgucuucaagaugucuccuggcuacgugcuggggguuuuucuccggaagcugacaagccgcgagaccgcccugauggugaucggaauggcuaugacaaccacccuuuccauuccgcacgaccugauggagcucaucgacggcaucucucuggggcucauucugcuuaaaaucgucacacaguucgauaacacgcaagugggaacccuggcccucagccugacauuuauuagauccaccaugagccugguuauggcguggcggacaaucauggcugugcuuuucgucgugacccugauuccccucuguagaacgucuugccugcagaagcagucccauugggucgaaaucacagcccucauucugggcgcccaagcucuuccuguguaucugaugacccucaugaaaggggccagccgccggucuuggccccugaaugagggaaucauggcuguuggccuggugucccuucugggcagcgcccuccugaagaacgacgucccucucgcggggcccaugguggccggaggccugcuucuggcugccuacguuaugucuggguccagcgcugaucugucccucgaaaaagccgccaaugugcagugggacgagauggcugauaucaccggaagcucuccuauuaucgaagucaagcaggacgaggauggcagcuuuuccauuagagacguggaggaaacaaacaugaucacccugcuugugaagcuggcgcucauuacaguuucugggcuguacccccucgccaucccgaucacgaugacccugugguauauguggcaggucaaaacacaacgcagcggagcucuuugggaugugccuucccccgccgccacccagaaggcugcccugucugagggcguguaccggauuaugcagagaggccuguucgggaaaacacaggucggagugggcauccacauggaagggguuuuccacaccauguggcaugugacgcgcggaagcgucauuugucacgagaccggccggcucgaaccuuccugggcggacgugagaaaugauaugaucucuuaugggggaggcuggcgccugggcgacaagugggauaaagaggaggacguucaagugcuugcuauugaacccgggaagaacccgaagcauguccagacaaaaccuggacuguuuaagacccucacaggcgagaucggggccgugacccuggacuucaaacccggaacaagcggcuccccuaucauuaaucggaaggggaaaguuaucggccucuacggaaacggcguggucacgaagagcggggauuaugugucugccauuacccaggcugaaagaaucggagagcccgacuacgagguggaugaagacauuuuucggaaaaagcgccugacaaucauggaucuucaccccggcgccgggaagaccaaaagaauucugccuuccaucguccgggaggcgcugaagcgcagacuccggacccugauccuugcuccgacaagaguuguggccgccgaaauggaggaagcucugcgcggacuccccauucgguaucagacgccugccgugaaaagcgagcauaccggcagagagaucgucgaccugaugugccacgcuacauucaccacacgccuccugucuuccacccgggugcccaauuacaaccuuauuguuauggaugaagcccacuuuacggacccuagcuccguggcggccagaggguacaucucuacacgcgucgagaugggcgaagcugccgcuauuuucaugaccgccacccccccuggagccacagauccguuuccccaaagcaauuccccuaucgaggacaucgaacgggagauucccgagagaagcuggaacaccggcuucgauuggaucacagacuaucaggggaagaccgugugguuuguuccuucuauuaaagcuggaaaugacaucgcgaacugccugcgcaaguccggcaagaaagugauucagcugagcagaaagacguucgauacagaauaccccaaaaccaagcucacagacugggauuuugucgugaccacggacaucucugagaugggggccaacuuccgggcuggacgcgucaucgauccgagacggugucugaaaccugugauucuuaccgacggccccgaacgcguuauccuggccgggcccauuccugugacacccgccagcgcugcccaaagacggggcagaaucggacgcaauccugcgcaggaggaugaccaguauguguucuccggcgauccgcucaagaacgacgaagaucaugcucacuggaccgaggccaagaugcugcuggacaauauuuacacacccgaggggaucauuccuacccucuuuggacccgaacgggagaaaacacaggccaucgauggcgaauucagacuucgcggggagcaacggaagaccuuugucgagcugaugagacggggagaccugccuguuuggcucucuuauaaaguggcuagcgccggcaucuccuacaaggaccgcgaauggugcuucacgggcgagagaaacaaucagauucuggaagagaacauggaaguggagaucuggacacgggagggggaaaaaaagaagcuucgccccaaauggcuggaugcgagagucuaugccgacccgauggcucucaaggauuuuaaagaguucgccucuggacggaagagcauuacccuggacauccugaccgaaauugcuucccucccuacauaccuuagcucucgcgccaaacuggcucuggauaauaucgugaugcuccauaccacagagagaggcgggcgggccuaccagcacgcgcugaacgaacuucccgagucccuggagacgcucaugcugguugcccugcucggagcuaugaccgccggcaucuuucuuuucuuuaugcaggggaagggaauuggcaagcugagcaugggccugaucacaauugcuguggccuccgggcuccugugggucgccgaaauccaaccucaguggauugcugcgucuaucauccuugaguucuuucugauggugcuccugauucccgaaccugagaaacagcgcaccccccaggacaaucaacugaucuaugucauucucacaauccuuaccauuaucggacugauugccgcuaacgaaaugggccugaucgagaagacgaaaaccgauuucggguuuuaccaggugaagacagagaccacaauccucgacguugaucugagaccggccagcgccuggacccuuuaugcuguggccacgacaauucugaccccuaugcuccggcacacaaucgaaaauaccuccgcgaaccugucucuggccgcuauugccaaucaggcugccguccucaugggacuuggcaaaggguggccccugcauagaauggaccugggagugccccuccuggcgaugggcuguuacagccagguuaacccuaccacacuuacggccucccuggugaugcuccugguccacuaugcuaucauuggcccggggcugcaagccaaggcuacccgcgaggcccagaaacggacagcugccggaaucaugaagaaucccaccguggauggcaucacagugauugaccucgaaccuaucagcuacgaucccaaguucgagaaacagcuugggcaaguuaugcugcugguccucugcgcgggacagcugcuucugaugagaaccacgugggccuucugugaggugcucacacuggcuaccggcccuauucugacccucugggaagggaaccccggacgcuuuuggaacacaaccaucgccgugucuacagcuaauauuuuccggggcuccuaucuugccggcgccgggcuggcguuuagccugaucaagaacgcucagacgccuagacgcggaaccggcacaaccggggagacacucggagaaaaauggaagcggcagcugaauucucuugacagaaaagaguucgaagaguacaagcgcuccggcauccuggaggucgaccggaccgaagccaagagcgcucucaaagaugggucuaagauuaaacaugccguuagcagaggauccucuaagauccgcuggauuguggagcggggcauggugaaaccgaagggcaaggucguggaccuggggugcggaagaggcggguggagcuacuauauggccacgcugaaaaacguuaccgaagugaagggauacacaaaaggcgggcccggacacgaggaaccuauccccauggcuaccuauggcuggaaucucgucaagcuucauuccggcguggauguuuuuuacaaaccuacagagcaaguggacacccugcugugugauauuggggagagcuccucuaaccccacaaucgaagagggacgcacccucagaguccugaagaugguggaaccguggcuuagcuccaagccugaguucugcauuaaagugcugaaucccuauaugcccacggucaucgaagagcucgagaagcugcagcggaaacacggcgggaaccugguucgcuguccucucucuagaaauagcacacacgaaauguacuggguguccggagccucuggcaacaucgugagcuccgucaauaccaccagcaagaugcuucugaaccgguuuacaacgagacaucggaaacccaccuaugagaaggacguggaucugggggcgggaacacgcucuguuuccaccgaaacagagaaaccugacaugaccauuaucggcagacggcuccagcgccugcaggaggaacacaaggagacauggcauuacgaucaagaaaauccguacagaaccugggccuaucacggcagcuacgaggcucccucuacgggguccgccagcucuauggugaacggagucgugaagcuucugaccaaaccuugggacguuauucccauggugacacagcucgcuaugaccgauacaaccccuuucggccagcagcgggucuuuaaggaaaaaguggacacgcgcacaccccaaccgaagccugggaccagaaugguuaugacaaccacggccaauuggcugugggcgcugcucggaaaaaagaagaacccccggcugugcacccgcgaggaguucaucuccaaagugagaagcaaugccgcuauuggcgccgucuuucaggaagagcagggguggacauccgcuagcgaagccgugaacgacucucgguucugggagcuugucgauaaggaacgcgcucugcaccaagagggcaaaugugagagcugcguguauaacaugaugggaaagagagaaaaaaagcucggcgaguuugggcgggccaagggaucccgcgcgaucugguacauguggcugggcgccagauuccuugaauucgaggcucugggguuucucaaugaagaccauugguucggacgggagaacucuuggagcggcguugagggggaaggccugcacagacugggauauauccucgaggaaauugauaaaaaggacggcgaucugauguacgccgacgauaccgcugggugggacacacgcaucaccgaggaugaccuucagaaugaggaacugauuacagagcagauggccccucaucacaaaauccucgccaaggcgauuuuuaaacugaccuaucagaacaagguggucaaggugcuucggcccacgccuagaggagcugugauggauaucaucucccgcaaagaccaacggggcucugggcagguuggaacauacggccugaauaccuucaccaacauggaagugcagcucauuagacagauggaggccgaaggggucaucacacaagaugacaugcagaaucccaagggccugaaagagcgcguggagaaguggcugcgggaaugcggaguugacagacucaaacgcauggccauuagcggcgaugacuguguggucaagccgcuggaugagcgguuugggaccucccuucuguuccucaacgacaugggaaaagugagaaaggauaucccucagugggaacccucuaagggcuggaaaaauuggcaggagguccccuuuugcagccaucacuuccacaagauuuuuaugaaagacgggcgcucccuggugguuccuugucggaaccaagaugaacuuaucggaagagcucggaucagccagggcgccggguggucucugagagagacagcuugccucggcaaggccuacgcgcagauguggucccugauguauuuccaucgccgggaccugagacucgccagcauggcuauuuguucugccgugccgacggagugguuucccaccucccgcacaaccuggagcauccacgcucaucaccaguggaugacaaccgaagauaugcugaaagucuggaauagaguguggauugaggacaacccuaauaugaucgauaagacgcccguucacuccugggaagacauuccuuaccuuggaaagcgggaggaccuguggugcggcucucucaucgggcugagcucccgcgccaccugggcgaaaaacauucauacagccaucacccaagugagaaaucuuaucggaaaggaagaguaugucgauuacaugcccgugaugaaacgguauagcgcuccuucugaguccgaaggcgugcuguga

SEQ ID NO: 21007 - RNA, 9867 nt, Artificial Sequence
  derived and/or modified CDS sequence (opt5) from DENV-4__FJ882581__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggaauggccgggagcugaagugcgggucuggaaucuucgucguugauaacgugcauacauggaccgaacaauacaaauuucagcccgaguccccugcgagacuggccagcgcuauucucaaugcccacaaggacggcgugugugggauccgcuccacaacgcggcuggagaacgucauguggaaacagauuaccaaugaacuuaacuaugugcugugggagggaggccacgaccucacaguuguggcuggcgaugucaagggggugcugaccaaaggaaagagagcccugacacccccugcgucugaccuuaaguacagcuggaaaaccuggggcaaggccaaaaucuucacgcccgaagcucggaauuccaccuuucucaucgaugggccggacacaucugagugcccuaacgaacgcagagccuggaauagcuucgagguugaggauuacggauucggcauguuuaccacaaacauuuggaugaaguuccgggaaggguccagcgaggugugugaccauagacugaugucugcugccaucaaagaucagaaggccguccacgcugacaugggauauuggauugaauccagcaaaaaucaaaccuggcagaucgagcgcgcgucucugauugaagugaagacaugccucuggcccaagacccauacgcugugguccaacggcguucuugagagccagaugcugaucccuaaaucuuacgccggccccuuuagccagcacaacuaucggcaaggguacgcuacacagaccgugggaccuuggcaccucggcaagcuggagaucgauuucggggaaugccccggaaccacagucaccauucaggagaauugugaccauagaggcccgucccugcgcacgacaaccgccagcgggaaacuugugacacaguggugcuguagaucuugcaccaugccuccccuccgguuucugggagaagauggcuguugguauggcauggagauccgcccccuguccgagaaggaagagaacauggugaaaagccaagucacagccgggcagggaaccuccgaaacguucucuaugggccuccugugccuuacccuguuuguugaggaaugucucagacggcgcgugacaagaaagcacaugauucuggcuguggucaucacccugugcgccauuauccuugggggacucacauggauggaccugcugcgggcgcucaucaugcugggcgauaccaugagcgggcgcauuggaggccagacgcaucuugcuaucauggccguguucaagauguccccuggcuacguucuggggguguuucucagaaaacugacaucucgggagaccgcccugauggucauuggaauggcuaugacaaccacccuuagcaucccgcacgaccugauggagcucauugacggcaucucccuggggcucauccugcuuaagauugugacacaguucgauaauacgcaaguuggaacccuggcccucucucugacauuuauccgcagcaccaugucccuggugauggcguggagaacaauuauggcuguccuuuucguggucacccugaucccccucugucggacgagcugccugcagaaacagucucauuggguggaaauuacagcccucauccugggcgcccaagcucuuccuguuuaucugaugacccucaugaagggggccuccagacgcagcuggccccugaacgagggaauuauggcugugggccuggucucucuucugggcuccgcccuccugaaaaaugacgugccucucgcggggcccaugguugccggaggccugcuucuggcugccuacgugaugagcgggucuuccgcugaucugagccucgaaaaggccgccaacguccagugggacgagauggcugauaucaccggauccagcccuaucauugaagugaagcaggacgaggauggcucuuuuagcauccgggacguggaggaaacaaauaugauuacccugcuuguuaaacuggcgcucaucacagucuccgggcuguacccccucgccauuccgaucacgaugacccugugguauauguggcaggugaagacacaaagaucuggagcucuuugggaugugccuagccccgccgccacccagaaagcugcccuguccgagggcgucuaccgcaucaugcagcggggccuguucgggaagacacaggugggaguuggcauucacauggaagggguguuccacaccauguggcaugucacgagaggaucugugaucugucacgagaccggccgccucgaaccuagcugggcggacguucggaacgauaugauuuccuaugggggaggcuggagacugggcgacaaaugggauaaggaggaggacgugcaaguccuugcuaucgaacccgggaagaauccgaaacaugugcagacaaagccuggacuguuuaaaacccucacaggcgagauuggggccguuacccuggacuucaagcccggaacaucuggcagcccuaucaucaaccgcaaagggaaggugauuggccucuacggaaauggcgucgugacgaaauccggggauuaugugagcgccaucacccaggcugaacggauuggagagcccgacuacgaggucgaugaagacaucuuuagaaagaagcggcugacaauuauggaucuucaccccggcgccgggaaaaccaagcgcauccugccuucuauuguuagagaggcgcugaaacggcgccucagaacccugauccuugcuccgacacgggugguggccgccgaaauggaggaagcucugagaggacuccccauccgcuaucagacgccugccgucaaguccgagcauaccggccgggagauuguggaccugaugugccacgcuacauucaccacaagacuccugagcucuacccgcguucccaacuacaaucuuaucgugauggaugaagcccacuuuacggacccuuccagcgucgcggcccggggguacauuuccacaagaguggagaugggcgaagcugccgcuaucuucaugaccgccacccccccuggagccacagauccguuuccccaaucuaacagcccuauugaggacaucgaacgcgagauccccgagcgguccuggaauaccggcuucgauuggauuacagacuaucaggggaaaaccguuugguuugugccuagcaucaaggcuggaaacgacauugcgaacugccugagaaagucuggcaaaaaggucauccagcugucccgcaaaacguucgauacagaauaccccaagaccaaacucacagacugggauuuuguggucaccacggacauuagcgagaugggggccaauuucagagcuggacgggugaucgauccgcgcagaugucugaagccuguuauccuuaccgacggccccgaacgggugauucuggccgggcccaucccugugacacccgccucugcugcccaacgcagaggccggauuggaagaaaccucgcgcaggaggaugaccaguaugucuucagcggcgauccucugaagaaugacgaagaucaugcucacuggaccgaggccaaaaugcugcucgacaacaucuacacaccggaggggauuauccccacccuuuuuggaccugaacgcgagaagacacaggccauugauggcgaauuccggcugagaggggagcaacgcaaaaccuuuguugagcugaugcggagaggagaccuccccguguggcuguccuauaagguggcuucugccggcaucagcuacaaagaccgggaauggugcuucacgggcgagcgcaauaaccagauccuugaagagaauauggaagucgagauuuggacaagagagggggaaaagaagaaacugcggccuaaguggcucgaugcgcgcguguaugccgaccccauggcucugaaagauuuuaaggaguucgccuccggaagaaaaucuaucacccuggacauucucaccgaaaucgcuagccuuccgacauaccuguccagccgggccaagcuggcucucgauaacauuguuaugcugcauaccacagagcgcggcgggagagccuaccagcacgcgcuuaaugaacugccugagucucucgagacgcugaugcugguggcccuccuuggagcuaugaccgccggcaucuuucuguucuuuaugcaggggaagggaaucggcaaacuguccaugggccucauuacaaucgcugucgccagcgggcugcuuuggguggccgaaauucaaccccaguggaucgcugcguccauuauccuggaguucuuucucaugguccugcugaucccugaacccgagaagcagcggaccccucaggacaaccaacucauuuaugugauccuuacaauucugaccaucauuggacugaucgccgcuaaugaaaugggccucauugagaaaacgaagaccgauuucggguuuuaccagguuaaaacagagaccacaauccuggacguggaucuucgccccgccucugccuggacccuguaugcugucgccacgacaauccucaccccgaugcugagacacacaauugaaaacaccagcgcgaaucugucccucgccgcuaucgccaaccaggcugccgugcuuaugggacugggcaagggguggccucugcaucggauggaccucggaguuccccugcuugcgaugggcuguuacucucaggugaaucccaccacacugacggccagccucgucaugcugcuggugcacuaugcuauuaucggcccugggcuccaagccaaagcuaccagagaggcccagaagcgcacagcugccggaauuaugaagaacccgaccguggauggcaucacaguuaucgaccuugaacccauuuccuacgauccuaaauucgagaagcagcuggggcaagucaugcugcucgugcugugcgcgggacagcuucugcucaugcggaccacgugggccuucugugaggugcugacacuggcuaccggccccauccucacccuuugggaagggaacccuggaagauuuuggaauacaaccauugccgucagcacagcuaacaucuuccgcggcucuuaucuggccggcgccgggcuggcguuuucccucauuaaaaaugcucagacgccccggagaggaaccggcacaaccggggagacacugggagaaaaguggaaacgccagcuuaacagccuggaccggaaggaguucgaagaguacaagagaucuggcauccucgagguugaccgcaccgaagccaaauccgcucugaaggaugggagcaaaaucaagcaugccgugucucggggaagcuccaaaauuagauggaucguggagcgcggcauggucaagccuaagggcaaagugguugaccuggggugcggacggggcggguggucuuacuauauggccacgcucaagaaugugaccgaagucaaaggauacacaaagggcgggccgggacacgaggaacccauuccuauggcuaccuauggcuggaaccuugugaaacugcauagcggcguugauguguuuuacaagcccacagagcaagucgacacccugcucugugauaucggggaguccagcuccaauccuacaauugaagagggaagaacccugcgcgugcuuaagaugguggaacccuggcugucuagcaaaccggaguucugcaucaagguccucaacccuuauaugcccacgguuauugaagagcuggagaaacugcagagaaagcacggcgggaaucucgugcgguguccccuuucccgcaacucuacacacgaaauguacugggugagcggagccuccggcaauaucgucucuagcgugaacaccaccuccaaaaugcugcugaauagauuuacaacgcggcauagaaagccuaccuaugagaaagacguugaucucggggcgggaacacggagcgugucuaccgaaacagagaagcccgacaugaccaucauuggccgcagacugcagcggcuucaggaggaacacaaggagacauggcauuacgaucaagaaaacccuuaccgcaccugggccuaucacggcuccuacgaggcuccgagcacggggucugccuccagcauggucaauggagugguuaaacugcucaccaagcccugggacgugaucccuauggucacacagcuggcuaugaccgauacaacccccuucggccagcagagaguguuuaaagaaaagguugacacgcggacaccucaacccaaaccggggacccgcauggugaugacaaccacggccaacuggcugugggcgcuccugggaaagaagaaaaauccuagacuuugcacccgggaggaguucauuucuaagguccgcuccaacgccgcuaucggcgccguguuucaggaagagcagggguggacaagcgcuuccgaagccgucaacgacagcagauucugggagcugguggauaaagaacgggcucuccaccaagagggcaagugugagucuugcguuuauaauaugaugggaaaacgcgaaaagaagcugggcgaguuugggagagccaaaggaagccgggcgauuugguacauguggcuuggcgcccgcuuccuggaauucgaggcucucggguuucugaacgaagaccauugguucggaagagagaauuccuggucuggcguggagggggaaggccugcaccggcucggauauauccuggaggaaaucgauaagaaagacggcgaucuuauguacgccgacgauaccgcugggugggacacaagaauuaccgaggaugaccugcagaacgaggaacucaucacagagcagauggccccccaucacaagauucuggccaaagcgaucuuuaagcuuaccuaucagaauaaggucgugaaagugcugcgcccuacgccccggggagcuguuauggauauuaucagcagaaaggaccaacgcggcuccgggcaggugggaacauacggccucaacaccuucaccaauauggaaguccagcugauccggcagauggaggccgaaggggugauuacacaagaugacaugcagaacccuaaaggccugaaggagagaguugagaaauggcuccgcgaaugcggaguggaccggcugaagagaauggccaucucuggcgaugacugugucgugaaaccccuugaugagcgcuuugggaccagccugcucuuccugaaugacaugggaaagguccggaaggauauuccgcagugggaaccuuccaaaggcuggaagaacuggcaggaggugcccuuuugcucucaucacuuccacaaaaucuuuaugaaggacgggagaagccuuguugugcccugucgcaaucaagaugaacugauuggacgggcuagaaucucccagggcgccggguggagccuccgggagacagcuugccugggcaaagccuacgcgcagauguggucucugauguauuuccauagacgcgaccuccggcuggccuccauggcuaucuguagcgccgucccuacggagugguuuccgaccucuagaacaaccugguccauucacgcucaucaccaguggaugacaaccgaagauaugcuuaagguguggaaccgcguuuggaucgaggacaaucccaacaugauugauaagacgccugugcacagcugggaagacauccccuaccugggaaaaagagaggaccucuggugcggcucccugauugggcuuucuagccgggccaccugggcgaagaauauccauacagccauuacccaaguccgcaaccugaucggaaaagaagaguauguggauuacaugccugugaugaagagauauuccgcucccagcgagucugaaggcguucucuga

SEQ ID NO: 21008 - RNA, 9867 nt, Artificial Sequence
  derived and/or modified CDS sequence (opt5) from DENV-4__FJ882582__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggaauggccgggagcugaagugcgggucuggaaucuucgucguugauaacgugcauacauggaccgaacaauacaaauuucagcccgaguccccugcgagacuggccagcgcuauucucaaugcccacaaggacggcgugugugggauccgcuccacaacgcggcuggagaacgucauguggaaacagauuaccaaugaacuuaacuaugugcugugggagggaggccacgaccucacaguuguggcuggcgaugucaagggggugcugaccaaaggaaagagagcccugacacccccugcgucugaccuuaaguacagcuggaaaaccuggggcaaggccaaaaucuucacgcccgaagcucggaauuccaccuuucucaucgaugggccggacacaucugagugcccuaacgaacgcagagccuggaauagcuucgagguugaggauuacggauucggcauguuuaccacaaacauuuggaugaaguuccgggaaggguccagcgaggugugugaccauagacugaugucugcugccaucaaagaucagaaggccguccacgcugacaugggauauuggauugaauccagcaaaaaucaaaccuggcagaucgagcgcgcgucucugauugaagugaagacaugccucuggcccaagacccauacgcugugguccaacggcguucuugagagccagaugcugaucccuaaaucuuacgccggccccuuuagccagcacaacuaucggcaaggguacgcuacacagaccgugggaccuuggcaccucggcaagcuggagaucgauuucggggaaugccccggaaccacagucaccauucaggagaauugugaccauagaggcccgucccugcgcacgacaaccgccagcgggaaacuugugacacaguggugcuguagaucuugcaccaugccuccccuccgguuucugggagaagauggcuguugguauggcauggagauccgcccccuguccgagaaggaagagaacauggugaaaagccaagucacagccgggcagggaaccuccgaaacguucucuaugggccuccugugccuuacccuguuuguugaggaaugucucagacggcgcgugacaagaaagcacaugauucuggcuguggucaucacccugugcgccauuauccuugggggacucacauggauggaccugcugcgggcgcucaucaugcugggcgauaccaugagcgggcgcauuggaggccagacgcaucuugcuaucauggccguguucaagauguccccuggcuacguucuggggguguuucucagaaaacugacaucucgggagaccgcccugauggucauuggaauggcuaugacaaccacccuuagcaucccgcacgaccugauggagcucauugacggcaucucccuggggcucauccugcuuaagauugugacacaguucgauaauacgcaaguuggaacccuggcccucucucugacauuuauccgcagcaccaugucccuggugauggcguggagaacaauuauggcuguccuuuucguggucacccugaucccccucugucggacgagcugccugcagaaacagucucauuggguggaaauuacagcccucauccugggcgcccaagcucuuccuguuuaucugaugacccucaugaagggggccuccagacgcagcuggccccugaacgagggaauuauggcugugggccuggucucucuucugggcuccgcccuccugaaaaaugacgugccucucgcggggcccaugguugccggaggccugcuucuggcugccuacgugaugagcgggucuuccgcugaucugagccucgaaaaggccgccaacguccagugggacgagauggcugauaucaccggauccagcccuaucauugaagugaagcaggacgaggauggcucuuuuagcauccgggacguggaggaaacaaauaugauuacccugcuuguuaaacuggcgcucaucacagucuccgggcuguacccccucgccauuccgaucacgaugacccugugguauauguggcaggugaagacacaaagaucuggagcucuuugggaugugccuagccccgccgccacccagaaagcugcccuguccgagggcgucuaccgcaucaugcagcggggccuguucgggaagacacaggugggaguuggcauucacauggaagggguguuccacaccauguggcaugucacgagaggaucugugaucugucacgagaccggccgccucgaaccuagcugggcggacguucggaacgauaugauuuccuaugggggaggcuggagacugggcgacaaaugggauaaggaggaggacgugcaaguccuugcuaucgaacccgggaagaauccgaaacaugugcagacaaagccuggacuguuuaaaacccucacaggcgagauuggggccguuacccuggacuucaagcccggaacaucuggcagcccuaucaucaaccgcaaagggaaggugauuggccucuacggaaauggcgucgugacgaaauccggggauuaugugagcgccaucacccaggcugaacggauuggagagcccgacuacgaggucgaugaagacaucuuuagaaagaagcggcugacaauuauggaucuucaccccggcgccgggaaaaccaagcgcauccugccuucuauuguuagagaggcgcugaaacggcgccucagaacccugauccuugcuccgacacgggugguggccgccgaaauggaggaagcucugagaggacuccccauccgcuaucagacgccugccgucaaguccgagcauaccggccgggagauuguggaccugaugugccacgcuacauucaccacaagacuccugagcucuacccgcguucccaacuacaaucuuaucgugauggaugaagcccacuuuacggacccuuccagcgucgcggcccggggguacauuuccacaagaguggagaugggcgaagcugccgcuaucuucaugaccgccacccccccuggagccacagauccguuuccccaaucuaacagcccuauugaggacaucgaacgcgagauccccgagcgguccuggaauaccggcuucgauuggauuacagacuaucaggggaaaaccguuugguuugugccuagcaucaaggcuggaaacgacauugcgaacugccugagaaagucuggcaaaaaggucauccagcugucccgcaaaacguucgauacagaauaccccaagaccaaacucacagacugggauuuuguggucaccacggacauuagcgagaugggggccaauuucagagcuggacgggugaucgauccgcgcagaugucugaagccuguuauccuuaccgacggccccgaacgggugauucuggccgggcccaucccugugacacccgccucugcugcccaacgcagaggccggauuggaagaaaccucgcgcaggaggaugaccaguaugucuucagcggcgauccucugaagaaugacgaagaucaugcucacuggaccgaggccaaaaugcugcucgacaacaucuacacaccggaggggauuauccccacccuuuuuggaccugaacgcgagaagacacaggccauugauggcgaauuccggcugagaggggagcaacgcaaaaccuuuguugagcugaugcggagaggagaccuccccguguggcuguccuauaagguggcuucugccggcaucagcuacaaagaccgggaauggugcuucacgggcgagcgcaauaaccagauccuugaagagaauauggaagucgagauuuggacaagagagggggaaaagaagaaacugcggccuaaguggcucgaugcgcgcguguaugccgaccccauggcucugaaagauuuuaaggaguucgccuccggaagaaaaucuaucacccuggacauucucaccgaaaucgcuagccuuccgacauaccuguccagccgggccaagcuggcucucgauaacauuguuaugcugcauaccacagagcgcggcgggagagccuaccagcacgcgcuuaaugaacugccugagucucucgagacgcugaugcugguggcccuccuuggagcuaugaccgccggcaucuuucuguucuuuaugcaggggaagggaaucggcaaacuguccaugggccucauuacaaucgcugucgccagcgggcugcuuuggguggccgaaauucaaccccaguggaucgcugcguccauuauccuggaguucuuucucaugguccugcugaucccugaacccgagaagcagcggaccccucaggacaaccaacucauuuaugugauccuuacaauucugaccaucauuggacugaucgccgcuaaugaaaugggccucauugagaaaacgaagaccgauuucggguuuuaccagguuaaaacagagaccacaauccuggacguggaucuucgccccgccucugccuggacccuguaugcugucgccacgacaauccucaccccgaugcugagacacacaauugaaaacaccagcgcgaaucugucccucgccgcuaucgccaaccaggcugccgugcuuaugggacugggcaagggguggccucugcaucggauggaccucggaguuccccugcuugcgaugggcuguuacucucaggugaaucccaccacacugacggccagccucgucaugcugcuggugcacuaugcuauuaucggcccugggcuccaagccaaagcuaccagagaggcccagaagcgcacagcugccggaauuaugaagaacccgaccguggauggcaucacaguuaucgaccuugaacccauuuccuacgauccuaaauucgagaagcagcuggggcaagucaugcugcucgugcugugcgcgggacagcuucugcucaugcggaccacgugggccuucugugaggugcugacacuggcuaccggccccauccucacccuuugggaagggaacccuggaagauuuuggaauacaaccauugccgucagcacagcuaacaucuuccgcggcucuuaucuggccggcgccgggcuggcguuuucccucauuaaaaaugcucagacgccccggagaggaaccggcacaaccggggagacacugggagaaaaguggaaacgccagcuuaacagccuggaccggaaggaguucgaagaguacaagagaucuggcauccucgagguugaccgcaccgaagccaaauccgcucugaaggaugggagcaaaaucaagcaugccgugucucggggaagcuccaaaauuagauggaucguggagcgcggcauggucaagccuaagggcaaagugguugaccuggggugcggacggggcggguggucuuacuauauggccacgcucaagaaugugaccgaagucaaaggauacacaaagggcgggccgggacacgaggaacccauuccuauggcuaccuauggcuggaaccuugugaaacugcauagcggcguugauguguuuuacaagcccacagagcaagucgacacccugcucugugauaucggggaguccagcuccaauccuacaauugaagagggaagaacccugcgcgugcuuaagaugguggaacccuggcugucuagcaaaccggaguucugcaucaagguccucaacccuuauaugcccacgguuauugaagagcuggagaaacugcagagaaagcacggcgggaaucucgugcgguguccccuuucccgcaacucuacacacgaaauguacugggugagcggagccuccggcaauaucgucucuagcgugaacaccaccuccaaaaugcugcugaauagauuuacaacgcggcauagaaagccuaccuaugagaaagacguugaucucggggcgggaacacggagcgugucuaccgaaacagagaagcccgacaugaccaucauuggccgcagacugcagcggcuucaggaggaacacaaggagacauggcauuacgaucaagaaaacccuuaccgcaccugggccuaucacggcuccuacgaggcuccgagcacggggucugccuccagcauggucaauggagugguuaaacugcucaccaagcccugggacgugaucccuauggucacacagcuggcuaugaccgauacaacccccuucggccagcagagaguguuuaaagaaaagguugacacgcggacaccucaacccaaaccggggacccgcauggugaugacaaccacggccaacuggcugugggcgcuccugggaaagaagaaaaauccuagacuuugcacccgggaggaguucauuucuaagguccgcuccaacgccgcuaucggcgccguguuucaggaagagcagggguggacaagcgcuuccgaagccgucaacgacagcagauucugggagcugguggauaaagaacgggcucuccaccaagagggcaagugugagucuugcguuuauaauaugaugggaaaacgcgaaaagaagcugggcgaguuugggagagccaaaggaagccgggcgauuugguacauguggcuuggcgcccgcuuccuggaauucgaggcucucggguuucugaacgaagaccauugguucggaagagagaauuccuggucuggcguggagggggaaggccugcaccggcucggauauauccuggaggaaaucgauaagaaagacggcgaucuuauguacgccgacgauaccgcugggugggacacaagaauuaccgaggaugaccugcagaacgaggaacucaucacagagcagauggccccccaucacaagauucuggccaaagcgaucuuuaagcuuaccuaucagaauaaggucgugaaagugcugcgcccuacgccccggggagcuguuauggauauuaucagcagaaaggaccaacgcggcuccgggcaggugggaacauacggccucaacaccuucaccaauauggaaguccagcugauccggcagauggaggccgaaggggugauuacacaagaugacaugcagaacccuaaaggccugaaggagagaguugagaaauggcuccgcgaaugcggaguggaccggcugaagagaauggccaucucuggcgaugacugugucgugaaaccccuugaugagcgcuuugggaccagccugcucuuccugaaugacaugggaaagguccggaaggauauuccgcagugggaaccuuccaaaggcuggaagaacuggcaggaggugcccuuuugcucucaucacuuccacaaaaucuuuaugaaggacgggagaagccuuguugugcccugucgcaaucaagaugaacugauuggacgggcuagaaucucccagggcgccggguggagccuccgggagacagcuugccugggcaaagccuacgcgcagauguggucucugauguauuuccauagacgcgaccuccggcuggccuccauggcuaucuguagcgccgucccuacggagugguuuccgaccucuagaacaaccugguccauucacgcucaucaccaguggaugacaaccgaagauaugcuuaagguguggaaccgcguuuggaucgaggacaaucccaacaugauugauaagacgccugugcacagcugggaagacauccccuaccugggaaaaagagaggaccucuggugcggcucccugauugggcuuucuagccgggccaccugggcgaagaauauccauacagccauuacccaaguccgcaaccugaucggaaaagaagaguaugcugauuacaugccugugaugaagagauauuccgcccccagcgagucugaaggcgugcucuga

SEQ ID NO: 21009 - RNA, 9867 nt, Artificial Sequence
  derived and/or modified CDS sequence (opt5) from DENV-4__FJ882584__SS-prME
agcaccaucacccugcugugccugauucccacggugauggcuuuccaccuuuccaccagagacggagagccucugaugaucgucgcuaagcaugaacgggggcgcccgcuccuguuuaagaccaccgagggaauuaacaaguguacacuuaucgccauggaucugggcgaaaugugcgaggacaccguuacauacaaguguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccagcgcguggagucuuggauccuuagaaauccuggcuucgcucugcucgccggcuuuauggcuuacaugaucgggcagacaggcauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcuagcauuucuaauaucaccacagccacccgcugcccgacgcaaggagagcccuaucuuaaggaggaacaggaccagcaguacauuuguagacgggaugugguggaccgcggcugggggaacggaugcggccuguucgggaaaggaggcgucgugacaugcgcgaaguuuuccuguagcggcaaaaucaccgggaaucucguucaaauugagaaccuggaauauaccguggucgugacaguucauaauggagauacccacgccgugggcaacgacacaucuaaucacggggucacggcuaccaucacaccuagaucccccagcguggaggucaaacuuccugauuacggagaacugacccucgacugcgagccccggucuggcaucgacuucaacgagaugauucugaugaagaugaaaaagaaaacauggcuggugcauaagcagugguuucucgaucugccgcuuccuuggaccacgggggccgacaccuccgaaguucacuggaauuacaaagagagaauggugacauucaaggucccccaugcuaaacgccaggaugugaccguucugggcagccaggaaggagccaugcacuccgcccucgcuggcgcgacagagguggacucuggggauggaaaccacauguuugccggccaucugaaguguaagguccggauggaaaaacuuagaaucaaggggaugagcuauaccaugugcuccggaaaauucagcauugacaaggagauggcugagacgcaacacggcacaaccguggugaaaguuaaguacgaaggggccggcgccccuuguaagguccccaucgagauucgcgaugugaauaaagaaaagguggucggacgggugaucucugcuacaccccuggccgagaacaccaacuccguuaccaauaucgagcucgaaccuccguucggcgacagcuauauugugaucggggucggaaacucugcgcugacacugcauugguuuagaaaaggcagcuccauugggaagauguucgagucuacguaccgcggagcuaaacggauggccauccucggcgaaaccgccugggauuuugggagcgugggcggacuguucacaucccuuggcaaggcuguucaccagguguuugggagcgucuauaccacaauguucggaggcgugucuuggaugauuagaauccugaucggguuucucguucuguggauuggaaccaauucccgcaacacgagcauggccaugacaugcaucgcugugggcgggauuacccuguuccuuggcuuuaccguccaggccgacaugggauguguggugucuugguccggccgggagcucaagugcgggagcggaaucuucgucguugauaaugugcauacauggaccgaacaauacaaauuucagcccgaguccccugcgagacuggccucugcuauucugaacgcccacaaggacggcgugugugggauccgcagcacaacgcggcucgagaaugucauguggaaacagauuaccaacgaacugaauuaugugcuuugggagggaggccacgaccugacaguuguggcuggcgaugucaagggggugcucaccaaaggaaagagagcccugacacccccugcguccgaccugaaguacucuuggaaaaccuggggcaaggccaaaaucuucacgcccgaagcucggaacagcaccuuucuuaucgaugggccggacacauccgagugcccuaaugaacgcagagccuggaacagcuucgagguugaggauuacggauucggcauguuuaccacaaauauuuggaugaaguuccgggaagggucuuccgaggugugugaccauagacucaugagcgcugccaucaaagaucagaaggccguccacgcugacaugggauauuggauugaaucuuccaaaaaccaaaccuggcagaucgagcgcgcgagccugauugaagugaagacaugccuguggcccaagacccauacgcucuggucuaauggcguucuggagagccagaugcuuaucccuaaauccuacgccggccccuuuagccagcacaacuaucggcaaggguacgcuacacagaccgugggaccuuggcaccugggcaagcucgagaucgauuucggggaaugccccggaaccacagucaccauucaggagaacugugaccauagaggcccgucucugcgcacgacaaccgccuccgggaaacuggugacacaguggugcuguagaagcugcaccaugccuccccuucgguuucucggagaagauggcuguugguauggcauggagauccgcccccuguccgagaaggaagagaauauggugaaaucucaagucacagccgggcagggaaccagcgaaacguucuccaugggccugcucugccugacccuuuuuguugaggaaugucugagacggcgcgugacaagaaagcacaugauucucgcuguggucaucacccugugcgccauuauccucggcgggcuuacauggauggaccuccugcgggcgcugaucaugcucggggauaccaugucugggcgcauuggaggccagacgcaucuggcuaucauggccguguucaagaugagcccuggcuacguucuugggguguuucugagaaaacucacaucccgggagaccgcccugauggucauuggaauggcuaugacaaccacccugucuaucccgcacgaccuuauggagcugauugacggcaucagccucgggcugauccuccugaagauugugacacaguucgauaacacgcaaguuggaacccuugcccugucccucacauuuauccgcagcaccaugucucuggugauggcguggagaacaauuauggcuguccuguucguggucacccuuaucccccugugucggacguccugccuccagaaacagagccauuggguggaaauuacagcccugauccucggcgcccaagcucugccuguuuaucuuaugacccugaugaagggggccucuagacgcuccuggccccucaaugagggaauuauggcugugggccuggucagccugcuuggcucugcccugcucaaaaacgacgugccucuggcggggcccaugguugccggaggccuccugcuugcugccuacgugauguccgggagcuccgcugaucugagccuggaaaaggccgccaauguccagugggacgagauggcugauaucaccggaucuagcccuaucauugaagugaagcaggacgaggauggcuccuuuucuauccgggacguggaggaaacaaacaugauuacccuccugguuaaacuugcgcugaucacagucagcgggcucuacccccuggccauuccgaucacgaugacccucugguauauguggcaagugaagacacaaagauccggagcucugugggaugugccuucucccgccgccacccagaaagcugcccuuagcgagggcgucuaccgcaucaugcagcggggccuguucgggaagacacaggugggaguuggcauucacauggaagggguguuccacaccauguggcaugucacgagaggauccgugaucugucacgagaccggccgccuggaaccuucuugggcggacguucggaaugauaugauuagcuaugggggaggcuggagacucggcgacaaaugggauaaggaggaggacgugcaaguccuggcuaucgaacccgggaagaacccgaaacaugugcagacaaagccuggacuuuuuaaaacccugacaggcgagauuggggccguuacccucgacuucaagcccggaacauccggcagcccuaucaucaaucgcaaagggaaggugauuggccuguacggaaacggcgucgugacgaaaucuggggauuauguguccgccaucacccaggcugaacggauuggagagcccgacuacgaggucgaugaagacaucuuuagaaagaagcggcucacaauuauggaucugcaccccggcgccgggaaaaccaagcgcauccuuccuagcauuguuagagaggcgcugaaacggcgccugagaacccucauccuggcuccgacacgggugguggccgccgaaauggaggaagcucuuagaggacugcccauccgcuaucagacgccugccgucaagucugagcauaccggccgggagauuguggaccucaugugccacgcuacauucaccacaagacugcucuccagcacccgcguucccaauuacaaccugaucgugauggaugaagcccacuuuacggacccuuccucugucgcggcccggggguacauuagcacaagaguggagaugggcgaagcugccgcuaucuucaugaccgccacacccccuggagccacagauccguuuccccaauccaauagcccuauugaggacaucgaacgcgagauccccgagcggucuuggaacaccggcuucgauuggauuacagacuaucaggggaaaaccguuugguuugugccuuccaucaaggcuggaaaugacauugcgaacugccuuagaaagagcggcaaaaaggucauccagcugucucgcaaaacguucgauacagaauaccccaagaccaaacugacagacugggauuuuguggucaccacggacauuagcgagaugggggccaacuucagagcuggacgggugaucgauccgcgcagaugucucaagccuguuauccugaccgacggccccgaacgggugauucuugccgggcccaucccugugacacccgccuccgcugcccaacgcagaggccggauuggaagaaauccugcgcaggaggaugaccaguaugucuucucuggcgauccgcugaagaacgacgaagaucaugcucacuggaccgaggccaaaaugcuccuggacaauaucuacacacccgaggggauuaucccuacccuguuuggacccgaacgcgagaagacacaggccauugauggcgaguuccggcucagaggggagcaacgcaaaaccuuuguugagcuuaugcggagaggagaccugccuguguggcugagcuauaagguggcuuccgccggcaucucuuacaaagaccgggaauggugcuucacgggcgagcgcaacaaucagauccucgaagagaacauggaagucgagauuuggacaagagagggggaaaagaagaaacugcggcccaaguggcuugaugcgcgcguguaugccgacccgauggcucugaaagauuuuaaggaguucgccagcggaagaaaauccaucacccucgacauucugaccgaaaucgcuagccugccuacauaccucucuucccgggccaaacuugcucuggauaauauuguuaugcugcauaccacagagcgcggcgggagagccuaccagcacgcgcucaacgaacugcccgagagccuugagacgcugaugcucguggcccugcugggagcuaugaccgccggcaucuuucucuucuuuaugcaggggaagggaaucggcaaacuuuccaugggccugauuacaaucgcugucgccucugggcugcucuggguggccgaaauucaaccucaguggaucgcugcgagcauuauccuggaguucuuucuuaugguccugcucauccccgaaccugagaagcagcggacaccccaggacaaucaacugauuuaugugauccugacaauucucaccaucauuggacuuaucgccgcuaacgaaaugggccugauugagaaaacgaagaccgauuucggguuuuaccagguuaaaacagagaccacaauccuggacguggaucuccgcccggccuccgccuggacccuguaugcugucgccacgacaauccuuaccccuaugcugagacacacaauugaaaauaccucugcgaaccucagccuggccgcuaucgccaaucaggcugccgugcugaugggacucggcaagggguggccccuucaucggauggaccugggaguuccccugcucgcgaugggcuguuacucccaggugaacccuaccacacugacggccagccuugucaugcugcucgugcacuaugcuauuaucggcccggggcugcaagccaaagcuaccagagaggcccagaagcgcacagcugccggaauuaugaagaaucccaccguggauggcaucacaguuaucgaccuggaaccuauuucuuacgaucccaaauucgagaagcagcucgggcaagucaugcuucuggugcugugcgcgggacagcuccugcuuaugcggaccacgugggccuucugugaggugcugacacucgcuaccggcccuauccugacccugugggaagggaaccccggaagauuuuggaacacaaccauugccgucuccacagcuaauaucuuccgcggcagcuaucucgccggcgccgggcuugcguuuucucugauuaaaaacgcucagacgccucggagaggaaccggcacaaccggggagacacugggagaaaaguggaaacgccagcucaauucccuggaccggaaggaguucgaagaguacaagagaagcggcauccuugagguugaccgcaccgaagccaaaucugcucugaaggaugggagcaaaaucaagcaugccgugucccggggaucuagcaaaauuagauggaucguggagcgcggcauggucaagccgaagggcaaagugguugaccucgggugcggacggggcgggugguccuacuauauggccacgcugaagaacgugaccgaagucaaaggauacacaaagggcgggcccggacacgaggaaccuauucccauggcuaccuauggcuggaaucuggugaaacuccauagcggcguugauguguuuuacaagccuacagagcaagucgacacccuucugugugauaucggggaguccucuagcaaccccacaauugaagagggaagaacccugcgcgugcucaagaugguggaaccguggcuguccucuaaaccugaguucugcaucaagguccuuaaucccuauaugcccacgguuauugaagaacuggagaaacuccagagaaagcacggcgggaaccuggugcgguguccucugagccgcaauuccacacacgaaauguacugggugucuggagccagcggcaacaucgucuccagcgugaauaccaccucuaaaaugcuccuuaacagauuuacaacgcggcauagaaagcccaccuaugagaaagacguugaucugggggcgggaacacgguccgugagcaccgaaacagagaagccugacaugaccaucauuggccgcagacugcagcggcuccaggaggaacacaaggagacauggcauuacgaucaagaaaauccguaccgcaccugggccuaucacggcucuuacgaggcucccuccacggggagcgccucuuccauggucaacggagugguuaaacugcuuaccaagccuugggacgugauccccauggucacacagcuggcuaugaccgauacaaccccuuucggccagcagagaguguuuaaagaaaagguugacacgcggacaccccaaccgaaaccugggacccgcauggugaugacaaccacggccaauuggcucugggcgcugcugggaaagaagaaaaaccccagacucugcacccgggaggaguucauuagcaagguccgcuccaaugccgcuaucggcgccguguuucaggaagaacagggguggacaagcgcuucugaagccgucaacgacagcagauucugggagcugguggauaaagaacgggcccuucaccaagagggcaagugugaguccugcguuuauaacaugaugggaaaacgcgaaaagaagcugggcgaguuugggagagccaaaggaucucgggcgauuugguacauguggcucggcgcccgcuuccuggaguucgaggcucuuggguuucugaaugaagaccauugguucggaagagagaacagcugguccggcguggagggggaaggccuccaccggcugggauauauccuggaggaaaucgauaagaaagacggcgaucucauguacgccgacgauaccgcugggugggacacaagaauuaccgaggaugaccugcagaaugaggaacuuaucacagagcagauggccccucaucacaagauucuggccaaagcgaucuuuaagcucaccuaucagaacaaggucgugaaagugcugcgccccacgccucggggagcuguuauggauauuaucucuagaaaggaccaacgcggcagcggacaggugggaacauacggccuuaauaccuucaccaacauggaaguccagcugauccggcagauggaggccgaaggggugauuacacaagaugacaugcagaaucccaaaggccucaaggagagaguugagaaauggcugcgcgaaugcggaguggaccggcugaagagaauggccaucuccggcgaugacugugucgugaaaccgcucgaugagcgcuuugggaccucucugcuuuuccugaacgacaugggaaagguccggaaggauauuccucagugggaacccagcaaaggcuggaagaauuggcaggaggugcccuuuugcucccaucacuuccacaaaaucuuuaugaaggacgggagaagccucguugugccuugucgcaaccaagaugaacugauuggacgggcuagaaucucucagggcgccggguggucccuucgggagacagcuugccugggcaaagccuacgcgcagauguggagccucauguauuuccauagacgcgaccugcggcuggccucuauggcuaucuguuccgccgucccgacggagugguuucccaccagcagaacaaccugguccauucacgcucaucaccaguggaugacaaccgaagauaugcucaagguguggaaucgcguuuggaucgaggacaacccuaauaugauugauaagacgcccgugcacucuugggaagacaucccuuaccugggaaaaagagaggaccuuuggugcggcagccugauugggcucuccagccgggccaccugggcgaagaacauccauacagccauuacccaaguccgcaaucugaucggaaaagaagaguauguggauuacaugcccgugaugaagagauauucugcuccuuccgagagcgaaggcguucuuuga

SEQ ID NO: 21010 - RNA, 9867 nt, Artificial Sequence
  derived and/or modified CDS sequence (opt5) from DENV-4__FJ882585__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggucuggccgggagcugaagugcggguccggaaucuucgucguugauaaugugcauacauggaccgaacaauacaaauuucagcccgagagcccugcgagacuggccuccgcuauucucaacgcccacaaggacggcgugugugggauccgcucuacaacgcggcuggagaaugucauguggaaacagauuaccaacgaacuuaauuaugugcugugggagggaggccacgaccucacaguuguggcuggcgaugucaagggggugcugaccaaaggaaagagagcccugacacccccugcgagcgaccuuaaguacuccuggaaaaccuggggcaaggccaaaaucuucacgcccgaagcucggaacucuaccuuucucaucgaugggccggacacaagcgagugcccuaaugaacgcagagccuggaacuccuucgagguugaggauuacggauucggcauguuuaccacaaauauuuggaugaaguuccgggaagggagcucugaggugugugaccauagacugauguccgcugccaucaaagaucagaaggccguccacgcugacaugggauauuggauugaaagcucuaaaaaccaaaccuggcagaucgagcgcgcgucccugauugaagugaagacaugccucuggcccaagacccauacgcuguggagcaauggcguucuugagucucagaugcugaucccuaaaagcuacgccggccccuuuucccagcacaacuaucggcaaggguacgcuacacagaccgugggaccuuggcaccucggcaagcuggagaucgauuucggggaaugccccggaaccacagucaccauucaggagaacugugaccauagaggcccgagccugcgcacgacaaccgccucugggaaacuugugacacaguggugcuguagauccugcaccaugccuccccuccgguuucugggagaagauggcuguugguauggcauggagauccgcccccugagcgagaaggaagagaauauggugaaaucccaagucacagccgggcagggaaccucugaaacguucagcaugggccuccugugccuuacccuguuuguugaggaaugucucagacggcgcgugacaagaaagcacaugauucuggcuguggucaucacccugugcgccacaauucuugggggacucaccuggauggaccugcugcgggcgcucaucaugcugggcgauacgauguccgggcgcaucggaggccagacacaucuugcuauuauggccguguucaagaugucuccuggcuacguucuggggguguuucucagaaaacugaccagccgggagacagcccugauggucaucggaauggcuaugaccaccacacuuuccauuccgcacgaccugauggagcucaucgacggcauuucucuggggcucauccugcuuaagaucgugacgcaguucgauaacacccaaguuggaacacuggcccucagccugaccuuuauucgcuccacaaugagccuggugauggcguggagaaccaucauggcuguccuuuucguggucacgcugauuccccucugucggacaucuugccugcagaaacagucccauuggguggaaaucaccgcccucauucugggcgcccaagcucuuccuguuuaucugaugacccucaugaagggggccagcagacgcucuuggccccugaaugagggaaucauggcugugggccuggucucccuucugggcagcgcccuccugaaaaacgacgugccucucgcggggcccaugguugccggaggccugcuucuggcugccuacgugaugucuggguccagcgcugaucugucccucgaaaaggccgccaauguccagugggacgagauggcugcgauuacaggaagcucuccuaucaucgaagugaagcaggaugaggacggcagcuuuuccauucgggauguggaggaaaccaacaugaucacacugcuuguuaaacuggcccucauuacggucucugggcuguacccccucgcuaucccgauuaccaugacacugugguauauguggcaggugaagacccaaagaagcggagcccuuugggacgugccuucccccgccgcuacacagaaagccgcgcugucugagggcgucuaccgcaucaugcagcggggccuguucgggaagacccaggugggaguuggcauccacauggaagggguguuccacacgauguggcaugucaccagaggaagcgugauuugucacgagacaggccgccucgaaccuuccugggcugauguucggaaugacaugaucucuuaugggggaggcuggagacugggcgauaaaugggacaaggaggaggaugugcaaguccuugccauugaacccgggaagaacccgaaacaugugcagaccaagccuggacuguuuaaaacacucaccggcgagaucggggccguuacacuggacuucaagcccggaacgagcggcuccccuauuaucaaucgcaaagggaaggugaucggccucuacggaaacggcgucgugaccaaaagcggggacuaugugucugcuauuacacaggccgaacggaucggagagcccgauuacgaggucgacgaagauauuuuuagaaagaagcggcugaccaucauggaccuucaccccggcgcggggaaaaccaagcgcauucugccuuccaucguuagagaggcucugaaacggcgccucagaacacugauucuugccccgacgcgggugguggccgcugaaauggaggaagcccugagaggacuccccauccgcuaucagaccccugcugucaagagcgagcauacaggccgggagaucguggaucugaugugccacgccaccuucacaaccagacuccugucuuccacgcgcguucccaauuacaaccuuauugugauggacgaagcgcacuuuacagauccuagcuccgucgccgcucggggguacaucucuaccagaguggagaugggcgaagccgcugccauuuucaugaccgccacacccccuggagcuaccgacccguuuccccaaagcaauuccccuaucgaggauauugaacgcgagauccccgagcggagcuggaacacaggcuucgacuggaucaccgauuaucaggggaaaacgguuugguuugugccuucuauuaaggcgggaaaugacaucgccaacugccugagaaaguccggcaaaaaggucauucagcugagccgcaaaacauucgacaccgaauaccccaagacaaaacucaccgauugggacuuuguggucacgaccgauaucucugagaugggggcuaacuucagagccggacgggugauugacccgcgcagaugucugaagccuguuauccuuacagauggccccgaacgggugauccuggccgggcccauuccugugacccccgcuagcgccgcgcaacgcagaggccggaucggaagaaauccugcucaggaggacgaucaguaugucuucuccggcgacccgcucaagaacgaugaagaccaugcccacuggacagaggccaaaaugcugcuggauaauauuuacacccccgaggggaucauuccuacacucuuuggacccgaacgcgagaagacccaggcuaucgacggcgaauuccggcuuagaggggagcaacgcaaaacguuuguugagcugaugcggagaggagaucugccuguguggcucucuuauaagguggccagcgcgggcauuuccuacaaagaccgggaauggugcuucacaggcgagcgcaacaaucagauccuggaagagaacauggaagucgagaucuggaccagagagggggaaaagaagaaacuucggcccaaguggcuggacgcccgcguguaugcugauccgauggcccucaaagacuuuaaggaguucgcuucuggaagaaaaagcaccacacuggauauucugaccgaaaucgccucccucccuacauaccuuagcucucgggcuaagcuggcccuggacaauauuguuaugcuccauacgaccgagcgcggcgggagagcguaccagcacgcccugaacgaacuucccgagucccuggagacacucaugcugguggcucugcucggagccaugaccgcuggcaucuuucuuuucuuuaugcaggggaagggaauuggcaaacugagcaugggccugaucacaaucgccgucgccuccgggcuccuguggguggcugaaauucaaccucaguggaucgcggccucuauuauccuugaguucuuucugaugguccuccugauucccgaaccugagaagcagcggaccccccaggauaaucaacugaucuaugugauccucacgauucuuaccaucauuggacugaucgcugccaacgaaaugggccugauugagaaaacaaagaccgacuucggguuuuaccagguuaaaacagagaccacgauccucgauguggaccugcgcccggccagcgcuuggacacuuuaugccgucgcgaccacaauucugaccccuaugcucagacacaccaucgaaaauacauccgccaaccugucucuggcugccaucgcuaaucaggccgcggugcucaugggacuuggcaagggguggccccugcaucggauggaucugggaguuccccuccuggccaugggcuguuacagccaggugaacccuacgacccuuacagcuucccuggucaugcuccuggugcacuaugccauuaucggcccggggcugcaagcuaaagccaccagagaggcucagaagcgcacagccgcgggaauuaugaagaaucccaccguggacggcaucacgguuauugaucucgaaccuaucagcuacgaccccaaauucgagaagcagcuugggcaagucaugcugcuggugcucugcgccggacagcugcuucugaugcggacaaccugggcuuucugugaggugcucacccuggccacaggcccuauccugacccucugggaagggaaccccggaagauuuuggaacacaacgauugcugucucuaccgccaauaucuuccgcggcuccuaucuugccggcgcggggcuggcuuuuagccugauuaaaaacgcccagacaccucggagaggaaccggcacaaccggggagacgcucggagaaaaguggaaacgccagcugaauucucuugaucggaaggaguucgaagaguacaagagauccggcauccuggagguugaccgcaccgaagcuaaaagcgcccucaaggacgggucuaaaauuaagcaugccgugagccggggauccucuaaaaucagauggaucguggagcgcggcauggucaagccgaagggcaaagugguugaucuggggugcggacggggcggguggagcuacuauauggcuacacugaagaacgugaccgaagucaaaggauacacaaagggcgggcccggacacgaggaaccuauucccauggccaccuauggcuggaaucucgugaaacuucauuccggcguugacguguuuuacaagccuacagagcaagucgauacccugcugugugacaucggggagagcuccucuaaccccacgauugaagagggaagaacacuccgcgugcugaagaugguggaaccguggcuuagcuccaaaccugaguucugcaucaagguccugaaucccuauaugcccaccguuauugaagagcucgagaaacugcagagaaagcacggcgggaaccuggugcgguguccucucucucgcaauagcacccacgaaauguacuggguguccggagcgucuggcaacaucgucagcuccgugaauacaacgagcaaaaugcuucugaacagauuuaccacacggcauagaaagcccaccuaugagaaagauguugaccugggggccggaacacggucuguguccaccgaaacagagaagccugauaugaccauuaucggccgcagacuccagcggcugcaggaggaacacaaggagacguggcauuacgaccaagaaaauccguaccgcaccugggcuuaucacggcagcuacgaggcccccucuacaggguccgcuagcucuauggucaacggagugguuaaacuucugaccaagccuugggaugugauccccauggucacacagcucgccaugaccgacacgacaccuuucggccagcagagaguguuuaaagaaaagguugauacccggacaccccaaccgaaaccugggacccgcauggugaugacgaccacagcgaauuggcugugggcccugcucggaaagaagaaaaaccccagacugugcaccaaggaggaguucauuuccaaaguccggagcaaugcugccaucggcgcuguguuucaggaagagcagggguggacauccgccagcgaagcugucaacgacucucgcuucugggagcuuguggacaaggaaagagcccugcaccaagagggcaaaugugagagcugcguuuauaacaugaugggaaagcgggaaaagaaacucggcgaguuugggcgcgcgaagggauccagagccauuugguacauguggcugggcgcucgguuccuugaauucgaggcccugggguuucucaaugaagaucauugguucggacgcgagaacucuuggagcggcguggagggggaaggccugcacagacugggauauauccucgaggaaauugacaaaaaggauggcgaccugauguacgcugaugacaccgccgggugggauacacggaucaccgaggacgaucuucagaaugaggaacugaucacggagcagauggccccucaucacaaaauucucgcgaaggcuaucuuuaagcugacauaucagaacaaagucgugaaggugcuuagacccaccccucgcggagccguuauggacauuaucucccggaaagaucaaagaggcucugggcaggugggaaccuacggccugaauacauucaccaacauggaaguccagcucauucgccagauggaggccgaaggggugaucacacaagacgauaugcagaaucccaagggccugaaagagcggguugagaaguggcugagagaaugcggaguggaccgccucaaacggauggcuaucagcggcgacgauugugucgugaagccgcuggacgagagauuugggacgucccuucuguuccucaacgauaugggaaagguccgcaaagacauuccucagugggaacccucuaagggcuggaaaaauuggcaggaggugcccuuuugcagccaucacuuccacaagaucuuuaugaaagaugggcggucccugguugugccuuguagaaaccaagacgaacuuauuggacgcgcccggaucagccagggcgcuggguggucucugagagagaccgccugccucggcaaggcguacgcccagauguggucccugauguauuuccaucggagagaucugcgccucgcuagcauggccauuuguucugcugucccgacagagugguuucccaccucccggacaaccuggagcauccacgcccaucaccaguggaugacgaccgaagacaugcugaagguguggaauagaguuuggaucgaggauaacccuaauaugacagacaaaacccccgugcacuccugggaagauauuccuuaccuuggaaagcgcgaggaccuguggugcggcucucucaucgggcugagcuccagagcgacaugggccaaaaacauucauaccgcuaucacgcaaguccggaaucuuauuggaaaggaagaguauguggacuacaugcccgugaugaaacgcuauagcgccccuucugaguccgaaggcguucuguga

SEQ ID NO: 21011 - RNA, 9867 nt, Artificial Sequence
  derived and/or modified CDS sequence (opt5) from DENV-4__FJ882586__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggucuggccgggagcugaagugcggguccggaaucuucgucguugauaaugugcauacauggaccgaacaauacaaauuucagcccgagagcccugcgagacuggccuccgcuauucucaacgcccacaaggacggcgugugugggauccgcucuacaacgcggcuggagaaugucauguggaaacagauuaccaacgaacuuaauuaugugcugugggagggaggccacgaccucacaguuguggcuggcgaugucaagggggugcugaccaaaggaaagagagcccugacacccccugcgagcgaccuuaaguacuccuggaaaaccuggggcaaggccaaaaucuucacgcccgaagcucggaacucuaccuuucucaucgaugggccggacacaagcgagugcccuaaugaacgcagagccuggaacuccuucgagguugaggauuacggauucggcauguuuaccacaaauauuuggaugaaguuccgggaagggagcucugaggugugugaccauagacugauguccgcugccaucaaagaucagaaggccguccacgcugacaugggauauuggauugaaagcucuaaaaaccaaaccuggcagaucgagcgcgcgucccugauugaagugaagacaugccucuggcccaagacccauacgcuguggagcaauggcguucuugagucucagaugcugaucccuaaaagcuacgccggccccuuuucccagcacaacuaucggcaaggguacgcuacacagaccgugggaccuuggcaccucggcaagcuggagaucgauuucggggaaugccccggaaccacagucaccauucaggagaacugugaccauagaggcccgagccugcgcacgacaaccgccucugggaaacuugugacacaguggugcuguagauccugcaccaugccuccccuccgguuucugggagaagauggcuguugguauggcauggagauccgcccccugagcgagaaggaagagaauauggugaaaucccaagucacagccgggcagggaaccucugaaacguucagcaugggccuccugugccuuacccuguuuguugaggaaugucucagacggcgcgugacaagaaagcacaugauucuggcuguggucaucacccugugcgccauuauccuugggggacucacauggauggaccugcugcgggcgcucaucaugcugggcgauaccauguccgggcgcauuggaggccagacgcaucuugcuaucauggccguguucaagaugucuccuggcuacguucuggggguguuucucagaaaacugacaagccgggagaccgcccugauggucauuggaauggcuaugacaaccacccuuuccaucccgcacgaccugauggagcucauugacggcaucucucuggggcucauccugcuuaagauugugacacaguucgauaacacgcaaguuggaacccuggcccucagccugacauuuauccgcuccaccaugagccuggugauggcguggagaacaauuauggcuguccuuuucguggucacccugaucccccucugucggacgucuugccugcagaaacagucccauuggguggaaauuacagcccucauccugggcgcccaagcucuuccuguuuaucugaugacccucaugaagggggccagcagacgcucuuggccccugaaugagggaauuauggcugugggccuggucucccuucugggcagcgcccuccugaaaaacgacgugccucucgcggggcccaugguugccggaggccugcuucuggcugccuacgugaugucuggguccagcgcugaucugucccucgaaaaggccgccaauguccagugggacgagauggcugauaucaccggaagcucuccuaucauugaagugaagcaggacgaggauggcagcuuuuccauccgggacguggaggaaacaaacaugauuacccugcuuguuaaacuggcgcucaucacagucucugggcuguacccccucgccauuccgaucacgaugacccugugguauauguggcaggugaagacacaaagaagcggagcucuuugggaugugccuucccccgccgccacccagaaagcugcccugucugagggcgucuaccgcaucaugcagcggggccuguucgggaagacacaggugggaguuggcauucacauggaagggguguuccacaccauguggcaugucacgagaggaagcgugaucugucacgagaccggccgccucgaaccuuccugggcggacguucggaaugauaugauuucuuaugggggaggcuggagacugggcgacaaaugggauaaggaggaggacgugcaaguccuugcuaucgaacccgggaagaacccgaaacaugugcagacaaagccuggacuguuuaaaacccucacaggcgagauuggggccguuacccuggacuucaagcccggaacaagcggcuccccuaucaucaaucgcaaagggaaggugauuggccucuacggaaacggcgucgugacgaaaagcggggauuaugugucugccaucacccaggcugaacggauuggagagcccgacuacgaggucgaugaagacaucuuuagaaagaagcggcugacaauuauggaucuucaccccggcgccgggaaaaccaagcgcauccugccuuccauuguuagagaggcgcugaaacggcgccucagaacccugauccuugcuccgacacgggugguggccgccgaaauggaggaagcucugagaggacuccccauccgcuaucagacgccugccgucaagagcgagcauaccggccgggagauuguggaccugaugugccacgcuacauucaccacaagacuccugucuuccacccgcguucccaauuacaaccuuaucgugauggaugaagcccacuuuacggacccuagcuccgucgcggcccggggguacauuucuacaagaguggagaugggcgaagcugccgcuaucuucaugaccgccacccccccuggagccacagauccguuuccccaaagcaauuccccuauugaggacaucgaacgcgagauccccgagcggagcuggaacaccggcuucgauuggauuacagacuaucaggggaaaaccguuugguuugugccuucuaucaaggcuggaaaugacauugcgaacugccugagaaaguccggcaaaaaggucauccagcugagccgcaaaacguucgauacagaauaccccaagaccaaacucacagacugggauuuuguggucaccacggacauuucugagaugggggccaacuucagagcuggacgggugaucgauccgcgcagaugucugaagccuguuauccuuaccgacggccccgaacgggugauucuggccgggcccaucccugugacacccgccagcgcugcccaacgcagaggccggauuggaagaaauccugcgcaggaggaugaccaguaugucuucuccggcgauccgcucaagaacgacgaagaucaugcucacuggaccgaggccaaaaugcugcuggacaauaucuacacacccgaggggauuaucccuacccucuuuggacccgaacgcgagaagacacaggccauugauggcgaauuccggcuuagaggggagcaacgcaaaaccuuuguugagcugaugcggagaggagaccugccuguguggcucucuuauaagguggcuagcgccggcaucuccuacaaagaccgggaauggugcuucacgggcgagcgcaacaaucagauccuggaagagaacauggaagucgagauuuggacaagagagggggaaaagaagaaacuucggcccaaguggcuggaugcgcgcguguaugccgacccgauggcucucaaagauuuuaaggaguucgccucuggaagaaaaagcaucacccuggacauucugaccgaaaucgcuucccucccuacauaccuuagcucucgggccaagcuggcucuggauaauauuguuaugcuccauaccacagagcgcggcgggagagccuaccagcacgcgcugaacgaacuucccgagucccuggagacgcucaugcugguggcccugcucggagcuaugaccgccggcaucuuucuuuucuuuaugcaggggaagggaaucggcaaacugagcaugggccugauuacaaucgcugucgccuccgggcuccuguggguggccgaaauucaaccucaguggaucgcugcgucuauuauccuugaguucuuucugaugguccuccugauccccgaaccugagaagcagcggaccccccaggacaaucaacugauuuaugugauccucacaauucuuaccaucauuggacugaucgccgcuaacgaaaugggccugauugagaaaacgaagaccgauuucggguuuuaccagguuaaaacagagaccacaauccucgacguggaucugcgcccggccagcgccuggacccuuuaugcugucgccacgacaauccugaccccuaugcucagacacacaauugaaaauaccuccgcgaaccugucucuggccgcuaucgccaaucaggcugccgugcucaugggacuuggcaagggguggccccugcaucggauggaccugggaguuccccuccuggcgaugggcuguuacagccaggugaacccuaccacacuuacggccucccuggucaugcuccuggugcacuaugcuauuaucggcccggggcugcaagccaaagcuaccagagaggcccagaagcgcacagcugccggaauuaugaagaaucccaccguggauggcaucacaguuaucgaccucgaaccuauuagcuacgaucccaaauucgagaagcagcuugggcaagucaugcugcuggugcucugcgcgggacagcugcuucugaugcggaccacgugggccuucugugaggugcucacacuggcuaccggcccuauccugacccucugggaagggaaccccggaagauuuuggaacacaaccauugccgucucuacagcuaauaucuuccgcggcuccuaucuugccggcgccgggcuggcguuuagccugauuaaaaacgcucagacgccucggagaggaaccggcacaaccggggagacacucggagaaaaguggaaacgccagcugaauucucuugaccggaaggaguucgaagaguacaagagauccggcauccuggagguugaccgcaccgaagccaaaagcgcucucaaggaugggucuaaaaucaagcaugccgugagccggggauccucuaaaauuagauggaucguggagcgcggcauggucaagccgaagggcaaagugguugaccuggggugcggacggggcggguggagcuacuauauggccacgcugaagaacgugaccgaagucaaaggauacacaaagggcgggcccggacacgaggaaccuauucccauggcuaccuauggcuggaaucucgugaaacuucauuccggcguugauguguuuuacaagccuacagagcaagucgacacccugcugugugauaucggggagagcuccucuaaccccacaauugaagagggaagaacccuccgcgugcugaagaugguggaaccguggcuuagcuccaaaccugaguucugcaucaagguccugaaucccuauaugcccacgguuauugaagagcucgagaaacugcagagaaagcacggcgggaaccuggugcgguguccucucucucgcaauagcacacacgaaauguacuggguguccggagccucuggcaacaucgucagcuccgugaauaccaccagcaaaaugcuucugaacagauuuacaacgcggcauagaaagcccaccuaugagaaagacguugaucugggggcgggaacacggucuguguccaccgaaacagagaagccugacaugaccaucauuggccgcagacuccagcggcugcaggaggaacacaaggagacauggcauuacgaucaagaaaauccguaccgcaccugggccuaucacggcagcuacgaggcucccucuacgggguccgccagcucuauggucaacggagugguuaaacuucugaccaagccuugggacgugauccccauggucacacagcucgcuaugaccgauacaaccccuuucggccagcagagaguguuuaaagaaaagguugacacgcggacaccccaaccgaaaccugggacccgcauggugaugacaaccacggccaauuggcugugggcgcugcucggaaagaagaaaaaccccagacugugcacccgggaggaguucauuuccaagguccgcagcaaugccgcuaucggcgccguguuucaggaagagcagggguggacauccgcuagcgaagccgucaacgacucuagauucugggagcuuguggauaaagaacgggcucugcaccaagagggcaagugugagagcugcguuuauaacaugaugggaaaacgcgaaaagaagcucggcgaguuugggagagccaaaggaucccgggcgauuugguacauguggcugggcgcccgcuuccuugaauucgaggcucugggguuucucaaugaagaccauugguucggaagagagaacucuuggagcggcguggagggggaaggccugcaccggcugggauauauccucgaggaaaucgauaagaaagacggcgaucugauguacgccgacgauaccgcugggugggacacaagaauuaccgaggaugaccuucagaaugaggaacugaucacagagcagauggccccucaucacaagauucucgccaaagcgaucuuuaagcugaccuaucagaacaaggucgugaaagugcuucgccccacgccucggggagcuguuauggauauuaucuccagaaaggaccaacgcggcucugggcaggugggaacauacggccugaauaccuucaccaacauggaaguccagcucauccggcagauggaggccgaaggggugauuacacaagaugacaugcagaaucccaaaggccugaaggagagaguugagaaauggcugcgcgaaugcggaguggaccggcucaagagaauggccaucagcggcgaugacugugucgugaaaccgcuggaugagcgcuuugggaccucccuucuguuccucaacgacaugggaaagguccggaaggauauuccucagugggaacccucuaaaggcuggaagaauuggcaggaggugcccuuuugcagccaucacuuccacaaaaucuuuaugaaggacgggagaucccugguugugccuugucgcaaccaagaugaacuuauuggacgggcuagaaucagccagggcgccggguggucucugcgggagacagcuugccucggcaaagccuacgcgcagauguggucccugauguauuuccauagacgcgaccugcggcucgccagcauggcuaucuguucugccgucccgacggagugguuucccaccuccagaacaaccuggagcauucacgcucaucaccaguggaugacaaccgaagauaugcugaagguguggaaucgcguuuggaucgaggacaacccuaauaugauugauaagacgcccgugcacuccugggaagacaucccuuaccuuggaaaaagagaggaccuguggugcggcucucucauugggcugagcucccgggccaccugggcgaagaacauccauacagccauugcucaaguccgcaaucuuaucggaaaagaagaguauguggauuacaugcccgugaugaagagauauagcgccccuucugaguccgaaggcguucuguga

SEQ ID NO: 21012 - RNA, 9867 nt, Artificial Sequence
  derived and/or modified CDS sequence (opt5) from DENV-4__JN819406__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaagguggucggacgggugaucagcgcuacaccccucgccgagaacaccaacucuguuaccaauaucgagcuggaaccuccguucggcgacuccuauauugugaucggggucggaaacagcgcgcugacacuccauugguuuagaaaaggcucuagcauugggaagauguucgaguccacguaccgcggagcuaaacggauggccauccugggcgaaaccgccugggauuuugggucugugggcggacuuuucacaagccugggcaaggcuguucaccagguguuuggguccgucuauaccacaauguucggaggcgugagcuggaugauuagaauccucaucggguuucugguucuguggauuggaaccaauucucgcaacacguccauggccaugacaugcaucgcugugggcgggauuacccuuuuccucggcuuuaccguccaggccgacaugggauguguggugagcuggucugcgcgggagcugaagugcggcuccgggaucuucgucguugauaaugugcauacauggaccgaacaauaccaguuucagcccgagagcccugccagacuggcuuccgccauucucaacgcucacaaagacggaguguguggcauccgcucuacaacgcggcuggagaaugucauguggaagcagauuaccaacgaacuuaauuaugugcugugggaggggggacacgaccucacaguuguggccggcgaugucaaaggcgugcugaccaaggggaaaagagcgcugacacccccugccagcgaccuuaaguacuccuggaagaccuggggaaaagcuaagaucuucacgcccgaagcccggaacucuaccuuucucaucgauggcccggacacaagcgagugcccuaaugaacgcagagcuuggaacuccuucgagguugaggauuacggguucggaauguuuaccacaaauauuuggaugaaauuccgggaaggcagcucugaggugugugaccauagacugauguccgccgccaucaaggaucaaaaagcuguccacgcggacaugggguauuggauugaaagcucuaagaaccagaccuggcagaucgagcgcgccucccugauugaagugaaaacaugccucuggcccaagacccauacgcuguggagcaauggaguucuugagucucagaugcugaucccuaagagcuacgcuggccccuuuucccaacacaacuaucggcagggcuacgccacacagaccguggggccuuggcaccucggaaaacuggagaucgauuucggcgaaugccccgggaccacagucaccauucaggagaacugugaccauagaggaccgagccugcgcacgacaaccgccucuggcaagcuugugacacaauggugcuguagauccugcaccaugccuccccuccgguuucugggggaagauggauguugguauggcauggagauccgcccccugagcgagaaagaagagaauauggugaagucccaggucacagcuggccaggggaccucugaaacguucagcaugggacuccugugccuuacccuguuuguugaggaaugucucagacggcgcgugacaagaaaacacaugauucuggccguggucaucacccugugcgcgauuauccuuggcgggcucacauggauggaccugcugcgggcucucaucaugcugggagauaccauguccggccgcauugggggacagacgcaucuugccaucauggccguguucaagaugucuccuggcuacguucugggcguguuucucagaaagcugacaagccgggagaccgcucugauggucauugggauggccaugacaaccacccuuuccaucccgcacgaccugauggagcucauugacggaaucucucugggccucauccugcuuaaaauugugacacaauucgauaacacgcagguugggacccuggcgcucagccugacauuuauccgcuccaccaugagccuggugauggcuuggagaacaauuauggccguccuuuucguggucacccugaucccccucugucggacgucuugccugcagaagcaaucccauuggguggaaauuacagcccucauccugggagcucaggcccuuccuguuuaucugaugacccucaugaaaggcgcuagcagacgcucuuggccccugaaugaggggauuauggccgugggacuggucucccuucugggcagcgcgcuccugaagaacgacgugccucucgccggccccaugguugcugggggacugcuucuggccgcuuacgugaugucuggcuccagcgccgaucugucccucgaaaaagccgcuaauguccagugggacgagauggcggauaucaccgggagcucuccuaucauugaagugaagcaggacgaggauggaagcuuuuccauccgggacguggaggaaacaaacaugauuacccugcuuguuaagcuggcccucaucacagucucuggccuguacccccucgcuauuccgaucacgaugacccugugguauauguggcaagugaaaacacagagaagcggggcccuuugggaugugccuucccccgccgcuacccagaaggccgcgcugucugagggagucuaccgcaucaugcagcggggccuguucggcaaaacacaaguggggguuggaauucacauggaaggcguguuccacaccauguggcaugucacgagagggagcgugaucugucacgagaccggacgccucgaaccuuccugggcugacguucggaaugauaugauuucuuauggcgggggauggagacugggcgacaagugggauaaagaggaggacgugcagguccuugccaucgaacccggcaagaacccgaagcaugugcagacaaaaccugggcuguuuaagacccucacaggagagauuggcgccguuacccuggacuucaaacccgggacaagcggauccccuaucaucaaucgcaagggcaaagugauugggcucuacggcaacggagucgugacgaagagcggcgauuaugugucugcuaucacccaggccgaacggauuggggagcccgacuacgaggucgaugaagacaucuuuagaaaaaagcggcugacaauuauggaucuucaccccggagcgggcaagaccaaacgcauccugccuuccauuguuagagaggcucugaagcggcgccucagaacccugauccuugccccgacacgggugguggccgcugaaauggaggaagcccugagagggcuccccauccgcuaucaaacgccugcugucaaaagcgagcauaccggacgggagauuguggaccugaugugccacgccacauucaccacaagacuccugucuuccacccgcguucccaauuacaaccuuaucgugauggaugaagcgcacuuuacggacccuagcuccgucgccgcucggggcuacauuucuacaagaguggagaugggggaagccgcugccaucuucaugaccgccacccccccuggcgcuacagauccguuuccccagagcaauuccccuauugaggacaucgaacgcgagauccccgagcggagcuggaacaccggauucgauuggauuacagacuaucagggcaagaccguuugguuugugccuucuaucaaagcggggaaugacauugccaacugccugagaaaguccggaaagaaagucauccaacugagccgcaagacguucgauacagaauaccccaaaaccaagcucacagacugggauuuuguggucaccacggacauuucugagaugggcgcuaacuucagagccgggcgggugaucgauccgcgcagaugucugaaaccuguuauccuuaccgacggacccgaacgggugauucuggccggccccaucccugugacacccgcuagcgccgcgcagcgcagagggcggauuggcagaaauccugcucaggaggaugaccaguaugucuucuccggagauccgcucaagaacgacgaagaucaugcccacuggaccgaggccaagaugcugcuggacaauaucuacacacccgagggcauuaucccuacccucuuugggcccgaacgcgagaaaacacaagcuauugauggagaauuccggcuuagaggcgagcagcgcaagaccuuuguugagcugaugcggagaggggaccugccuguguggcucucuuauaaaguggccagcgcgggaaucuccuacaaggaccgggaauggugcuucacgggcgagcgcaacaaucagauccuggaagagaacauggaagucgagauuuggacaagagagggcgaaaaaaagaagcuucggcccaaauggcuggaugcccgcguguaugcugacccgauggcccucaaggauuuuaaagaguucgcuucugggagaaagagcaucacccuggacauucugaccgaaaucgccucccucccuacauaccuuagcucucgggcuaaacuggcccuggauaauauuguuaugcuccauaccacagagcgcggaggcagagcguaccagcacgcccugaacgaacuucccgagucccuggagacgcucaugcugguggcucugcucggggccaugaccgcuggaaucuuucuuuucuuuaugcaaggcaaggggaucggaaagcugagcaugggccugauuacaaucgccgucgccuccggccuccuguggguggcugaaauucagccucaguggaucgcggccucuauuauccuugaguucuuucugaugguccuccugauccccgaaccugagaaacagcggaccccccaagacaaucagcugauuuaugugauccucacaauucuuaccaucauugggcugaucgcugccaacgaaaugggacugauugagaagacgaaaaccgauuucggcuuuuaccagguuaagacagagaccacaauccucgacguggaucugcgcccggccagcgcuuggacccuuuaugccgucgcgacgacaauccugaccccuaugcucagacacacaauugaaaauaccuccgccaaccugucucuggcugccaucgcuaaucaggccgcggugcucauggggcuuggaaaaggcuggccccugcaucggauggaccuggggguuccccuccuggccaugggauguuacagccaagugaacccuaccacacuuacggcuucccuggucaugcuccuggugcacuaugccauuaucggcccgggccugcaggcuaaggccaccagagaggcucagaaacgcacagccgcggggauuaugaagaaucccaccguggauggaaucacaguuaucgaccucgaaccuauuagcuacgaucccaaguucgagaaacaacuuggccaggucaugcugcuggugcucugcgccgggcagcugcuucugaugcggaccacgugggcuuucugugaggugcucacacuggccaccggaccuauccugacccucugggaaggcaaccccgggagauuuuggaacacaaccauugcugucucuacagccaauaucuuccgcggauccuaucuugccggcgcgggccuggcuuuuagccugauuaagaacgcccagacgccucggagagggaccggaacaaccggcgagacacucggggaaaaauggaagcgccaacugaauucucuugaccggaaagaguucgaagaguacaagagauccggaauccuggagguugaccgcaccgaagcuaagagcgcccucaaagauggcucuaagaucaaacaugccgugagccggggguccucuaagauuagauggaucguggagcgcggaauggucaaaccgaagggcaaggugguugaccugggcugcgggcggggaggcuggagcuacuauauggcuacgcugaaaaacgugaccgaagucaagggguacacaaaaggaggccccgggcacgaggaaccuauucccauggccaccuauggauggaaucucgugaagcuucauuccggcguugauguguuuuacaaaccuacagagcaggucgacacccugcugugugauaucggcgagagcuccucuaaccccacaauugaagaggggagaacccuccgcgugcugaagaugguggaaccguggcuuagcuccaagccugaguucugcaucaaaguccugaaucccuauaugcccacgguuauugaagagcucgagaagcugcagagaaaacacggaggcaaccuggugcgguguccucucucucgcaauagcacacacgaaauguacuggguguccggggcgucuggaaacaucgucagcuccgugaauaccaccagcaagaugcuucugaacagauuuacaacgcggcauagaaaacccaccuaugagaaggacguugaucugggcgccgggacacggucuguguccaccgaaacagagaaaccugacaugaccaucauuggacgcagacuccagcggcugcaagaggaacacaaggagacauggcauuacgaucaggaaaauccguaccgcaccugggcuuaucacggcagcuacgaggcccccucuacgggcuccgcuagcucuauggucaacggggugguuaagcuucugaccaaaccuugggacgugauccccauggucacacagcucgccaugaccgauacaaccccuuucggacagcaaagaguguuuaaggaaaaaguugacacgcggacaccccagccgaagccuggcacccgcauggugaugacaaccacggcgaauuggcugugggcccugcucgggaaaaagaagaaccccagacugugcacccgggaggaguucauuuccaaaguccgcagcaaugcugccaucggagcuguguuucaggaagagcaaggcuggacauccgccagcgaagcugucaacgacucuagauucugggagcuuguggauaaggaacgggcccugcaccaggaggggaaaugugagagcugcguuuauaacaugaugggcaagcgcgaaaaaaagcucggagaguuuggcagagcgaaggggucccgggccauuugguacauguggcugggagcucgcuuccuugaauucgaggcccugggcuuucucaaugaagaccauugguucgggagagagaacucuuggagcggaguggagggcgaagggcugcaccggcugggcuauauccucgaggaaaucgauaaaaaggacggagaucugauguacgcugacgauaccgccggcugggacacaagaauuaccgaggaugaccuucagaaugaggaacugaucacagagcagauggccccucaucacaaaauucucgcgaaggcuaucuuuaaacugaccuaucaaaacaaggucgugaaggugcuucgccccacgccucggggggccguuauggauauuaucuccagaaaagaccagcgcggaucuggccagguggggacauacggacugaauaccuucaccaacauggaaguccagcucauccggcaaauggaggccgaaggcgugauuacacaggaugacaugcagaaucccaaggggcugaaagagagaguugagaaguggcugcgcgaaugcggcguggaccggcucaaaagaauggcuaucagcggagaugacugugucgugaagccgcuggaugagcgcuuuggcaccucccuucuguuccucaacgacauggggaaaguccggaaggauauuccucagugggaacccucuaagggauggaaaaauuggcaagaggugcccuuuugcagccaucacuuccacaagaucuuuaugaaagacggcagaucccugguugugccuugucgcaaccaggaugaacuuauugggcgggccagaaucagccagggagcuggcuggucucugcgggagacagccugccucgggaaggcguacgcccagauguggucccugauguauuuccauagacgcgaccugcggcucgcuagcauggccaucuguucugcugucccgacggagugguuucccaccuccagaacaaccuggagcauucacgcccaucaccaauggaugacaaccgaagauaugcugaaaguguggaaucgcguuuggaucgaggacaacccuaauaugauugauaagacgcccgugcacuccugggaagacaucccuuaccuuggcaagagagaggaccuguggugcggaucucucauuggccugagcucccgggcgaccugggccaaaaacauccauacagcuauuacccagguccgcaaucuuaucgggaaggaagaguauguggauuacaugcccgugaugaaaagauauagcgccccuucugaguccgaaggaguucuguga

SEQ ID NO: 21013 - RNA, 9867 nt, Artificial Sequence
  derived and/or modified CDS sequence (opt5) from DENV-4__GQ199876__SS-prME
agcaccaucacacugcucugccugauucccacggugauggccuuccaccuuuccaccagagacggcgagccucugaugaucgucgcuaagcaugaacgggggcgcccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauccuuagaaauccuggcuucgcucugcucgccggcuuuauggcuuacaugaucgggcagacaggaauucagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguaucgaagcucuuauuagcaauaucaccacagccacccgcugcccgacgcaaggagagcccuaucugaaggaggaacaggaccagcaguacauuuguagacgggaugugguggaccgcggcugggggaacggaugcggccucuucgggaaaggaggcgucgugacaugcgcgaaguuuucuuguuccggcaaaaucaccgggaaucugguucaaauugagaaccuugaauauaccguggucgugacaguucauaauggagauacccacgccgugggcaacgacacaagcaaucacggggucacggcuaccaucacaccuagaucucccuccguggaggucaagcugccugauuacggagaacucacccuggacugcgagccccggagcggcaucgacuucaacgagaugauucugaugaagaugaaaaagaaaacauggcucgugcauaagcagugguuucuggaucuuccgcugccuuggaccacgggggccgacaccucugaaguucacuggaauuacaaagagagaauggugacauucaaggucccccaugcuaaacgccaggaugugaccguucucggcucccaggaaggagccaugcacagcgcccuggcuggcgcgacagagguggacuccggggauggaaaccacauguuugccggccaucuuaaguguaagguccggauggaaaaacugagaaucaaggggaugucuuauaccaugugcagcggaaaauucuccauugacaaggagauggcugagacgcaacacggcacaaccguggugaaaguuaaguacgaaggggccggcgccccuuguaagguccccaucgagauucgcgaugugaauaaagaaaaggugaucggacgggucaucagcgcuacaccccucgccgagaacaccaacucugugaccaauauugagcuggaaccuccguucggcgacuccuauaucguuauuggggugggaaacagcgcgcugacacuccauugguuuagaaaaggcucuagcaucgggaagauguucgaguccacguaccgcggagcuaaacggauggccauucugggcgaaaccgccugggauuuugggucugucggcggacuuuucacaagccugggcaaggcugugcaccagguuuuuggguccguguauaccacaauguucggaggcgucagcuggaugaucagaauccucauuggguuucuggugcuguggaucggaaccaauucucgcaacacguccauggccaugacaugcauugcuguuggcgggaucacccuuuuccucggcuuuaccgugcaggccgacaugggaugugucgugagcuggucuggccgggagcugaagugcggguccggaauuuucguggucgauaauguucauacauggaccgaacaauacaaauuucagcccgagagcccugcgagacuggccuccgcuauccucaacgcccacaaggacggcgugugugggauucgcucuacaacgcggcuggagaaugugauguggaaacagaucaccaacgaacuuaauuauguccugugggagggaggccacgaccucacagugguugcuggcgaugugaaggggguccugaccaaaggaaagagagcccugacacccccugcgagcgaccuuaaguacuccuggaaaaccuggggcaaggccaaaaucuucacgcccgaagcucggaacucuaccuuucucauugaugggccggacacaagcgagugcccuaaugaacgcagagccuggaacuccuucgagguggaggauuacggauucggcauguuuaccacaaauaucuggaugaaguuccgggaagggagcucugagguuugugaccauagacugauguccgcugccauuaaagaucagaaggccgugcacgcugacaugggauauuggaucgaaagcucuaaaaaccaaaccuggcagauugagcgcgcgucccugaucgaagucaagacaugccucuggcccaagacccauacgcuguggagcaauggcgugcuugagucucagaugcugaucccuaaaagcuacgccggccccuuuucccagcacaacuaucggcaaggguacgcuacacagaccguuggaccuuggcaccucggcaagcuggagauugauuucggggaaugccccggaaccacagugaccauccaggagaacugugaccauagaggcccgagccugcgcacgacaaccgccucugggaaacuugucacacaguggugcuguagauccugcaccaugccuccccuccgguuucugggagaagauggcuguugguauggcauggagauucgcccccugagcgagaaggaagagaauauggugaaaucccaagugacagccgggcagggaaccucugaaacguucagcaugggccuccugugccuuacccuguuugucgaggaaugucucagacggcgcguuacaagaaagcacaugauccuggcuguggugauuacccugugcgccaucauccuugggggacucacauggauggaccugcugcgggcgcucauuaugcugggcgauaccauguccgggcgcaucggaggccagacgcaucuugcuauuauggccgucuucaagaugucuccuggcuacgugcuggggguuuuucucagaaaacugacaagccgggagaccgcccugauggugaucggaauggcuaugacaaccacccuuuccauuccgcacgaccugauggagcucaucgacggcaucucucuggggcucauucugcuuaagaucgucacacaguucgauaacacgcaagugggaacccuggcccucagccugacauuuauucgcuccaccaugagccugguuauggcguggagaacaaucauggcugugcuuuucgucgugacccugauuccccucugucggacgucuugccugcagaaacagucccauugggucgaaaucacagcccucauucugggcgcccaagcucuuccuguguaucugaugacccucaugaagggggccagcagacgcucuuggccccugaaugagggaaucauggcuguuggccuggugucccuucugggcagcgcccuccugaaaaacgacgucccucucgcggggcccaugguggccggaggccugcuucuggcugccuacguuaugucuggguccagcgcugaucugucccucgaaaaggccgccaaugugcagugggacgagauggcugauaucaccggaagcucuccuauuaucgaagucaagcaggacgaggauggcagcuuuuccauucgggacguggaggaaacaaacaugaucacccugcuugugaaacuggcgcucauuacaguuucugggcuguacccccucgccaucccgaucacgaugacccugugguauauguggcaggucaagacacaaagaagcggagcucuuugggaugugccuucccccgccgccacccagaaagcugcccugucugagggcguguaccgcauuaugcagcggggccuguucgggaagacacaggucggagugggcauccacauggaagggguuuuccacaccauguggcaugugacgagaggaagcgucauuugucacgagaccggccgccucgaaccuuccugggcggacgugcggaaugauaugaucucuuaugggggaggcuggagacugggcgacaaaugggauaaggaggaggacguucaagugcuugcuauugaacccgggaagaacccgaaacauguccagacaaagccuggacuguuuaaaacccucacaggcgagaucggggccgugacccuggacuucaagcccggaacaagcggcuccccuaucauuaaucgcaaagggaagguuaucggccucuacggaaacggcguggucacgaaaagcggggauuaugugucugccauuacccaggcugaacggaucggagagcccgacuacgagguggaugaagacauuuuuagaaagaagcggcugacaaucauggaucuucaccccggcgccgggaaaaccaagcgcauucugccuuccaucgucagagaggcgcugaaacggcgccucagaacccugauccuugcuccgacacggguuguggccgccgaaauggaggaagcucugagaggacuccccgugcgcuaucagacgccugccgucaagagcgagcauaccggccgggagauuguggaccugaugugccacgcuacauucaccacaagacuccugucuuccacccgcguucccaauuacaaccuuaucgugauggaugaagcccacuuuacggacccuagcuccgucgcggcccggggguacauuucuacaagaguggagaugggcgaagcugccgcuaucuucaugaccgccacccccccuggagccacagauccguuuccccaaagcaauuccccuauugaggacaucgaacgcgagauccccgagcggagcuggaacaccggcuucgauuggauuacagacuaucaggggaaaaccguuugguuugugccuucuaucaaggcuggaaaugacauugcgaacugccugagaaaguccggcaaaaaggucauccagcugagccgcaaaacguucgauacagaauaccccaagaccaaacucacagacugggauuuuguggucaccacggacauuucugagaugggggccaacuucagagcuggacgggugaucgauccgcgcagaugucugaagccuguuauccuuaccgacggccccgaacgggugauucuggccgggcccaucccugugacacccgccagcgcugcccaacgcagaggccggauuggaagaaauccugcgcaggaggaugaccaguaugucuucuccggcgauccgcucaagaacgacgaagaucaugcucacuggaccgaggccaaaaugcugcuggacaauaucuacacacccgaggggauuaucccuacccucuuuggacccgaacgcgagaagacacaggccauugauggcgaauuccggcuuagaggggagcaacgcaaaaccuuuguugagcugaugcggagaggagaccugccuguguggcucucuuauaagguggcuagcgccggcaucuccuacaaagaccgggaauggugcuucacgggcgagcgcaacaaucagauccuggaagagaacauggaagucgagauuuggacaagagagggggaaaagaagaaacuucggcccaaguggcuggaugcgcgcguguaugccgacccgauggcucucaaagauuuuaaggaguucgccucuggaagaaaaagcaucacccuggacauucugaccgaaaucgcuucccucccuacauaccuuagcucucgggccaagcuggcucuggauaauauuguuaugcuccauaccacagagcgcggcgggagagccuaccagcacgcgcugaacgaacuucccgagucccuggagacgcucaugcugguggcccugcucggagcuaugaccgccggcaucuuucuuuucuuuaugcaggggaagggaaucggcaaacugagcaugggccugauuacaaucgcugucgccuccgggcuccuguggguggccgaaauucaaccucaguggaucgcugcgucuauuauccuugaguucuuucugaugguccuccugauccccgaaccugagaagcagcggaccccccaggacaaucaacugauuuaugugauccucacaauucuuaccaucauuggacugaucgccgcuaacgaaaugggccugauugagaaaacgaagaccgauuucggguuuuaccagguuaaaacagagaccacaauccucgacguggaucugcgcccggccagcgccuggacccuuuaugcugucgccacgacaauccugaccccuaugcucagacacacaauugaaaauaccuccgcgaaccugucucuggccgcuaucgccaaucaggcugccgugcucaugggacuuggcaagggguggccccugcaucggauggaccugggaguuccccuccuggcgaugggcuguuacagccaggugaacccuaccacacuuacggccucccuggucaugcuccuggugcacuaugcuauuaucggcccggggcugcaagccaaagcuaccagagaggcccagaagcgcacagcugccggaauuaugaagaaucccaccguggauggcaucacaguuaucgaccucgaaccuauuagcuacgaucccaaauucgagaagcagcuugggcaagucaugcugcuggugcucugcgcgggacagcugcuucugaugcggaccacgugggccuucugugaggugcucacacuggcuaccggcccuauccugacccucugggaagggaaccccggaagauuuuggaacacaaccauugccgucucuacagcuaauaucuuccgcggcuccuaucuugccggcgccgggcuggcguuuagccugauuaaaaacgcucagacgccucggagaggaaccggcacaaccggggagacacucggagaaaaguggaaacgccagcugaauucucuugaccggaaggaguucgaagaguacaagagauccggcauccuggagguugaccgcaccgaagccaaaagcgcucucaaggaugggucuaaaaucaagcaugccgugagccggggauccucuaaaauuagauggaucguggagcgcggcauggucaagccgaagggcaaagugguugaccuggggugcggacggggcggguggagcuacuauauggccacgcugaagaacgugaccgaagucaaaggauacacaaagggcgggcccggacacgaggaaccuauucccauggcuaccuauggcuggaaucucgugaaacuucauuccggcguugauguguuuuacaagccuacagagcaagucgacacccugcugugugauaucggggagagcuccucuaaccccacaauugaagagggaagaacccuccgcgugcugaagaugguggaaccguggcuuagcuccaaaccugaguucugcaucaagguccugaaucccuauaugcccacgguuauugaagagcucgagaaacugcagagaaagcacggcgggaaccuggugcgguguccucucucucgcaauagcacacacgaaauguacuggguguccggagccucuggcaacaucgucagcuccgugaauaccaccagcaaaaugcuucugaacagauuuacaacgcggcauagaaagcccaccuaugagaaagacguugaucugggggcgggaacacggucuguguccaccgaaacagagaagccugacaugaccaucauuggccgcagacuccagcggcugcaggaggaacacaaggagacauggcauuacgaucaagaaaauccguaccgcaccugggccuaucacggcagcuacgaggcucccucuacgggguccgccagcucuauggucaacggagugguuaaacuucugaccaagccuugggacgugauccccauggucacacagcucgcuaugaccgauacaaccccuuucggccagcagagaguguuuaaagaaaagguugacacgcggacaccccaaccgaaaccugggacccgcauggugaugacaaccacggccaauuggcugugggcgcugcucggaaagaagaaaaaccccagacugugcacccgggaggaguucauuuccaagguccgcagcaaugccgcuaucggcgccguguuucaggaagagcagggguggacauccgcuagcgaagccgucaacgacucuagauucugggagcuuguggauaaagaacgggcucugcaccaagagggcaagugugagagcugcguuuauaacaugaugggaaaacgcgaaaagaagcucggcgaguuugggagagccaaaggaucccgggcgauuugguacauguggcugggcgcccgcuuccuugaauucgaggcucugggguuucucaaugaagaccauugguucggaagagagaacucuuggagcggcguggagggggaaggccugcaccggcugggauauauccucgaggaaaucgauaagaaagacggcgaucugauguacgccgacgauaccgcugggugggacacaagaauuaccgaggaugaccuucagaaugaggaacugaucacagagcagauggccccucaucacaagauucucgccaaagcgaucuuuaagcugaccuaucagaacaaggucgugaaagugcuucgccccacgccucggggagcuguuauggauauuaucuccagaaaggaccaacgcggcucugggcaggugggaacauacggccugaauaccuucaccaacauggaaguccagcucauccggcagauggaggccgaaggggugauuacacaagaugacaugcagaaucccaaaggccugaaggagagaguugagaaauggcugcgcgaaugcggaguggaccggcucaagagaauggccaucagcggcgaugacugugucgugaaaccgcuggaugagcgcuuugggaccucccuucuguuccucaacgacaugggaaagguccggaaggauauuccucagugggaacccucuaaaggcuggaagaauuggcaggaggugcccuuuugcagccaucacuuccacaaaaucuuuaugaaggacgggagaucccugguugugccuugucgcaaccaagaugaacuuauuggacgggcuagaaucagccagggcgccggguggucucugcgggagacagcuugccucggcaaagccuacgcgcagauguggucccugauguauuuccauagacgcgaccugcggcucgccagcauggcuaucuguucugccgucccgacggagugguuucccaccuccagaacaaccuggagcauucacgcucaucaccaguggaugacaaccgaagauaugcugaagguguggaaucgcguuuggaucgaggacaacccuaauaugacggauaagacccccgugcacuccugggaagacauuccuuaccuuggaaaaagagaggaccuguggugcggcucucucaucgggcugagcucccgggccacaugggcgaagaacauucauaccgccaucacacaaguccgcaaucuuauuggaaaagaagaguauguggauuacaugcccgugaugaagagauauagcgcuccuucugaguccgaaggcguucuguga

SEQ ID NO: 21014 - RNA, 9867 nt, Artificial Sequence
  derived and/or modified CDS sequence (opt5) from DENV-4__KP723482__SS-prME
agcaccaugacacugcucugccugauccccacggugauggccuuccaccuuuccaccagagacggcgagccucugaugauugucgcuaagcaugaacgggggcgcccgcuccuguuuaaaacaaccgagggaaucaacaaguguacacuuauugccauggaucugggcgaaaugugcgaggacaccguuacauacaaauguccccuccuggugaauaccgaaccugaggauaucgacugcugguguaaccugacgucuaccugggugauguaugggacaugcacccagagcggagagagacggcgcgaaaagagauccgucgcgcucacaccccacucuggcauggggcuggagacccgggcugaaacguggaugagcuccgagggagccuggaaacaugcccaacgcguggagucuuggauucuuagaaauccuggcuucgcucugcucgccggcuuuauggcuuacaugaucgggcagacaggaauccagcggaccguuuucuuugugcugaugaugcuugucgcccccagcuauggcaugcgcuguguggggguuggaaacagagauuucguggaaggcgucuccgggggagcguggguggaccuggugcucgagcacggcggcugcgucacaaccauggcccaggggaagccuacccuggauuuugaacugacaaagacgaccgcuaaagagguugcccuccugcggacauacuguauugaagcuagcaucucuaauauuaccacagccacccgcugcccgacgcaaggagagcccuaucuuaaggaggaacaggaccagcaguacaucuguagacgggaugugguggaccgcggcugggggaacggaugcggccuguucgggaaaggaggcgucgugacaugcgcgaaguuucucuguuccggcaaaauuaccgggaaucugguucaaaucgagaaccuugaauauaccguggucgugacaguucauaauggaaacacccacgccgugggcaaugauacaagcaaccacggggucacggcuaccauuacaccuagaucucccuccguggaggucaagcugccugacuacggagaacucacccuggauugcgagccccggagcggcaucgacuucaaugagaugauccugaugaagaugaaaaagaaaacauggcucgugcauaagcagugguuucuggaccuuccgcugccuuggaccgccggggcugauacgucugaaguucacuggaacuacaaagagagaauggugaccuucaaggucccccaugccaaacgccaggacgugacaguucucggcucccaggaaggagccaugcacagcgcucuggcgggcgccaccgagguggauuccggggacggaaaucacauguuugcuggccaucuuaaguguaagguccggauggaaaaacugagaauuaaggggaugucuuauacaaugugcagcggaaaauucuccaucgauaaggagauggccgagacccaacacggcacgacaguggugaaaguuaaguacgaaggggccggcgcuccuuguaagguccccauugagauccgcgacgugaacaaagaaaagguggucggacggauuaucagcucuacccccuucgccgagaacacaaauuccgugaccaacaucgagcucgaaccuccguuuggcgauagcuauauuguuaucggggugggagacucugcgcugacccugcauugguucagaaaaggcagcuccauugggaagauguuugagucuacauaccgcggagcuaaacggauggccauccucggcgaaacggccugggauuucgggagcgucggcggacuguuuaccucccuuggcaaggcugugcaccagguuuucgggagcguguauacaaccauguuuggaggcgucucuuggaugauuagaauccugaucggguuccucgugcuguggauuggaacaaauucccgcaacaccagcauggccaugacgugcaucgcuguuggcgggauuacacuguuucuuggcuucaccgugcaggccgacaugggaugugucgugucuuggaauggcaaggagcucaaaugcggguccggaaucuuuguggucgauaacguucauaccuggacagaacaauacaaguuccagcccgagagcccugcgcggcuggccuccgcuauucugaaugcccacaaagacggcgugugugggaucagaucuaccacacgccucgagaacgugauguggaagcagauuacgaaugaacugaacuauguccuuugggagggaggccacgaccugaccgugguugcuggcgaugugaaagggguccucacaaagggaaagcgggcccugacccccccugugaaugaccugaaauacagcuggaagacauggggcaaagcgaagaucuuuacccccgaagccagaaacuccacguuccuuaucgaugggccggacaccucugagugcccuaaugaacggcgcgcuuggaacuucuuugagguugaggauuacggauucggcauguuuacaaccaauauuuggaugaaauucagagaagggagcuccgaggugugugaccaucggcucaugagcgccgcuaucaaggaucagaaagccguccacgccgacaugggauauuggauugaaucuuccaagaaccaaacauggcagaucgagaaggcuagccugauugaagugaaaaccugccuguggcccaagacacauacccucuggucuaacggcguucuggagucccagaugcuuaucccuagaagcuacgcgggccccuuuucucagcacaauuaucgccaaggguacgccacgcagacagcuggaccuuggcaccugggcaaacucgagaucgauuucggggaaugccccggaaccaccgugacaauucaggaggacugugaucaucggggcccgagccugagaaccacgacagccuccgggaagcuggucacccaguggugcugucgcagcugcacaaugccuccccuuagauuucucggagaagacggcuguugguauggcauggagauccggccccugucugagaaagaagagaacauggugaagucccaagugaccgccgggcagggaacaagcgaaaccuucuccaugggccugcucugccugacgcuuuuugucgaggaaugucugcgcagacggguuacccgcaagcacaugauucucgcuguggugaucacauucugcgccauuauccuggggggacugaccuggauggaucuucucagaguccugaucaugcugggcgacacaaugucugggcggauuggaggccagauccaucucgcgauuauggcuguguuuaaaaugagcccuggcuacguucuggggguguuccuucgcaagcugaccuccagagagacggcccucauggucaucggaauggccaugacaaccguguuuucuauuccgcacgaccugauggagcugaucgauggcaucagccuugggcugauucuccugaaaaucguuacacauuucgacaauacccaggugggaacccucgcucugucccuuacauucauucggucuacgaccccccuggucauggccuggcgcacaaucauggcgguguuuuucgucgugacccucauuccucuguguagaacaagcugccugcaaaagcagucccacuggguugaaaucaccgcucuuauucugggcgcccaggcccuccccguguaucugaugacgcucaugaaaggggcuagccggagaucuuggccucugaacgagggaaucauggccgucggccuugugucccugcucggcagcgcucugcugaagaaugauguuccccuugccgggccuaugguggcgggaggccugcuccuggccgcuuacgucaugucuggguccagcgccgaccucucucuggaaaaggcugccaacgugcaaugggaugagauggccgacaucacaggauccagccccauuaucgaagugaaacaggaugaggacggcuccuuuagcauucgcgauguugaggaaaccaauaugaucacccuucuggucaagcuggcucucauuacagugucugggcuguacccgcuugcgaucccugugaccauggcccugugguaugucuggcaggugaaaacacagcggagcggagcucucugggacguucccuccccuucugccacgcaaaaggccacccugagcgagggcguguacagaaucaugcagcgcggccucuucgggaaaacacaggucggagugggcauucacauggaagggguuuuucauaccauguggcacgugacacggggauccgucaucugucaugagaccggcagacuggaacccucuugggcugaugugcgcaacgacaugauuagcuaugggggaggcuggcggcuuggcgauaagugggacaaggaggaggacguucaggugcuggccaucgaaccggggaaaaauccuaagcacguccaaacgaaacccggacuguucaagacccucacaggcgagauuggggcggugacccuggauuuuaaaccuggaacauccggcucucccaucaucaacaagaaagggaaggugauuggccuuuacggaaauggcgucguuaccaagagcggggacuauguguccgcuaucacacaggccgaaagaauuggagagcccgauuacgagguggacgaagauaucuuccgcaaaaagcggcugacgauuauggaccuccauccuggcgccgggaaaaccaagagaauccugccgagcauuguccgggaggcucucaaacgcagacugcggacacuuauccuggcccccacccgcgugguugcggcugaaauggaggaagcccugagaggacucccuauccgguaucagacccccgccgugaagucugagcacacaggcagagagauugucgaucugaugugccacgcuacguuuaccacacgccuucuguccagcacccgggugccuaacuacaaucucaucguuauggacgaagcccauuucacagaucccugcucuguggcugccagaggguacauuuccacccgcgucgagaugggcgaagcggccgcuaucuuuaugacggccacaccuccgggaagcauugaccccuucccucaguccaacucucccaucgaggauaucgaacgggagauuccugagagaagcuggaauaccggcuucgacuggaucaccgacuaucaagggaagacagugugguuuguccccuccauuaaagcuggaaacgauaucgccaacugucugcgcaagagcggcaaacgggugauucagcucucuagaaagaccuucgacacagaauacccgaaaaccaagcugacggauugggacuuuguugugacaaccgauaucuccgagaugggggccaauuuccgcgcuggaagagugaucgacccucggcgcugccuuaagcccgucauucugacagauggccccgaaagaguuauccuggcggggccuauucccgugaccccugccagcgcugcccagcggcgcggcagaaucggacggaacccggcccaagaggacgaucaguauguguuuucuggcgacccccucaaaaaugaugaagaccacgcucauuggacggaggccaagaugcugcuugauaacauuuacaccccugaggggaucauucccacacuguucggaccugaaagagagaaaacccaggcgaucgacggcgaauuucgccuccggggggagcagagaaagacauucgucgagcugaugcgccggggagaccugcccguguggcucagcuauaaaguugcuuccgccggcaucucuuacaaggauagagaaugguguuuuaccggcgagcggaauaaccaaauucuugaagagaauauggaaguggagaucuggacacgcgagggggaaaagaaaaagcugagaccgaaauggcuggacgcccgggucuaugcugauccuauggcccucaaggacuucaaagaguuugcgagcggacgcaaguccauuacccuggauauccuuacggaaauugccacacugcccaccuaccucucuagcaaggcuaaacuggcccuggacaacaucgugaugcuccacaccacagagaagggcgggagagcuuaccagcacgcccuuaaugaacugccugagucccuggagacccucaugcuggucgcucuucugggagccaugacagcgggcaucuuccucuuuuucaugcaggggaaaggaauuggcaagcugagcaugggccugaucgccauugcuguggccucugggcuccuuuggguugcugaaauccagccccaauggauugccgccuccaucauccuggaguucuuucugauggugcuccugauuccugaacccgagaaacagcggacgccgcaggauaaccagcuuaucuaugucauucugaccauccucacaauuaucggacugauugcugcgaaugaaaugggccugaucgagaagaccaaaacagacuucggguuuuaccaagugaagccugagaccacgauccucgauguugaccuucgccccgccagcgcuuggacccuguaugccguggccacaaccauucugacacccaugcucagacauaccaucgaaaacacguccgcuaaucugucucuugccgcgauugccaaccaggcugccguccugaugggacucggcaagggguggccucugcaccggauggaucugggagugccgcuccuugcuaugggcugcuacagccaggugaaucccacaacccugacagccucccugguuaugcuccugguccauuaugcgaucauuggcccugggcuucaggccaaagcuacccgcgaggcccaaaagagaaccgcugccggaaucaugaaaaaccccacaguggacggcaucacggugauugaucuggaaccuaucucuuacgaccccaaguucgagaaacagcucgggcaggucaugcugcugguucucugugugggacaacuucugcugaugcggaccacaugggcucucugcgaggugcugacccuugccacaggcccugucaugacccugugggaagggaacccgggaagauuuuggaauacgacaauugcggugagcaccgccaacaucuuccgcggcuccuaucucgcuggcgccgggcuggcuuuuagccugauuaagaaugcccagaccccccggagaggaacaggcaccacaggggagacgcucggagaaaaguggaaacgccagcuuaacucucuggaccggaaggaguucgaagaguacaaaagauccggcauccuggagguugaucgcaccgaagccaagagcgcgcuccgggacgggacaaaaaucaaguacgcugugucuagaggauccagcaagauucgcuggaucgucgagcggggcaugauuaaaccuaagggcaaagugguugaucugggguguggaagaggcggguggucuuauuacauggccacccuuaagaaugugacagaagucaaaggauauaccaagggcgggcccggacacgaggaaccuauccccauggcuacguacggcuggaaccuggugaagcuccauagcggcguggacgucuuuuauaaaccgaccgagcagguugauacacugcugugcgacauuggggaguccucuagcaauccuaccaucgaagagggacgcacacuccgggugcuuaagaugguggaacccuggcuguccagcaaacccgaguucuguauuaagguccugaacccuuacaugcccaccgugaucgaagagcucgagaaacugcaaagacgccacggcgggucccuuguuagaugcccucugucucggaauagcacacacgaaauguauuggguguccggagccucuggcaacaucgucagcuccgugaauaccauuucuaagaugcuccugaaccgcuuuacgacaagacaucggaaaccgaccuacgagaaggauguugaccugggggccggaaccagaagcguguccacagaaacggagaagcccgauaugaccgucaucggccggcgccuccagagacuucgggaggaacacaaagagacauggcauuacgaccaggaaaauccuuaucgcaccugggcuuaccacggcagcuaugaggcccccucuacaggguccgcgagcucuauggugaacggaguugugaagcugcugaccaaaccuugggaugucauucccauggugacacagcucgccaugaccgacacgaccccguucggccaacagagagucuuuaaggaaaaaguggacacacggaccccucagcccaagccugggacacgcaugaucaugaccacgacagcuaauuggcugugggcccuucugggaaagaaaaagucccccagacucuguacccgggaggaguucauuagcaaaguucgcucuaacgcugccaucggcgcgguguuccaggaagagcaaggguggacauccgccagcgaagcugucaaugauuccagauuuugggagcugguggacaaggaacgggcccugcaccaggagggcaaaugcgagagcugcguguacaacaugaugggaaagcgcgaaaagaaacucggcgaguucgggagagcuaagggaucucgggccaucugguauauguggcugggcgcucgcuuucuugaauucgaggcccugggguuucucaacgaagaucauugguucagcagagagaauuccuggucuggaguugagggcgaagggcugcaccggcuuggcuacauucuggaggacaucgauaaaaaggacggagaucucauuuaugcggacgauaccgccggcugggacacgagaaucaccgaagaugaccugcugaacgaggagcucauuacagaacagauggcuccucaucacaaaacccuggccaaggcuaucuuuaagcuuacauaccaaaauaaaguggucaaggugcugcgccccaccccgaaaggggccguuauggauaucauuagccggaaggaccagagaggauccggccagguggggacauacggacucaacaccuucacgaauauggagguccagcugauccgccaaauggaagccgagggcgugauuacacaggacgauaugcagaacccuaaagggcuuaaggaacgggucgagaaauggcugaaggaguguggcguggacagacucaagcgcauggcgaucucuggagaugacugcguugugaaaccccuggaugaacgguuuagcaccucccugcucuuccugaaugacaugggcaaggucagaaaagauauuccccagugggagccuucuaagggguggaaaaacuggcaagaagugccguuuuguagccaucacuuccacaagaucuuuaugaaggacggacgcucccuuguugugcccugccggaaucaggaugagcugaucggcagagcucgcauuagccagggggccggauggucucuccgggaaaccgccugucugggcaaagcuuaugcccagauguggucccuuauguacuuccauagacgggaccugagacucgcuagcauggccaucugcucugcggucccuacagagugguuccccaccucccgcacaacguggagcauucacgcccaucaccaauggaugaccacagaggauaugcugaagguguggaaccggguguggaucgaagacaauccuaacaugaccgacaaaacacccguucacuccugggaggauauuccuuaucuggggaagagagaagaccucugguguggcucucugaucggacuuagcucccgcgcuaccugggccaaaaauauucauacggcuaucacccaggucagaaaccugaucggcaaggaggaauacguggauuauaugcccgccaugaagcgguacagcgcgccguuugagucugagggggugcucuga

SEQ ID NO: 21015 - RNA, 9867 nt, Artificial Sequence
  derived and/or modified CDS sequence (opt5) from DENV-4__JN638570__SS-prME
agcaccaucacccugcucugccugauucccacggugauggccuuccaccuuuccaccagagacggagagccucugaugaucguggcuaagcaugaacgggggagaccgcuccuguuuaagaccaccgagggaauuaacaaguguacacuuaucgccauggaucugggcgaaaugugcgaggacaccguuacauacaaauguccccuccuggugaauaccgaaccugaggauauugacugcugguguaaccugacgucugcgugggugauguaugggaccugcacacagagcggagagagacggcgcgaaaagagauccgucgcucucacaccccacucuggcauggggcuggagacacgggccgaaaccuggaugagcuccgagggagccuggaaacaugcucaacgcguggagucuuggauccuuagaaauccuggcuucgcccugcucgcuggcuuuauggccuacaugaucgggcagacgggcauucagcggacaguuuucuuuauccugaugaugcuuguggcccccagcuauggcaugcgcugugucggggugggaaacagagauuucguugaaggcguguccgggggagccugggucgaccuggugcucgagcacggcggcugcgugaccacaauggcucaggggaagccuacccuggauuuugaacugauuaagaccacagccaaagaggucgcucuccugcggacguacuguaucgaagccagcauuucuaauaucaccacagcgacccgcugccccacacaaggagagcccuaucuuaaggaggaacaggaccagcaguacauuuguagacgggauaugguugaccgcggcugggggaacggaugcggccuguucgggaaaggaggcguggugaccugcgccaaguuuuccugucucggcaaaaucacggggaaucugguccaaaucgagaaccuugaauauacagugguugugaccguccauaauggagauacccacgcugugggcaacgacacaagcaaucacgggguuaccgccacaauuacgccuagaucucccuccguggaggucaagcugccugauuacggagaacucacccuggacugcgagccccggagcggcaucgacuucaacgagaugauucugaugaagaugaaaacaaagaccuggcucgugcauaaacagugguuucuggaucuuccgcugccuuggacaaccggggcugacacgcucgaaguccacuggaaucauaaggagagaauggugaccuucaaaguuccccacgccaagcgccaggaugugacaguccugggcucucaggaaggagccaugcacuccgcucuugcgggcgccaccgagguggacagcggggauggaaaccauauguuugcuggccaccugaaauguaagguucggauggaaaagcucagaaucaaagggauguccuacacaaugugcucuggaaaguucagcauugacaaagagauggccgagacccaacauggcacgacaguggucaaggugaaauaugaagggaccggcgccccuuguaaggugcccaucgagauccgcgauguuaauaaggaaaaagucgugggacggauuaucuccagcacacccuucgcugagaacaccaacucugugaccaauauugagcuggaaccuccguuuggcgacuccuacaucgucauuggggugggagauggcgcccugacacuccacugguucagaaaggggagcucuaucggaaaaauguuugagagcacguaucgcggcgcgaagcggauggcuauccugggggaaaccgccugggacuucggcuccguuggaggccuucugacaucucucgggaaagccgugcaucaggucuuuggaagcguguacaccacaauguucggcgggguuuccuggauggugcgcauucugaucggacugcuuguccucuggauuggcaccaacagccgcaauacgucuauggcuauguccugcaucgccguugggggaauuacacuguuucugggauucaccgugcacgcugauaugggcuguguggucagcuggucugggaaggagcucaagugcggauccggcaucuuugugauugacaacgugcacaccuggacagaacaguauaaauuccaacccgagagcccugcccggcuggcguccgccauccuuaaugcucauaaggagggggucuguggaaucagaucuaccacacgccuggaaaacguuauguggaaacagauuacgaaugagcucaacuacgugcugugggaaggcggccacgaccugaccguggucgccggggaugugaagggaguucuuagcaaaggcaagcgggcucucgcgcccccugugaaugaccugaaguauuccuggaaaacaugggggaaggcgaaaaucuuuacccccgagacaagaaacucuaccuuccuggucgauggaccggacacgagcgaaugcccuaaugagcggcgcgccuggaacuuucucgagguggaagauuacggcuucgggauguucaccacaaauauuuggaugaaguuuagagagggaucccccgaaguuugugaccaucggcugaugagcgcugccaucaaagaucagaaggcugugcacgccgacaugggcuacuggauugagucuuccaaaaaccagaccuggcaaaucgaaaaggccagccuuaucgaggucaagacaugccuguggccuaaaacccacacacucuggucuaauggcgugcuggagucccagaugcugauucccaaggcuuaugcggggccuaucagccagcauaacuacagacagggauaugccacccaaacggcuggccccuggcaccuugggaaacucgaaauugauuucggagagugcccgggcacaaccguuaccgugcaggaagacugugaucaucgcgggccuucucugcggacaaccacggccagcggaaagcuggucacacaguggugcuguagauccugcaccaugccgccccuccgcuuucugggcgaggacggcuguugguacgggauggagaucagaccucuuaacgaaaaagaggaaaauauggucaagagccaggugucugccggacaaggcacauccgagaccuucagcauggggcugcucugccugacacuguuugucgaagagugucuucggcgcagaguuacccggaagcacaugaugcucgugguggucacgacccugugcgcuauuauccugggaggccucacauggauggaucugcuucgcgcccugaucaugcucggggacaccauguccggaagaaugggcggccagauucaucuggcgaucauggcuguguucaaaaugucuccgggguauguucugggaauuuuucuucggaagcugacaagccgcgagaccgcccucauggugaucggcauggccaugacgacaguccuggcuauuccccacgaccucauggaguucaucgaugggaucucccugggacuuauucugcucaaaauggugacccacuuugacaacacacagguuggcacccuggcccuggcgcuuaccuucaucaagucuacaaugccucuggugauggcuuggagaacgauuauggccguccucuuuguggucacccugaucccccucugucggacaagcugccugcagaaacaaucccauuggguggagauuaccgcccuuauccugggggcucaggcccucccuguuuaccugaugacacugaugaagggagcuucuaagcgcagcuggccccuuaaugaaggcauuauggccgugggccuggucucccuccuggggagcgcgcuccugaaaaacgaugugccucuugccggacccaugguugcuggcgggcugcugcucgccgcuuaugugaugucuggauccagcgccgaccugucucuugagaaggccgcuaaugucagaugggaugaaauggcggacaucaccggcuccagcccgaucauugaggugaaacaggaugaggacgggucuuucuccauccgggauguggaagagacgaacaugauuacacugcucguuaagcuggcccucaucaccgucagcggacuguacccucuugcuauucccgugaccaugacacugugguacauguggcaagugaaaacccagagauccggcgcccugugggacgucccuagccccgccgcugcccagaaggcgacacucacggaaggcguguaucgcaucaugcagcgggggcuguuuggaaagacccaaguuggcguggggauccacacagagggagucuuccauaccauguggcacgugacaagaggcucuguuauuugucaugaaagcgggcgccuugagccguccugggcugaugugcggaaugacaugaucucuuacggaggcggcuggagacugggggauaaaugggacaaggaggaagacguccaggugcucgccauugagccuggcaagaaccccaagcacguucagaccaaaccuggccuguucaagacgcucaccggggaaaucggagccgugacacuggauuuuaaacccggcaccagcgggucccccauuaucaaucgcaagggcaaggucaucggacuuuauggcaacgggguggugacaaaaucuggagacuacgucagcgcuauuacccaggccgagcggaucggcgagccugauuaugaaguugacgaggauauuuucagaaagaaacgccugacaaucauggaccugcacccgggggcgggaaagacgaaacggauucuccccuccaucgugagagaagcucugaagcggcgccuuagaacccugauucucgccccuacacggguggucgccgcugagauggaagaggcccugcgcggccuccccaucagauaccaaaccccugcugugaagucugagcauaccgggcgggaaaucguugaucugaugugccacgccacauuuacgaccagacuucugagcuccacacgcgugcccaauuauaaccugauugucauggacgaggcgcauuucaccgauccuagcucuguggccgcucggggcuacaucuccacaagaguugaaaugggagaggccgcugccauuuuuaugaccgccacgccgcccggcacaaccgacccuuucccccagagcaauucuccuaucgaagauauugagcgcgagauccccgaacgguccuggaacaccggguuugacuggaucacagacuaccagggaaaaaccgugugguucgucccgagcauuaaggcuggcaaugauaucgcgaacugccucagaaaauccgggaagaaagugauucagcugucucgcaagacauuugacaccgaguauccuaagacgaaacuuacagauugggacuucgucgugaccacagauaucagcgaaaugggagccaacuuucgggcuggcagaguuauugacccccgcagaugucugaagcccgugauccucaccgaugggccugagcgggugauccuggccggccccauuccugucacgccggccuccgcugcccaacgcagaggacggaucggccgcaaucccgcgcaggaagacgaucaguacguuuucagcggggacccucugagaaacgaugaggaccacgcucacuggaccgaggccaaaaugcuccuugauaauauuuauacacccgaaggaaucauuccuacccuguucggccccgagcgggaaaagacacaagccaucgacggggaguuuagacugcgcggagagcagcggaaaaccuucguggaacucaugagacgcggcgaccugccgguguggcuuucuuacaaggucgcuuccgccggcauuagcuauaaggaucgggaguggugcuuuacaggggaaagaaacaaucagauccuggaggaaaacauggagguggagaucuggacccgggaaggagagaaaaagaaacuccgcccuaaguggcuggacgcgagaguuuacgccgaucccauggcucugaaagacuucaaggaauuugccucuggccggaaaagcauuacgcucgauauccuuacagagauugcuucccugccuaccuaucugucuagccgcgccaaacucgcucuggacaauaucgugaugcuucauaccacagaaagagggggaaaggccuaccagcacgcgcugaacgagcuccccgagucccuggaaacccugaugcucgucgcccuucugggcgcuaugacagccgggauuuuccuguuuuucaugcaaggaaaaggcaucggcaagcucucuauggggcugaucgcuauugccguggccagcggacuucugugggucgcugagauccagccucaguggauugcggccuccaucauucucgaauuuuuccugauggugcugcucguucccgagccggaaaaacagcggacgccucaagauaaucagcuuaucuacgugauccugaccauucugacaaucauugcucucgucgccgccaacgagaugggccugaucgagaagaccaaaacagacuuuggguucuaucaggugaaggcugaaaccacgauucuugauguugaccugcgccccgccagcgcguggacccucuacgccguggcuacaaccauccugacacccaugcugagacauaccauugagaauacgucugccaaccucucccuugcugccaucgcgaaucaggccgcuguccugaugggacugggcaagggguggccucuccaccggauggaucugggagugccgcuucuggccaugggcuguuauagccaagugaaccccacaacccucacagcuucccugguuaugcugcucguccauuacgccaucauuggcccugggcuucaggcuaaagccacccgcgaagcgcagaagagaaccgccgcuggaaucaugaaaaaucccacaguggacggcauuacggugaucgaucuggagccuauuucuuaugaccccaaguuugagaaacagcuggggcaagucaugcuccugguucuuugcgccggacagcugcuccugaugcggaccacaugggcuuucugugaagugcugacccucgccacaggcccuauccuuacccugugggaggggaacccgggaagauucuggaacacgacaaucgccgugagcaccgcgaauauuuuucgcggcuccuaccuggcuggcgccgggcucgcuuucucucugaucaagaacgcccagacaccccggagaggaacaggcaccacaggggaaacgcuuggagagaaguggaaacgccaacugaauagccucgaccggaaggaauuugaggaguauaaaagauccggcauucuggaagucgaucgcaccgaggccaagagcgcucugaaagacgggucuaagaucaaguacgccgugucccggggaacaagcaaaauuagauggaucguugaacgcggcauggugaagccuaaaggcaaggucguggaucucgggugcggacggggcggguggucuuacuauauggcgacccuuaaaaacguuacagaggugaagggauacaccaagggcgggcccggacacgaagaaccuauccccauggccacguauggcuggaaucuggucaaacugcacuccggcguggacguguucuacaagccgaccgagcaggucgauacacuccugugugacauuggggaaagcucuagcaacccuaccaucgaggaaggaagaacacuucgcguucugaaaaugguggagcccuggcucuccucuaagcccgaauuuugcauuaaagugcugaauccuuauaugcccaccgucaucgaggagcuggaaaagcuccagcggagauacggcgggagccuugugcgcuguccucuguccagaaacagcacacaugagauguauuggguuuccggagugucuggcaauauugucagcuccgugaacaccacgucuaaaaugcugcucaaucgguucacaacccgccacagaaagccgaccuacgaacgggaugcugaccugggggccggaacaagaagcguuuccacggagaccgagaagcccgauaugacaaucauuggccggcgccuucagagacugcaagaagaacauaaagaaaccuggcacuacgaccacgagaacccuuaucggacaugggcuuaccauggcucuuaugaagcccccagcaccggguccgcgagcucuauggugaauggagucgugaagcuccugacaaaaccuugggauguugugcccauggucacccagcuggccaugacggacaccacaccguuuggccagcagcgcguguucaaggagaaagucgacaccagaacaccucaacccaagccugggacccgggugguuaugacgacaaccgcuaacuggcucuggacacugcuuggacgcaagaaaaaucccagacugugcacccgggaggaauuuaucuccaaggugcgcagcaacgccgcuaucggcgccgucuuccaggaggaacagggguggacgucugcuuccgaggccgugaaugauagcagauuuugggaacucguggacaaagagcgggcgcugcaccaggagggcaagugugaaucuugcguuuacaacaugaugggaaaacgcgagaagaaacuuggcgaguucgggagagccaaaggaucccgggcuauuugguauauguggcugggcgcccgcuuucucgaguucgaagcucugggguuccugaacgaggaucauugguuuggaagagagaauagcugguccggcguggaaggggagggccuccaccggcugggauacauccuugaagacauugauaagaaagacggcgaucugaucuaugccgacgauaccgccgggugggacacaagaauuaccgaggaugaccuccugaacgaggaacuuaucacagagcaaauggcgccucaucacaagauccuggcuaaagccauuuucaagcucaccuaccagaauaaggucgugaaaguucugcgccccacaccgaagggagccgugauggauaucauuagccggaaagaccagagaggcucugggcaagucggaaccuacggccugaacacguuuacaaauauggaagugcagcucauccgccagauggaggcugaaggggucauuacccgggacgauaugcacaacccuaagggccugaaagagagaguggagaaguggcuuaaagaaugcggaguugaccgccugaagcggauggccaucagcggcgaugacuguguggucaagccccucgaugagagauucuccaccucucugcuuuuucugaaugacauggggaaagugcgcaaggauaucccccagugggaaccuagcaaaggauggaagaacuggcaagagguuccguucugcucccaucacuuucauaaaauuuucaugaaggacggccggucucucgugguccccuguagaaaucaggaugaacugaucgggcgcgcucggauuagccagggagccggcuggucccugagagagacagcgugccucgggaaggccuaugcucagauguggucucugauguacuuucaccggagagaccuucgccuggccagcauggcuaucuguuccgccgugccuaccgagugguuccccacaagccggacgaccuggucuauucacgcgcaucaccaauggaugacaaccgaagauaugcucaaaguguggaacagaguuuggaucgaggacaauccuaacaugaucgacaagacacccguccauuccugggaagauauuccuuaucugggcaaacgcgaggaccuuuggugcggaagccugaucggccucucuuccagagccaccugggcuaagaauauucacacggccaucacccaggugcggaaccugauugggaaagaagaguacguggauuauaugcccgcuaugcgcagauacagcgcccauuuugaguccgaaggaguccuguga

SEQ ID NO: 21016 - RNA, 9867 nt, Artificial Sequence
  derived and/or modified CDS sequence (opt5) from DENV-4__JN638571__SS-prME
agcaccaucacccugcugugccugauucccacggugauggccuuccaccuuuccaccagagacggagagccucugaugaucguggcuaagcaugaacgggggagaccgcuccuguuuaaaacaaccgagggaauuaacaaguguacacuuaucgccauggaucugggcgaaaugugcgaggacaccguuacauacaaauguccccuccuggugaauaccgaaccugaggauauugacugcugguguaaccugacgucugcgugggugauguaugggaccugcacacagagcggagagagacggcgcgaaaagagauccgucgcucucacaccccacucuggcauggggcuggagacacgggccgaaaccuggaugagcuccgagggagccuggaaacaugcucaacgcguggagucuuggauccuuagaaauccuggcuucgcccugcucgcuggcuuuauggccuacaugaucgggcagacgggcauucagcggacaguuuucuuuauccugaugaugcuuguggcccccagcuauggcaugcgcugugucggggugggaaacagagauuucguugaaggcguguccgggggagccugggucgaccuggugcucgagcacggcggcugcgugaccacaauggcucaggggaagccuacccuggauuuugaacugauuaagaccacagccaaagaggucgcucuccugcggacguacuguaucgaagccagcauuucuaauaucaccacagcgacccgcugcccgacacaaggagagcccuaucuuaaggaggaacaggaccagcaguacauuuguagacgggauaugguugaccgcggcugggggaacggaugcggccuguucgggaaaggaggcguggugaccugcgccaaguuuuccugucucggcaaaaucacggggaaucugguccaaaucgagaaccuugaauauacagugguugugaccguccauaauggagauacccacgcugugggcaacgacacaagcaaucacgggguuaccgccacaauuacgccuagaucucccuccguggaggucaagcugccugaauacggagagcucacccuggauugcgagccccggagcggcaucgacuucaacgaaaugauucugaugaagaugaaaacaaagaccuggcucgugcauaaacagugguuucuggaccuuccgcugccuuggacaaccggggcugauacgcucgagguccacuggaaucauaaggaaagaauggugaccuucaaaguuccccacgccaagcgccaggacgugacaguccugggcucucaggagggagccaugcacuccgcucuugcgggcgccaccgaaguggauagcggggacggaaaccauauguuugcuggccaccugaaauguaagguucggauggagaagcucagaaucaaagggauguccuacacaaugugcucuggaaaguucagcauugauaaagagauggccgaaacccaacauggcacgacaguggucaaggugaaauaugaggggaccggcgccccuuguaaggugcccaucgaaauccgcgacguuaauaaggagaaagucgugggacggauuaucuccagcacacccuucgcugagaacaccaacucugugaccaauauugaacuggagccuccguuuggcgauuccuacaucgucauuggggugggagacggcgcccugacacuccacugguucagaaaggggagcucuaucggaaaaauguuugaaagcacguaucgcggcgcgaagcggauggcuauccugggggagaccgccugggauuucggcuccguuggaggccuucugacaucucucgggaaagccgugcaucaggucuuuggaagcguguacaccacaauguucggcgggguuuccuggauggugcgcauucugaucggacugcuuguccucuggauuggcaccaacagccgcaauacgucuauggcuauguccugcaucgccguugggggaauuacacuguuucugggauucaccgugcacgcugacaugggcuguguggucagcuggucugggaaggaacucaagugcggauccggcaucuuugugauugauaacgugcacaccuggacagagcaguauaaauuccaacccgagagcccugcccggcuggcguccgccauccuuaaugcucauaaggaaggggucuguggaaucagaucuaccacacgccuggagaacguuauguggaaacagauuacgaaugaacucaacuacgugcugugggagggcggccacgaccugaccguggucgccggggacgugaagggaguucuuagcaaaggcaagcgggcucucgcgcccccugugaaugaucugaaguauuccuggaaaacaugggggaaggcgaaaaucuuuacccccgaaacaagaaacucuaccuuccuggucgacggaccggauacgagcgagugcccuaaugagcggcgcgccuggaacuuucucgaaguggaggacuacggcuucgggauguucaccacaaauauuuggaugaaguuuagagaaggauccagcgagguuugugaucaucggcugaugucugcugccaucaaagaccagaaggcugugcacgccgauaugggcuacuggauugaauccagcaaaaaccagaccuggcaaaucgagaaggccucucuuaucgaggucaagacaugccuguggcccaaaacccacacacucugguccaauggcgugcuggaaagccagaugcugauuccuaaggcuuaugcggggcccaucucucagcauaacuacagacagggauaugccacccaaacggcuggcccuuggcaccuugggaaacucgagauugacuucggagaaugccccggcacaaccguuaccgugcaggaggauugugaccaucgcgggccgagccugcggacaaccacggccuccggaaagcuggucacacaguggugcuguagaagcugcaccaugccuccccuccgcuuucugggcgaggauggcuguugguacgggauggaaaucagaccccuuaacgagaaagaagagaauauggugaagucucagguguccgccggacaaggcacaagcgaaaccuucuccauggggcugcucugccugacacuguuugucgaggagugucuucggcgcagaguuacccggaagcacaugaugcucgugguggucacgacccugugcgcuauuauccugggaggccucacauggauggaccugcuucgcgcccugaucaugcucggggauaccaugucuggaagaaugggcggccagauucaucuggcgaucauggcuguguucaaaaugagcccuggguauguucugggaauuuuucuucggaagcugacaucccgcgaaaccgcccucauggugaucggcauggccaugacgacaguccuggcuauuccgcacgaccucauggaguucaucgacgggaucucucugggacuuauucugcucaaaauggugacccacuuugauaacacacagguuggcacccuggcccuggcgcuuaccuucaucaagagcacaaugccccuggugauggcuuggagaacgauuauggccguccucuuuguggucacccugaucccucucugucggacauccugccugcagaaacaaucucauuggguggaaauuaccgcccuuauccugggggcucaggcccuccccguuuaccugaugacacugaugaagggagcuagcaagcgcuccuggccucuuaaugagggcauuauggccgugggccuggucagccuccuggggucugcgcuccugaaaaacgacgugccccuugccggaccuaugguugcuggcgggcugcugcucgccgcuuaugugauguccggaagcucugccgaucugucccuugaaaaggccgcuaaugucagaugggacgagauggcggauaucaccggcagcucucccaucauugaggugaaacaggacgaagauggguccuucagcauccgggacguggaggaaacgaacaugauuacacugcucguuaagcuggcccucaucaccgucuccggacuguacccgcuugcuauuccugugaccaugacacugugguacauguggcaagugaaaacccagagaagcggcgcccugugggauguccccucuccugccgcugcccagaaggcgacacucacggagggcguguaucgcaucaugcagcgggggcuguuuggaaagacccaaguuggcguggggauccacacagaaggagucuuccauaccauguggcacgugacaagaggcagcguuauuugucaugaguccgggcgccuugagcccucuugggcugacgugcggaaugauaugaucagcuacggaggcggcuggagacugggggacaaaugggauaaggaagaggacguccaggugcucgccauugaaccgggcaaaaacccuaagcacguucagaccaaacccggccuguucaagacgcucaccggggagaucggagccgugacacuggacuuuaaaccuggcaccuccgggucucccauuaucaaucgcaagggcaaggucaucggacuuuauggcaacgggguggugacaaaaagcggagauuacgucuccgcuauuacccaggccgagcggaucggcgaacccgacuaugagguugaugaagacauuuucagaaagaaacgccugacaaucauggaucugcacccuggggcgggaaagacgaaacggauucucccgucuaucgugagagaggcucugaagcggcgccuuagaacccugauucucgcccccacacggguggucgccgcugaaauggaggaggcccugcgcggccucccuaucagauaccaaacccccgcugucaagagcgaacauaccgggcgggagaucguugaccugaugugccacgccacauuuacgaccagacuucuguccagcacacgcgugccuaauuauaaccugauugucauggaugaagcgcauuucaccgaccccucuuccguggccgcucggggcuacaucagcacaagaguugagaugggagaagccgcugccauuuuuaugaccgccacgccuccgggcacaaccgaucccuucccucagucuaauucccccaucgaggacauugagcgcgaaaucccugagcggagcuggaacaccggguuugauuggaucacagacuaccagggaaaaaccgugugguucguccccuccauuaaggcuggcaaugacaucgcgaacugccucagaaaaucugggaagaaagugauucagcugagccgcaagacauuugauaccgaauauccgaagacgaaacuuacagacugggauuucgucgugaccacagacaucuccgagaugggagccaacuuucgggcuggcagaguuauugauccucgcagaugucugaagcccgugauccucaccgacgggcccgaacgggugauccuggccggcccuauucccgucacgccugccagcgcugcccaacgcagaggacggaucggccgcaauccggcgcaggaggaugaccaguacguuuucucuggggauccccugagaaacgacgaggaucacgcucacuggaccgaagccaaaaugcuccuugacaauauuuauacaccugagggaaucauucccacccuguucggcccugaacgggagaagacacaagccaucgauggggaguuuagacugcgcggagaacagcggaaaaccuucguggagcucaugagacgcggcgaccugcccguguggcuuuccuacaaggucgcuagcgccggcauuucuuauaaggaccgggaauggugcuuuacaggggagagaaacaaucagauccuggaagagaacauggagguggaaaucuggacccgggagggagagaaaaagaaacuccgcccgaaguggcuggaugcgagaguuuacgccgacccuauggcucugaaagauuucaaggaguuugccagcggccggaaguccauuacgcucgacauccuuacagaaauugcuucucugcccaccuaucugagcucccgcgccaaacucgcucuggauaauaucgugaugcuucauaccacagagagagggggaaaggccuaccagcacgcgcugaacgagcucccugaaucucuggagacccugaugcucgucgcccuucugggcgcuaugacagccgggauuuuccuguuuuucaugcaaggaaaaggcaucggcaagcucagcauggggcugaucgcuauugccguggccuccggacuucugugggucgcugaaauccagccccaguggauugcggccagcaucauucucgaguuuuuccugauggugcugcucguuccugaacccgagaaacagcggacgccgcaagacaaucagcuuaucuacgugauccugaccauucugacaaucauugcucucgucgccgccaacgagaugggccugaucgaaaagaccaaaacagauuuuggguucuaucaggugaaggcugagaccacgauucuugacguugaucugcgcccugccucugcguggacccucuacgccguggcuacaaccauccugacacccaugcugagacauaccauugaaaauacguccgccaaccucagccuugcugccaucgcgaaucaggccgcuguccugaugggacugggcaagggguggccccuccaccggauggaccugggagugccucuucuggccaugggcuguuauucccaagugaacccgacaacccucacagcuucucugguuaugcugcucguccauuacgccaucauuggccccgggcuucaggcuaaagccacccgcgaggcgcagaagagaaccgccgcuggaaucaugaaaaauccuacaguggauggcauuacggugaucgaccuggagcccauuagcuaugauccuaaguuugaaaaacagcuggggcaagucaugcuccugguucuuugcgccggacagcugcuccugaugcggaccacaugggcuuucugugaggugcugacccucgccacaggccccauccuuacccugugggaagggaacccuggaagauucuggaacacgacaaucgccguguccaccgcgaauauuuuucgcggcucuuaccuggcuggcgccgggcucgcuuucagccugaucaagaacgcccagaccccgcggagaggaacaggcaccacaggggagacgcuuggagaaaaguggaaacgccaacucaauucccucgaccggaaggaguuugaggaauauaaaagaagcggcauucuggaggucgaccgcaccgaagccaagucugcucugaaagauggguccaagaucaaguacgccgugagccggggaacaucuaaaauuagauggaucguugagcgcggcauggugaagcccaaaggcaaggucguggaccucgggugcggacggggcgggugguccuacuauauggcgacccuuaaaaacguuacagaagugaagggauacaccaagggcgggccuggacacgaggagcccaucccuauggccacguauggcuggaaucuggucaaacugcacagcggcguggauguguucuacaagcccaccgaacaggucgacacacuccugugugauauuggggagucuagcuccaacccgaccaucgaagagggaagaacacuucgcguucugaaaaugguggaaccuuggcucucuagcaagcccgaguuuugcauuaaagugcugaaucccuauaugccuaccgucaucgaggaacuggagaagcuccagcggagauacggcgggucccuugugcgcuguccccugagcagaaacuccacacaugaaauguauuggguuucuggagugagcggcaauauugucuccucugugaacaccacgagcaaaaugcugcucaaucgguucacaacccgccacagaaagccuaccuacgagcgggacgcugaucugggggccggaacaagauccguuucuacggagaccgaaaagccggacaugacaaucauuggccggcgccuucagagacugcaagaggaacauaaagagaccuggcacuacgaucacgaaaaccccuaucggacaugggcuuaccauggcagcuaugaggccccuuccaccgggagcgcgucuuccauggugaauggagucgugaagcuccugacaaaacccugggacguugugccuauggucacccagcuggccaugacggauaccacacccuuuggccagcagcgcguguucaaggagaaagucgacaccagaacaccgcaaccuaagcccgggacccgggugguuaugacgacaaccgcuaacuggcucuggacacugcuuggacgcaagaaaaauccuagacugugcacccgggaagaguuuaucagcaaggugcgccucaacgccgcuaucggcgccgucuuccaggaagaacagggguggacgucugcuuccgaagccgugaaugacagcagauuuugggagcugguggauaaagagcgggcgcuucaccaggaaggcaagugugagucuugcguuuacaacaugaugggaaaacgcgaaaagaagcugggcgaguucgggagagccaaaggaucccgggcuauuugguauauguggcucggcgcccgcuuucuggaguucgaggcucugggguuccucaacgaggaccauugguuuggaagagaaaauagcugguccggcguggagggggaaggccugcaccggcuuggauacauccuggaggauauugacaagaaagauggcgaccucaucuaugccgaugacaccgccgggugggauacaagaauuaccgaggacgaucugcuuaacgaagaacugaucacagaacaaauggcgccccaucacaagauccucgcuaaagccauuuucaagcugaccuaccagaauaaggucgugaaaguucugcgcccuacacccaagggagccgugauggacaucauuagccggaaagaucagagaggcucugggcaagucggaaccuacggccucaacacguuuacaaauauggaggugcagcugauccgccagauggaagcugagggggucauuacccgggacgacaugcacaacccgaagggccuuaaagagagaguggaaaaguggcugaaagagugcggaguugaucgccucaagcggauggccaucagcggcgacgauuguguggucaagccucuggacgaaagauucuccaccucucuucuguuucucaaugauauggggaaagugcgcaaggacaucccccagugggagcccagcaaaggauggaagaacuggcaagaaguuccuuucugcucccaucacuuucauaaaauuuucaugaaggauggccggucucugguggucccguguagaaaucaggacgagcugaucgggcgcgcucggauuagccagggagccggcuggucccucagagagacagcgugccuggggaaggccuaugcucagauguggucucuuauguacuuucaccggagagaucugcgccucgccagcauggcuaucuguuccgccgugcccaccgaaugguucccuacaagccggacgaccuggucuauucacgcgcaucaccaauggaugacaaccgaggacaugcugaaaguguggaacagaguuuggaucgaagauaaucccaacaugaucgacaagacaccuguccauuccugggaggacauucccuaucuuggcaaacgcgaagaucuguggugcggaagccucaucggccugucuuccagagccaccugggcuaagaauauucacacggccaucacccaggugcggaaccugauugggaaagaggaguacguggacuauaugccugcuaugcgcagauacagcgcccauuuugaauccgagggaguccucuga
